United States Patent 12,642,819 (COMPOSITIONS AND METHODS FOR TREATING INFLAMMATORY BOWEL DISEASE) - sequence listing, part 58

SEQ ID NO: 26 - DNA, 2473844 bp, Bifidobacterium longum (residues 1-1,236,922 of 2,473,844)
  modified_base (655361)..(655457): a, c, t, g, unknown or other
  modified_base (832193)..(832289): a, c, t, g, unknown or other
  modified_base (1330979)..(1331076): a, c, t, g, unknown or other
  modified_base (1999775)..(1999873): a, c, t, g, unknown or other
ctaaacccgaaaaatcatcgtgactaaacccgcaacaactaattgaacacaaacatcgaacgccgtggacggcaacggcatcaacgcggccctctcctcgtcgaacacctcggccacgggcacgtccggcaacctcgggcaacacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgagtacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtagtccgtctccgccagcagacggtcgtgcacgcgcctgatcgtgtgccgctgcttcctgggcagcagacgatcggcctccagccacccgtccaccagatgcgcgtacgggtcgatcttcgacccgtacctgcgatccgccttcggcttgggcgagcaatcctccatatccgcgtacttcgcgaccgtcccgcgatccacatgcagacgacgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggccgcggcaccgatgcctctcacatcaccgggaaacgatgacgacaccggggaaaaccatcagcccacactgcggaaaaacactgccgaacctgtcgaacaaacattgaagcaaaacactcgaaatccctggtgaaccggctgcccggttccgcccacggcacggaggcgaccacgacgccgcacctcgggcagtccacgcgcggcatggcggcgaccagttcgacgcgccagcagcccgaagtcctggccacgccagcggcgcactccgccgccctggtcatacccgcggtgcctccttccgcagcgggagcatctgagcgcgcccgcacgcgggcgcacgcggacctcgagcacgggctcgggacgcaacggcgagtcgacgatccgcacgtcctcgaccaccgtgcctttgacgttgagaagctggttgaatatgctgctcatcaggcgctttttggctgtgcttttcttggtcgttaaacagcctacccaaaaagcgctcttctcttactcccacaacggttcaacaacgaaccaccacccacgaaaacaacaacagcgccgttttttgatccctccctcagtcagcgcgactgacagctccctcacagagagagctcagtttttactgcttgttgatggaacaggcagcggtgtcagtggtgacaccggaatcagtccagcccattggagtttggtcgatggtgaggtcggagacggccttgatagaggtagtcacatcaaaggagtaggtaacggattctccagggccgatattggcgatgctggcatacacggtcttgccattcaaagtctcctgacgactaccagtcaccgtaccacctgaggtttgaagattcgtgaggctgcctcccgcaggagcgtagattaaggttttctctacgccacggccttgttgatcagcgtttacactgagaatatacgttccggcagctccagctatgccaatctggttatcgtctatcgtattcgtcatcgtatattccacatggtaggtctgagaaccatcattattgcaggcggaacgagttatcttcgacgtgcggtgaatataccaccccatctttgacgggttctgctcagtcacatacacacccgcctgcggatgttcctcactgctcggagtctgtgcagtgaagcctgcatcgctaatagtcttctcagtagcctcgtcaaacgaatacattgagaagcaacgaccttccgacatacttcccatcagttgcgctaccttgctcagcttcgtcaaatccaaattagagaacatgttactaactgtttgctcggcgacttgggcaaaataggtgtcctgcatgtaaaccggataatcgatatacaccttgtttaacaggaattcagcagtgttgcctccggcgagcacacggccatcagaaagcgtgatgttgccgttgattttcaccaattcctgcagaaacaccggatcaaccatgagcacaccatccaatggagtgtcacgtccccatgatgtgcgctgccagatagactgcataccttctgcaacacgagaggtatcaggatatacagccaaatcacggatatcgaacgacattttcagaggcccccactgctcgaaaatacgctgttcatcttccgttggatcaccagcaccatacgggatgcactctttgttcgagcggaaatccccaatactaatcttgccgttgtccgtagtcaccacacccacggaaccaatcaggccaccggatgagcgctcctccgaagtggtcatggccatcaacgcgtatgtacgcgcctggccagagccgagaaaattcggcggaatctggaatgtgccagatagctgatcaaccctatcggccaatttcgttaattgagtcttgccggtgttgtaggcatcgttgactatgccgatatgggccttcggcagattctgatatttctggacctgctgttgcagcgattcattggctgagacaatggtcttctgcgcctccagaatcggctgaatattcagctgcccatcccctgtgctcagttgcgcattcttcaaagtagtcagcacattcataaactgcggcgccgagtcgccaatcaatgaatccactaccgaagtcatgccctgcacggcggtaatgtcatcgccatacactggcagtttcgaggcaatgttccacagcgtgccatgcacaatatcgttcgccgcggcggtttcggtcttcgcttgatcgatctgctaactcaccttatcaacgttgtcgagattgctgagatcggatatgccacccaacaattgcaaagcctgctcctcatgagccttaacctgcttggcttcggaatacggtttcaatccgcagaatccacacacgcctaacagcaccacgagcaatgccagaatcgacaccacccatggccagacacggtgccttctgctcggaatacttactgcgtgccctgccctatgcctgctcataccaattcccaaaatgtctgagccaacttgcatatctatgcaatgaccaaccacctattatgccccggtctcttgcgaaaagtgggttcgctccccgcttctgcacatattccgaaccgactgggcacccccaggtataacgtattggggtgcttttgagaggctgcccggccaagcacatgaagagacggtcgccgaaaccatcgattgttgcgcgacatatgacgccgcatgaagaaccgacatgccaaccgacaccgcccaaagccatcaggccgagcaacggaagtggagtgtgtgcgtggctggagagagcggaatcaagaaccgtcgtggcgaactgcaacgagtgctgagccaagaggaatcgtacgttgacggcaagctgagtcatgccgcgtttatttcgatcgcaatcctgaccttcatcacctttgtcggcaactttacccagctgcaactgagctcggcgctgccgatcatcgtgtcggaattccatatttccgtgaccacaggccagtggctgacctccgtgttccagctggttatgggcgtcatggtaccgctgaccgcgttcctgacccgtcgtttctccacccgtcagatcgtgatctgctcgatggcggtgttcacggtcggctccctgcttgcctggctgggcccgaacttcctcttcgtgctgctcggccgcgtgctggaggcagccggcacaggcgtgatgtggccggtgctgcaaatcaccgtgttctccatttacccgctgtctcgccgcgggtttgccatgggcacggtgggcatggccatgagcgtggcgccagccatcggccccaccttgggcggctggcagaccgatgccaacggctggcgctcgatcttcctgaccatgaccatcattggcgtaatctcgctgctggcggccatgttcggactgcataatttcggttcacacgacccttcggcccgcgcggacttcttctcggtgtgcctgtcggtgatcggctttggtgggctgatgttcggcttcaccaattcagagacctatggattcgcggcaccggtcacgtgggggcccatggttgtgggactggtcggcatcgtgtggtttgtgatgcgcaacctgcgcgctggcaagcggtatcgcgaggccgtagccaaggacgagtcggcactcccccagccgccgctgctggacttggaagtgctgaagaaccgttcgttcaccgtcggcactattaccgcgtcgctggcatttttcgccttcagttcgattttggtcatcatgccgctctacatccagactgaccgcggctattcggccacgatgagcggtctgatcatgctgccgggcgccatcggccagtgcgtctcccagttcttcggcggccgcgcgatggatcggttcggcgcgcgcccggtggctttgttcggttcgattgtgttgacccttggcaccttgggcatgtcgctggtggcgatggatacgtggatctggtgggtatcgatctgccagttcatccgtcagatcggcatgggtttcctgctgatgccgattaccacgtggtccctgaattgcctgaacgggccgagcgaagtgtccgccggatcatcggtgacgaataccgcgcgtcagattgcgggcgctgtgggcgcacccgtgttggtgattctgatggaaacgtttgccgctttgcataagcagggcggcgcctccgccgtcgccgcttcgattttcggcattcaatgggcgctgcgaatctccgcaataatctgtctggcaatggtgttgatggtgttcttcggcgtcaagggcgacggtgccggtcgtacgcgagacattatttccttgcgcgcgctgcgcgaacggcgtgcgcggcgtatggctgcgaactgacggcagattcaaccattctcaacataataagaaaccccggttccaacaccggggcttcttattatgttgtgctatcgcaggatttcagctggagtctattacgccctgcccatcagcgtcaggacaatcagcagcacgttgagcgccacaatcagtgccaccacaatcataaaaatcacgtgcttgacggttccatcagcccacttgcccatgagttccttgttatgcgtgtatcgcatcagcggaatcacggcgaacgggatgccgatggaaagcaccacctggccgatgaccagcgcctgagtcgggtccttggcgaaccacagcacaatcagagccggcaccagcgtgaccacgcggcaggcccacatcggggcgttaacgtgcagcagaccgtgcatgatttccgagccggcatacgtgccgaccgatgtggagctcagcgacgaagccagcaggccgatggagaagatcgtgccgatcaccgggccaagcacctgcgtgatcgcccgttgtgcgccgtcgatggagtccgtgccagacatgccgtgcagcgagttggcggcgagcaccagcatcgccagattcacggtgccggccagcaacagcgcccaggccacatcgattttcgagcctctcagctgcgttttgattgacggcttttcgccgcctgcgtaatggtcgttcaccagcgtggagtgcaggtagatggcgtgcggcatcacggtggcgcccagaatcgaggcggccatcaacaccgagtcggcgccttggaagcgtggaatcatgcctttgaccacttcgccggggttcggcggggctacgaacagacccgcgatgaagccgaatgtgataatcagcagcatcacgatgatgatgcgctcgaacgtggtctgtgtcttgccaccttggaaccacagcatcaccgtggagattgcgccgatcaccagaccgccgatgaacagtggaaatccgaacagcaggttcagggcgatggcgccgccgatcacctcggccagatcggtggcgatggcgatgacctcggcctgcataaagaacatgaaacggccggcatcgctcatacgctcgcccagcagttccggcagggatttgttggtcacgatgccgagtttggcggactgatactggatgagcacgctcatggcgttggcgagcaccagcacccacaccaacaggtagccgtatcgtgcgccggaggtgatgttggccgccacattaccaggatcgacgtaggccacggccgccacgaacgcggggccaaggatgctggccagcgcatggtcatgcggcttcttattgttgttcgtccctgctccggccccggttccgactccggcaagctggcgttccttcccgatttccggtgtttcctgttcgatgtctgccacagcgttcgtcatagcggttgccgcagtggcatctgcttcggtgtgtgttactgccatatcgtttgtaccagttcccttcataccgcgcacagttatagcgcaggcctgtttcccgagtcaacagacggacaatctgcggacgattgatggatgaccggcggactggcagctggcatttcccgccatctcgctcatgaaatgtgccagacggtagaaaactcgctcatgaaatgaggtaattactagaaaactcgctcatgaaatgtgccagacggtagaaaactcgctcatgaaagtgtaaaatcattgatatagcagtaattcggaaaggggctcctcatgtatctcaaacgcaaagccgatgcctatctcaatgcatggaaatccgacccgaatcgctccccgctaatcatcaagggccctcgtcaagtaggcaagacagagactatcgattactttgccgcacacaactaccgttcggtagtggaaatcaacttcgttgaggaaccgaaatatcgtgcaatcactgcggacggttatggcgcgaataccatcgtccgcaatatttccctgatcgacccagccaaaaagttcattccgggcgatacgctcatctttttcgacgaaatccaggcccatcctgatatcgccactgcactgaagttctttaaaatcgacggcaaatatgatgtgatttgcagcggttcaatgttgggcatcagctataagcaaatcgaaagcaatagcgtgggatataagaccgactacgaaatgcgatcgttggacttcgaggaatttctgtgggctcgcggatacgatgaggccgtcatcgaaagcatgttcacccacctgtgtaatgctacgccattctctgaagtggaaatgaacgtcttctccacggcatttatggattactgcgtgcttggcggcatgcctgcggttgtcgcctcccatatacgcactggcacgttcgagggaacactgcaattgcagcgccagcttattttggactaccaggaggatatccgcaaatacgcgcaaggactcgatcaggcacgaattctcaacgtgttcaaccatattcccgtgcaacttgccaaggaaaacaagaagttccaaatcagcaaggttgccagcggagcgcgtttcaaagactatcgaggatgcgtggaatggcttgaaacctcgggaatggtgaatatctgccgatgtatgtcctatcctgaactgccgttgaaaggcaattatgacgaaaacaagttcaagatatatttcggcgataccggtctgttcgtagcgatgcttgacgacgaggccagtgatgatctgcgggccaatcgtaatcttggtgtctataagggtgctatgtacgagagcatcgtctctgaagcgctacggaaatccggctatgacctgtactactacaaaaaagaggattccacactggaacaggatttcttcgtccgcacgcgcgaatggctggtgccggtggaggtgaaatcgaaaaaaggcaccgccaaatccatgcggacgctaatcgcttcggattcttatccggaaattcagttcggcgtgaaactatccgccggcaatatcggtagcagcgaacacgtgttcaccgcaccatacttcaccacatttttgctccgacggctcctgcgcgcttatgacgaggggcaggcacctatgctcaacaatcctgagcggtagcccctattcgtctgcgggcacggcctggcccgggcaggtgtggaggacggcgagcatggcgtccttttcttgggaggtgacggtgagctggtacttgtctttgacgccaatctggcgggccacgtagtcgcaacggtagtcggcgttggtgggtagccagtaggcggcggaggccgaacccttctcctgattggccgggccgtcgactgccagcaggttgtaggggtcattgccgaattcatggcgtttggcagtggaccagtcgtgtgcaccggattgccaagcgttttcaagggccaccacatggtcgatctgcactttggcgctggtggcgcggccacgtacgaaatggatggtctgagcggtgtacggatcggccagtgtgccggactcgaccacacaggaaccggcgtatttgtaggtgatgtccgtgagatcgcgggcgagcacgtcgtcgcgtacgtcgcagccattgccgtcgacgtcggtggtgcggaaaccgaaggaatcgcggtcgtagccggaggagctttggttgtcgtctacggcgagtgcgttcaaggtgtcggcggctgaaccggtggcagtgtagccaccggtgattttggctgcgtcggagctgatctgcggcagtagcaggccgatggtcacgccgattgctgcggcgagaacgatgaggatcagcacgcgctccagcggtccggaggcgttgaaacgacggcggaagtgggcgcgacggcgtgccatcaatcacgcataggtgaaggtgagggggtcgtggccggcgcgggtggggccgtcgagggcgtcgatggcagcgtgttcgtcggcggtcagggcgaagccgaacaggtcgagattctccctctgacggtcggcatgcacggacttggggatgatgatcgtgccgttttcgatgtgccagcgcagaatcacctgggccgggctgacctcatgggcggcggcgatcttctcgatggtgccgtcgccggcgttgaggtcggcgccacgcgccatcggcgagtaggcctccacggcgatgccgtgctccttgcagaacgccaccacttcgcgctgctgccacgtggggtgcagctcaatttggttgacggccggccatgcgccggtctccccgtgcagacgcttcagatcggcgggcatgaagttgcatacgccgagcgtgcgtgccatgccttcgtcgcgcagcttgacgaacgccttccaggtgtcggtgctgcgccagtcgaacggcgtgggccaatggatcatgtacatgtccacgtaatcgagctggaggagtttcagggagttgtcgaatgccttgagcgcggagtcgtagccctgctcggagtcgcgcagcttggtggtgacccacagggtctcgcgcttggcgccggtgttgtatccggaagcggcgagcgcacgacccacgccggcctcgttgttgtatccggcggcgccatcgatgtggcggtatccggcttccagcgcagattcgacgacaggggccacgccctcgtcaccgatacgtagcatgccaaggccgacctgcggaatggaatggccgtctttcaaggcgatgtccggcacgttggcgggattgatgtgtccgttggtcatggcttgtgatgctccttcatgtactgcaactacacgccactgtacacggttatgcaggcgatgtgcgggtgctgcaaccaaacggcatgattgcgcccggccttccgtgtgggagagccgggcgcaatcatgacaacatcacgctctactcctgcgaccggccctcgccctattgttcccgggcgcgaatttgccccggtacaggcgtcaatcgattgacgtttgcaccggggcagaaatcgttgtcccggtacgcaatttcgggccattttcgagaaccaggacaagacaatccccaaagtccacataccccaacaaacagaatcggcggaatacagccaatcccgaaatcaacatactgtcccggttctcacgtagaacgattgacgtgcaaaccggggcaacgggaattgtcccggtacgcgaaaaacacccgttttcgcaaaccaggacagtgatttctgtcctggtacccacatcaaacgattgatgcacgaaccgggacagaatcgcatcgccgcgccgagacagacgcatctgacagccgacaaccgataaacgacagccgacagatggcatctgacagccggctgccggctgccggcaaccgcatcataatgccgcatcagtctctatcaggagcgcttacgacgcaaagcaagcgagaccccgccggccacgccgagaacgacaaccgcaagacccacggcagtcaccgcgctaccggtattgctcagcacaccagtgatcttgtcgccattcgcaccgttggtcttatcgccctcgcccgtatcgggattgatagtagccccgccattacccgcaccgtccgagccgttgccggaaccaccttcggcccgagcggtaaccgcaaccgtataggtttcggtgacattcggattcgacttgaacgttacggtaaccttcgccgcatcagcgggagcggagaaatcgtaatcgagcgtgaactggtcggcggaaagcgtcacgttgcccatgcctgcggaatagttgcccacgaccttgagatcatggtcggcatcgatggcatcgcccacctgataggtggttttgcttggcgtgacggtcaggctggagacctccttttgggcgaggccggcaatggcatcggcaacaagcttgatcacatcgttcacgtcctgctcggtgtaggtgctgccggcaagcagcacgtcagcggcggcaagcgcctgatcgagtttggcgagcgactcgttggtgtactcatcgcgattgattttcccggcttcggccacggccttgtccaggttctccgtggatggcttcaccggagtttcggtctttttgacgagtgagaccttgtccacattgccccatgcgtcggcaggcaggttgcccgtgatggtgatggtcgctgtgccatcagcacccacggtgacaggcacggtggcggtatcgaacttaacccaaccgttgagttccagcgcatcggacgtggtcttgccacccgttgtggcggagagggccacaccatcggtaatagcggcgttgtccgctgccgcgccttggctcatggcggtcagcacgtattcgccaggctcgagtccggtgatggtctgcgtggcggagaaactgtaggcatcggatgtccaaaacttcagcgcgcgcttgccgtcggcggcgttgccactgtcttcggtgatggacgcaccggtgccggcaatggtccagttcttatcgttctcagcgttctcgaagctgccgtccgttacgtaatccttggcgggagtggcggtgacggtgacggtgacggtcacgtcgtggccagcgttggtggtgccggtgatggtgtatgtgcctgcgccacgaatccagtcaagcgcagcggattgccaggtcacggtttcggtctcgtccaccccatcctgatagtgtgcggccacctcactcggcaattgcgctttgatcgcgtcgatggaatccgagtcagtcgcggtaatctccactggatctatcttggtgaacacatgatcggtgacggcaccggtgtgaatgtacttgaacgtcggcagagaggcgagcgccttgccatcgaaatcgaacaaagcttggttatcgacacctgagccgccccagtacaggccggcgtcattgggttcgtattcgccggccgcttcagtggcccagccgccaccgtacttgttccacgtatccaccagttcggcgttatccttgccgccggtgcccacgggcacccatgcgggctcccagtagaacacacccaggccgtcgttttcgccatcgccatcattgtcgccgatattgttcacggcctcggcgaccgcgcgaatctcatcggcctggccttgcgggctgatgtcgtatttcttgaggttatcggcggttactttactgggcactgtgttggaatcgtcgtcgccatcatccaaggtgtatgcccacgacgtttccgccaccatcacatctttcttataagtggaggccacgttcttgagcacgctggtgaggttttcggtggtgccatgccagaacgggtagtaggagctggcgaacacatcgtaatccacattgtggttgctcaactgtttggcgtaagtggcgtaggtgccggctttctccgggttggtgaaatgaatgacgaccttggcttcggggagcacttcgcgtatggctttggaacctgcggagaatactttggacatgccgtcccagccggagatgccggcgattttcgcagtggtttcgttgccgacctgcaccatgccgacgtccacgccggcttgtttgaacgtggtcagagtctgcttggtgtagtcgtatacggtgtcggcggttttgtccgcgtcgccttcaaaggatttccacgccttgggcacctgctgcttgctggggtcggcccagaaatcggagtaatggaagtcgaccagcactttcagccctgctgccgtggctcgcttggccatggtcagtgcgcgatcggcgttgacgttgccgccgccatatccttggccgtctgcggtgaacggatcgttccacacacgcagacgcacatagttcacgccggattccttgagcaacgtgaacaaatcctcgacctcgccattggcgttcttgaacgtgacgccgctttcttccagcgagagcatggatgagacgtccataccgccgatgaaatcatcgcttaagccttggatggccttgaccgagacgtcggctttaactggttcttcttcggcggcgtttacagtgaacgtgcctcctgcgcagagcattatggcggccacgccggatgccataatgcgagtaagcacggtatttcggcgcatgctttttctcctttgaatggtgaacgctcagaacgaacgcccagtgatgcttggcgcttcctttccttatgcgccacgcggtacagctgtgtaccacgcaatcgtcaccttagcactttatgccgtgttggtcaaccggtgtatcaacgcctcgtacggcccagtacagcaacaccagcattacagcaatgtcgttcagcgtgtggaggcgcgggcgatgacctgggattcggtggtgagcagttcggacttggtgatgctgccgtcgatgcgtccgaggatgcgattcactgccgtgggagccgtccagtcaaggcgggaatccatggtggtcagcggaatctgcaggtagggggcttcctcgttgttatcgaagccgatgacctgcacctgcacgggcacctcataaccagcggtgcgcagagcggtcaatgcgccgatggccaactgatcgttcaaggcaatcacaccgtcgaatggcacgccggaatcaatgagccgctgggtcacacgggcaccggctccgatggtccaatcctgatcggtgttgccaatcagctgcggatccaaggagagcccacgcctacgggtctcttcgatgatgccgcgcagacgcagctgcgcgttgccttctacggcattcagcaatgcatcttcgtcgtaaacgtcacgggcaccgatcactgcaagtctggtggaaccgcggtcatacaggtagcctgcggccatggcggctgcggatacatcgtctggggtcacgtgatccacaatgccccacgtggtacgcgcgccaacgatgaccagcggaaaatcaaccttcagatcatcgggcgaaatgttttccacctcgctcatggaaaggatcatgccatcggacaccgtggagttgaacttcttcagcagatcgcgcgcgcctttcgcggagccttccgcatacgtggtgacgtatacggaatagtcgcgctgacgggcggcctcgatggtgcggttggcgagctcggccagatatggcggaatcagcgaaggcacggcgagggtgatgaagccggtgtgatcgcggttgaggttgcgggcggccacgttgactcggtagtcgaggtccttaatgaccgactcgaccttggcacgggtctcatctgtcatacgcccggagccattgatcacgttcgacgcagttttgagcgatacaccggcggcctgagcgacatcgcgtagcgtcactcgacgcttggctgttttctcgtcgctcatgccgcactcctctatccggacaacattgccattctagcgcggtttagcaggacgttttagcgataagaatggcgttgcggttcagcgtatatccaacggcgtcagtctcgcaacggtgggcgatgatgggatcaccttccacaccgttgatggcgacgggctggtttgagcggttgaggtagaaatcgaagcgggtggagccgtctgcggatcggcggatggtgtgcaggatgcggggatctgtggtgggataggttggagtttgaccactctcagtcggctgcgccgacaactcctgccatcgggagccaagtgctttgagcaactgggcaatgtcgtgacggttgaggtcgcagcccacgtagatggcggtaccgttgccataggggcggctggtgatggcgggggtgcgctccagctcccagtcggcggcggactcacctgcgtaagaggcaagcactgtggtgtccgcggctacggaagtcacgtcgttctgccacaggcgggtcgtcagaccattggacaggctgatttcgctgggctcgccttcggcttcttcaccgaggatgttgaattcttcggagcggatgccgagcatgtcgcgtaggagcccgttgccggcaccggggtagccgccgaggccgatgtggaagtgctcgtcgatcaggccggcggcatagccgacgatgacggttccgccggccttcgcgaagtcggcgatacggagaacgtcttcgtcggacaggctgagcacggtgggcagcacgatggttttgtagccggtccagtcgtaggcgagcggcaccacgtccgcgcgcagcccggcatccaggaagccgcggtaccagtcgcgcacgtcgtgccagtggttgagtttcatgctgggcagggtttcggagcgtgtggcccattcggattccgcgctgaacaggatcgccgtgccggcacgctcgagctcagtgccctgcagcccggcgtcggagagggtcttcagcgccttaccgagctcgcatacgccgcggaagaccttggaatcggcgcccgcgtggggcagcatggcggagtggaacgcctcggcgcccgacttggattgccgccattggaaaaagcagatggcgtcggcgcccatggccacgtgggccagggagtcgcgcatgagttcgccggcccgtttgcgtgtgttcagcggcttccactgcacggctgaggtggagtgctccatcacgtaccacggcttgcccagcgcgagggagtccatgagcgcgtccgagcaggcgagttcgtccaggtgggattcgccctcatggaagtagtgatcgttggacacgaagtccacctcatccgcccatttggcgtagttcatgacgcactggtcggtggagaccatgaagttcgtggtgaacggcttgtcggggcagatctgctcgatggcgtcgcgttcggctttgtagaagtcgagcagcatgtcgttgccgaaccgctcgtaatccaactgctgcgacgggttgaccatggcgtcgccgcccatgtgacgtggcagcagcacctcgtcgaaactgttcacgtgctgcgaccagaaggccgtgccccacgcctcgttcaacgcgtcgatggtaccgtacttggcctcgcaccacgtgcggaacgcggccaaggcgttgtcggagtagtcgtagcggttgttccagccgtattcgttgcccatgtgccaggcggtcacatacgggttgtccttgtagtgttcggcaagtttgcggcacaggcgcagcgcgtattccttgaacaccgggcttgtgggctgccacgactggcgtgagcccgcgttgacggtatgaccataccggtctaccggcagcacctctggatgggattcgtacagccacagcggcgcggcggctgtggcggaggccaagtccacggcgatgccggctctgccgagcctgtcgatcacatggtcgagccactcgaacgtgaacgcgccctcgaccggctcgatcttgtcccagctgaaaattgccagcgatacgacgttcacgccggcctcacccatgagacggatatcctcgtccagcgtctcctcgggccactggtccgggttgtagtcgccgccgaacgcgatgccgcggccggattccgtcagcagggacggccacctaaatgctctatgagtagtcatattaatcaaatcctttattgtatcggtttgcgggaagtgctgtgcttgcaggttgtgaacaccagagaggccgcccccgctggcggggctgtcagcgaagctgactggggggtggtcgccagtcgaatccccatatgaccaccctcagtccgctccgcggccagctcccgtcagagggagccagaggttactccttgacggcacctgcggcgaggcctgactgccagtacttctgtaggcacaggaacgcaatcaccagagggatgatcgtgatcagcgaaccggtaatcacgaggttttggatagcttgaccgcctgcggttgaagcctggtccttccactggttcagaccgatcgtcaacgggtaccagttggaatccttcaacatgatcaacggcaggaagtagttgttccacgtcgctacaatggcgaacaatgcagtggtcacgatgccgggtgccaacagcggcagggaaatctggaagaaggtgcggaactcgccggcaccatccacgcgcgcggcttcaagcagctcatccggcacggcctgatcggagaagatccacatcagatacagaccgaacgtggataccaaactcgggataatcatcgaccacggggtgttcgtgaggcccatcttggcgaacagcaggaactgcggcacggccagcgcgatacccggcaccgaaatggcgccgatgatgatcacgaagcacagcttacggccggggaagcggaacttggccagcgcatagccgcccatgatggccagcaaggtggcaccgccggcgccgaccaccacatacagaatcgtgttgacgaaccagcggccgaagataccgtcctgataggtgaacaccgtggcgatgttgtcgaacagggcgaacgttttgccgaaaccgaggccgaacgtcgaagtgaagtcggactgggtcttggtggcgttaatcatcaggtagacaaacgggaagaggcagtagaccgcgaaaatcgcgcacacgatggtcagggccatcgagcgggtcgggttcgccgggttggagaaaccggttttggcggcgcgcttgcgctcggccttctcgtcggcgtcgatgcgcttctgacgctccttctcggccttcttggcggccttttcctgagccttgagatcggccagggtcatggttgttgttgaagtcatggttgcagtgctcataattacttcatctgctccttcatactcttaagctggacgacatacgcaatggccatggtgatgatggccatcacgatggccagagctgcggcatagttgctctgattgccggtgaagctcaggttgtaggcgtacatgttcggcgtgtagtacgtggtgatcgcgttgcccggaaccatgttctgcaaaatgctcggctcgttgaacagctggaagctgccgatgatcgagaagatcaccgtgatggccagcgagcccttcagctccggcagcttgatcttcttaacaatctgccactccgaagcgccgtcgatggaggcggcctcatacaagctgtgcggaatggtgcttagggagctgtaaaaaatcagcatgttgtagccggcatattcccacgtgttgatgttcgcgatggatgcaagcagcacgtcggggttgagcacatcgatgttggtgccgaggaagtcgttgagggagccgaccagaccgtatttggcgccatacacgaaaccccaaatcatggtggagaccactgcgggcaccgcatagggcaggaatgtggagatgcggaagaacttggtgccatgcagcttcatcgaatccaaagcgagggccatggctgcggccagaaacagcatgatcggcacctggaatacggtgaagatagtgacgcggcccaccgagctccagaactgcggatcctgaatcagtcgggcgtagttctcgaagccgacgaacttggtgccgccgaccatctgcttcttgaagaaggagatgtaaatggcgtacacaattgggatgatgaacacgaagacgaacaccacggcgaacggccacatgaacttccagccgcgccagtcggccttgtgcttgttgacgcgggcctcggccgtgtgcagatccgcctcctcaggcaggattcccaccgttggctgcggggctgcggccattgtttgatcggacataatcgattgctttcttggaatacggattgctgtgctgcgcccgctaccagggggtcgctcgattggagcggtcacgtcaggcgagggcacgggaaagcggggacactggggagcatccccgctttgggagatcgggcggctaggcggaaggagagtggcctagccgcaggttttgattgttggtcagtgccggatgtaccggcaatagatcggttgcgtcacttgacggtgacgttgtagccctgctgattgccttgctcggcgagcttgttggcatagttttcaagcgccttctccagggtgatgtcgccggagtaggccttggagacttcgtcgccgtaagcggtctgggcgtacgggttgtacggcaggtactggaacttctcggtcgggcgctgagccgcggcggaaaggacttcgttgacgttctgaccgccgaagtagtcgttggtcttcttgttggactcggtggtcgggtcggtgaaggagtcggaccggaggatcttcttcagggacgggaaggtaccggtgtcggccatggtctgagcgccctcgccatgagtcatgtactcaacgagcttgtaggcagcggcctggttcttggactgcgaggtgacggcaagtgcagagccaccgtcttcggcggagacttccttgccttcctcccactgcggcagctgggcgacgcgccagttgccggcctgatcgggggcgccggtcatgaggttgatcggcatccaagcgccgatggtcagggaggcgagggtgccatcgttgagctcgcggttccaatcgtcggaccagttcggggtcttggcgtccacgaggtcttcgtcgatgagcttctggacgaattggatatagcgctgcatgccctcgtccttggtcatgttgatggtgatgttctcgccatcgaccttccacggctgggcaccggcctgccagatctgggcggtgaacggctgatagtcgttggaggtaccggccagattggtgatgtaggagccggtggcacggatcttcttggcggcctcgtagtagtcgttccaggtcttgatggactcgccgtccacgccggccttgtcgaacactgccttgttgtagaagaacatttcggggccggaatcaatcggcagagcgtacggcttgttgttgtactggagcttgttccacgggccggcggcgaagtcgtcggcgagtttgtcggcgccgaattcgctcaggtccacgaggccatcggtgacggcgaactgggtgacggtcggatcttcgagcatcacgacgtcaggggcgccgttgcctgcggcgatggcgttggagagcgcggtggaggtcttctcggcggtgccggtgttgttgaacttgacggtgatgccggggttggccttctcgaagtcagcgaggatttccttcatcgagttgccggaatcccagccccagaacacgagttcggccttgtcagcgtcacccttgttggcgccgttgtcgttgctgctgccgcaggcggcgagaccgacgagcgtggccacggctgccgttgccgcgatgaccttcttggtgttgcgcatgttatctccttctggaccattggagttgacttgcgggtggttggctttcttccgactggcttccggttttcgtccggttacttctcggttatcttccggctgtctttggctgccttccgattgttgacgactgccttccgattgccaaaaacgaatcgactgctgcgttggatttcaattcgtttggccgcttgcgaagtctcctctggccacctttccttggggtgttttctttggtacacccgtgtaccaatacctaagatgatacacctgtgtaccaatttgtcaaatcacccgacacgcctgatttttttcgccttttccatgctttccacgtgagcaaatctccagtcgaacagcgacttgtctcagaggctcttcatcccctcccccaacgtgagtaggtcccgactctcagcacaccaccaaataacgcgcagcatgctcgtgagtccccaacacccacacaccacggcgcgattccaccactcagccgcctcaccagtgcccacatttgtagatattcaacgccatatgacaagaatctgactagtatgaacaggcacccccccatagctgtattgagaggaaaagcacatggcgggcctgtttcaagctgcttccaagcagcgcaatcccttgggaacaaccatacgtactcacggatcgggcaaatatacgttcggtctggccttaagcgccggtcaatatccgcggtctgcttgccttttcctatcagctcctcgcggtatgcggcatcttcctgaccaatgtcatcaactacatcatcgcctcctacggttccagaagctgggatgtcaacgccggttggcgttggatgctgaggctgggtgcgattccggccgccgcgttcctgctctccatggtgcgagcaccggaaagcccacgattcctcattcaagccggcaaaaccgaagagggattcgcggtgctcgagcacatcatcggcaccgaacaggcacgccttcgcactgacgacatccatgcatcggtcaaactcgaaaccgaaatgtcgcatgaatttcacgacctgttccgcccagggctgcagaaggcgctcatcatcggcactttgatcaaggcgtgaatgctgcgttgcgttactgcattgccatgttgccgcgttattgcatcgctacgttgccacgttgtcgcgttattgcatcgctacgttgccacgttgccgcatcacattgcattgccgcattgctgcgttgccgcatcacatatcgcaacacaaacgcagcaacgcaatgacgaccggagatggcatcgccgccacccgcgaggaaccgcagtgcaacgcggtaacgtaacgcaatgcgatgtgattcccgcgtagttacaggcagttacagattgagtaccgcatcagcaatgcgcatggcggattcgcggtgggagaccagcaccacagccgcgccgcgctccttgtctgcatgctgctcacccacggccatagcgtgaatggaacgtagaataatagcctcgttcaaagcatccaaacggctggtcggctcgtcgaaaagcaccagatcagcattgcgcaggaacacacgagccaaaccgatacgctggcgttcaccttcggatagacggtcgcccaactcgcctacctgagtatcaaggccatcgggcagggaatcaatgagatcaagcacggaggccttggcgagagcctgacgcaaacgagcatcgagaccgtcagctgctgccacccgaacggcatcgccctctgccgattgcgccgccaactgctgctgtcgggaatcaacggtcttggcacccacttccccattgcctgcaacatttgcagcttcaacctcggactcaggcaaagcaatcagcagattgtctcggatagagccatcaaacaggtgggtttcctggctcatcatggcctgaatacgtcggcgagcatgcacatcgacctcgggcaacggcgtgccggacaacgtcacctgaccgcgctgcggatcccagtagcgcagcagcagcttgagcatggtggacttgcctcggccggacggcccctggatacccagcacgccatgctgcggcacgtcaagcgagaagtcggacaggacttcgcgctcccccgcatatgcaaaggtgacgtcatcaagacgcatgcccatatactcctgcggcacaacagtgccgttctcggtcacagcgggcacctcgtccatcagtccgaacagtcggctagcggacgcgaaggtctgagtcaggttagcgggcaaggcggcgagcgccaaagtcggtccgaacgagccggcgaacagcacgaaggcggcaatcagagccggaatgctctgcgggttcgcgccggcacaggcaatagccacggcgaccgaagccgctgtgagcacagccaccaagagtccgctgattccggtgaaacggccgttgaccttgctgagtttggcgtgatccttccacaacgcatgggtacggtcctcgatggtctgcgcacgttcctcgccgcggccaaatcggatgatttcgtccaggccgcgcatgtcatcgagtatcacatcgtcgagttctccggcagcgccacggatggcagggccaaggttacgtacgccggtggcaaagaatcgcggcacaaggatgccgataaccaggtgggcggcaatcaacgccagcgccatccatgggcttagggtggcggccacaatcgtgtagatgatggtggaggttaccgcgatggccaccggactgatggtatgggcaaagaagatctcaagcagttccacatcggtggtcagcatggcgataaggttgcccttacctttgcccgcgagcttggccggcgccagtctgcgcaacgcggcgaacgccttggaacggaagagtgcgagcagatggaatgccacattgtggttcagatattgttcaatgtatcgggtgatgccacgcagaagagcacagataatcatcatgatgacggcgggcgcaacacccatgccccacaccggattaccggtaagtgcaaatgccgcgataatgccgaacacgggcaggaaagtggccgaaagatggccgatggtgccggcggtggaggccgctgccatcagtcctgccagaggtcgggcttccttaagcagtcgcctgatcacttggaatgtgctcattttggaagacgaatcgctatttgcaacaccagccggagtctcagccgaggcctgctcactcccgccaacggaagccgtcggcaaagctgactgcaggcggtcaaccgtcatacccgcctctgcgcttacgcgcgctgcgccaccctcagtccgactgtcgtcggacagctcctgcttgcgggaaccaacctgcagcacacgccgagcatggccttctccgaagttctcaatatctgcctgcgtggtaaacagcttggcgtagacgccgtccgccgtcatcagctcggtatgggtgcccctctcaaccgacttgccgtgttcgagcaccaccacttgatcagcgtgttcggcgttggccatgcgatgggtgatcataataaccgtcttgccgcgggattgcgccaattcgcgaattgtatccaggatcagctcttcggattccatgtcaacgctgctggtcgcctcatcgaacacaaataccggcgaatcatgcaggagcgcgcgggcgatggcgatgcgctggcgttggccgccggacaggttggcggcatcggactcaatcggcatgcccagtccgttcggctgtgcgtgcacgaagtcggcaatgcgcgcctgctcgagcgcggaccacagacgggagtccacggaatccggcgaatcaggaatctcgtcatcgggcaaggccatcagaagattctcgcgcaatgcgcccgcaaacagatggctgctggcaccaatcacagtgacggctccggccagtgtttcgcctgacaaatcggatacctcgacaccgttcagcgtgagcgaacctcggtaaccggccagtgtaccggcgagcagcgaggcggccgtggacttgccggaaccggagatgccaacaatggcggtgaactgaccgggccgtgcggcgaaggtgatgttggtgagcgcaggagcgacggcggaattggggctggtttcaccttgcttatcggtctttgcggatgcggacttggagtcgccgtgcccggcatcatcataggaatagccgacgtggtcgaagcggaccgtcagaccgtcgtcagcggaatcggaatcgttggccggcagggtcgccgtgccatgctcgggctccggggtgtccagcagagcgaagatgcgcttggtggaggtcatgccgttcatcgccacgtggaagaacgagccaagctgacgcatgggaataaagaattcggcggacagcagcacaatgaacagcagaccggtaagagacagcgggtagcccaccccgaacgggatgagatagtgcaggccgtatgccgcgtaggcaagcacaccaggcagatgtgaggccagtgcgattggcgaccagccggacgcaccattggcaaaagcatcgccaatatgcgcgtattgccataacgccacaccgatgccggccgcagcaccgccgtaggccactatgtccatggcggtcagcgagcgcagctggatctgcagcacgcgcatggtcatgacgcggaagccttcggctttcttgtccatctcgatggcggcgcgctcgtcggcgtcgaagtttttcagggtctcaaggccttggagattgtcgaggaacgcggcgcccatatcggtgtagcgcacccagtacttcttgaaggcgcgggcggcggtcatggagacgatgccggtcacgatgatgatgaacggcgcgcagaccagcatgacggcagcggcgggcacgttaatcggcgcaatggccacgaacaaggtgattggcgcaagaatcgcatagaagagctgcggcaggaacagttcaaagaagctttgaatctgttcaacaccttcgccggcggattgcaccacatccgaggtcttgatgcgggttttgtaggacgggccgagtgccaccattttgcggtacagcttggagcgcaaagcgagcttgactcgttcggcggcttcggtgccgagacgggtggcgtgcgtggtggccgtgtaacggaccgctatacagaccagcgcaagcagcacgtaaatcatgacgtcgccagccatgggcagcacatccgcgccgtgccgatcagacaacggcacggggcaggccgcgccttgcgaagtgccgccgcattggagcagcggcggtgccacagcggtcagtaagctgttcagcagcattaccagcgacagcataaaaccaatgttggcaagcagacctacccacatcagggccactttgccagctatgagttttttcaagccaggcgccaattggaacagtcgtttgtcgaacatggtccgcttccccttgccgtgttgttgcggtgtgccctcgtcatgtgtacctgcgctccacattccgcgcaatcccattcaccttaagcgaacgccctcgcacacgccagacttttaaagtgagagaggccacagaattatcgattgcggagtgcgcatgctagacgcgccaaccaaaaaaatatgcttcgatatcaggggctgaagcatccactacacccaatacgtgcatttatccgtttcgaggaggctcatttttgcgtttgccggaggcctacttccgtttcaaggggctgatttcgcatttgccggaagtctatctccgcttcgaggggctcctcatccatgtaatcggaagtataaacggctacacgtcaacgtcattccgccgttttagggccgtgtctacttgggcatcagcccctcgaagtggaagtagacttccagataaggcaaaatcagcccctcgaagccgagaaagcacgtttctacggtgtcagaagccgacggaacgcaaaagggtcgtctgcacgcagacgacccatatgatcaattcgccaatagacgcagcaaacgcggcctagtgctgctttttgcgcggcgaccagtgcttcggcggcggccgtacttatcggacaggaagccggagaagccggcgccgatcacgccgccgatcatgatggagctgatgaccagaccctgcagggccgggctcagcgcgtacttgtcctgcaggaagtcgatggctcccgaaatggacacggtcataaccgtagagcaaaccggttagacacggcgttgtatacaatccacaaaaccagacagacaacttctccattgcccacaacgcgcgcaaccttacgccagcgtaacctaacttgtcagaatggctcgattttgtcaacagccatcacgcaacgcacgtaaggacacggcccgcttatgcttgaccactacaccacgcctggcgaatccatcgaaatccgcgacaaccagaccatctactccctacttaccgatcgccttgcccgcaccggcgcggacacggtaatcgccgccaagaaaatcggccccggccgctggcagaacgtcaccaccggcgaattccacgagcgcgtggtctcggccgccaagggcctgatcgcgctcggcatcgccaagggcgacgcggtgaccatcttttcctccacccgtctggaatggggcattctcgatttcgcactggccgcggtgggcgcggtaagcgtgccgatctatgacaccgactccgccccgcaggcccagcgcatcatgaacgattcggtggtcaagctggcctttgccgacaatcgcgagcgcttcgaccggctcgactcggtcaaggaccactgccctgccttgaagcagattctcatgctcgagggcaacgcactgggcgcgctcgaaggtctgggcgtggctgtttcggacgaggaactgaacgagcgcgtggccaccgtgcgcgccgacgatctggccaccatcgtctacacctcgggctccaccggcaacccgaagggtgccgaactgacccataagaacttcgtgtccatcaccatcaccgcttcgcaggcgcttcatgaagtggtgcttgacgaccatccacgcctgctgctcttcctgccgctggcccactgcttcgcacgattcatccagtacgcctccatcgcctccgatgacggcgtggtcggctatctgccggacaccaaaaccctgctgccggacctgcgttcgtttgaaccgacctacctgctgggcgtgccgcgcgtgttcgagaaggtgtacaacgccgcctcgcataaggccggtgccggctggaagggccgcctgtttgtcaaagccgccgaggccgcgcgcgtctggagccgcaaggagcaggccggcgagcagcacacatttgccgaaatcgccgagcgcgccaagtacgaaacgctcgtctaccgcacggtgcgcggcgctctgggcccgaagatcaagtacgtggcctgcggcggcgcaccgctgtcgcttgatctggcgcatttctacaacggcatcggtctgccgatgattcagggttacggcatgaccgaaaccgccgccccgttcgccgccacgcgcgtgaccgacaatgtgatcggcaccgtaggccagcccgcgcccggctcctcgattcgcatttccgacgaaggcgaactgcaggtcaagggcccgaacgtgttccgcggctaccacaatctgccggagaagacggccgaggcattcaccgccgacggctggctcaggaccggcgacttggccgagatcgatgacgccggccgcatcatcatcaccggtcgaatcaaggacattattattaccgccggcggcaagaacgtctcccccattccactggaggaggagattgccaagtgcccgattgtggagcattgcgtggtggtgggcgatcagcgcccgttcatcggcgcgctggtgacgctcgacccggagtcgctggcattgtggctgcccgcgcatggactgtccacggagacgccggtggaccggctcgccacgaacgcggcggtgcgcgaggagattcagcagtacgtggacaaggcgaatgcgacggtctcgcgcgccgaatccgtacgcaagttcgccgtgctggacacgcagttcacgcaggagaacaagtgcctgacaccgtcgctgaaagtggtgcgcccggccgtcaatcgcgtgttcgccgatgtgatcgacaacgagatctacaacggcaagcggtgagacgcgcggttcgtaatccgacacaaaaaaagggccttttgaaccgcaccccgattgttggactggagtaatccagattcgatgatcggaggtgcggtttctcatgtccagggatcgcaggcgtcattatgacgatgattccatgcgggtcgtcgccggggtgccgcccggcccaggtgggtcatgcccgggtcagtttcttgctcctgagacgcagcacgacatcggcggagttggcgacgcgcttggaatgcgtcaccacgatcacgcatttgccgagctgatgggcggcgtgctgcagcagatgaatcacctcgtcggtcatctccgggtcgaggctgcccgtcggctcgtccgcgaggatcgcgcggcccggggcgaccagcgcgcggccgaccgccacccgttgacgctggccgcccgacaggtgcatgatgttgcgcttggattcctcacggctcaaacccagttcctcgaggatcttcatatcggccttggcgctgaccagccgcaggttctcttcgggggtgaggtagtcgatcaggttatggtcctggaacaccagggacacgtgctcccggcggtgcttcgcatagcccgatgcggcgatgtcctccccttcgaagcggaccactccccgggagggggcgtccaggccggccagcagcgacagcagcgtgctcttgccggcgccggacgggccggtgatcgcatacatcttcccggattcgaaatccgcgctgacatccgaaagaacacggatcttcgccgcgccgtaggcgtaatcgacatggtccagttgcagacagttagacatgattggtgactcctaacgcatagaggaaagaatggatttcggggatttggacagcacggcggcgcatgacacggcaagagccacggcgatgaccgcgcatccgagcagcaggatgagcatcgtctgctcaggcggcaaggcctccacgtgcaacgattccaacggcgcgacgcccgaatcgcgcaacagtcgggaagacacgtatcccgacagcatggcgccggtgcccagcgaacacagggcggcgaccgccgccatgagtccggtttcgatggcgagttgtgcgacgatccgcatcttgtcgatgccgagggccagaagcgtgcctatctcatggatgcgtgagcgaatccagaagaccagcgccatcgccagcaccagtacgtccgcgaggcagacggacagcagcaccatgcgcaccagattacgcaccgtctgcacggattgcaggacgccggagagccgggccgaatcgtcggtgacgtcgtacttgccgccggccatggtcttggcccgtccaatagccgcggacaggtcctgcggattatccgacaggcatcggatcatgtcgatccggtcgtttccggtcagagcggaagctactcgcctacccgaatagatgaggttctcggaagtgtccgagggcagggggctttgggcctgcacgttgccggagaagatcccggccacacgcaccgtggcgttgcgcccctcctgccggagacggaatgtcgagccgaccgataggccgttctgcatcgcgaagtcgcggtggaccagcacattgtcgccgtcgcccgagatatggcggccctgctccaggcggtacaggccgctctggaattcctcggacaatgaggaatcggtggtgcccagcacgctgacctgcatggccagatcggagtccaatcgggggccctgccggggcatgaccgggcgcgcgccatccacctgcgccaaggtcttcgtcgcataggcggtcttcgtcacaccggggatacgcgagaaccggctcgcctcctcggcgctaatgggattctcgccggcgctgacggtaaaccctatgcccatgcccgcgccgatgccgtcggacatggtacgcagggccgtcgagactccgacctgcgccaccaggctcgtgaagaccatcagcatcagcagaccgatgatgccgctacgtaccggcttgcgtacgatcgccaacgtggcacgcttccacacattcatgctcatcatcgaatctccgacaggtctcgcggcgatttgcgcagcatcggcatgcacgccaccgcgacgcacaccagcatcaccgccaacaatccgagcgccacgtacagcatggcggtcccgtcgaccgacaccgtgagcgaatccagggtgcgcaccgacatgctggattcaagatcgccgccgacctgccccatgctgctcagctccttcgccgcggaggcgttcacggaatggagcgccgtggcgccgagccattgggccattccctgcgcgcacagccagccgagggcgagggacggcagaccgatcagcaccatctcggtgaggtattgggcgaccagggagggcttgccgacgccaagggacaccagtatgcccatctcttgacggcggtcgttcatccacagcagcagcatgagactgagcacgagcacggccgagacggtcacgccgatcagggcgccgcgcatcatggagcgcacgccgcgggcggcatgcagcatgctcgatgaatactggtcgttgcgcgtgatctgatagttgttccaatccaccgggagtttcttcgcggcatccatggtcttctccacgtcaacgcccttggacagcacgaaggtggcgtcctggtatatttccttgccgtccttgtactggtacaggtcgcgtgtggtatccagatcggtgtagatggtgttggcggtgagttccgctcggctggatacctttctggcgctgtcgcccttgaatatgcccacgatggtggtcttgacggtcgccgtcgaatgtgattcgttgtcggcgtcataggcgttggccttgagcgtgagcgtgtctccgactttgagcccgttggctttggcgagatcctcatggatcatcgacgtgtacttgtcggaggccttcagatgtcgtccttcggccatgccgagcgtgcgcgacgtgaacacgttgagtttcgacgaatcattcgtgcccatgacgttggcggcgttgccaaactgctgctcctgggtcgcatcgtaatcatcgccgccggggaccttcgccacattcgcccccacgagatcggcggtggcgttctgacggaccatatacgaatcgaccccgggcagttgggcgatcctgcgcacgtcggcggggcgcaccatgccgcctccgcgaggcgtgagcatgctgccctgcatgttgctggacagcacgaatccaccgaccgcttccttctcgattcgtccggcggcctgttgagctgcccgagaaaccgcgatcgtggatagcatgctcgccgttatgatggtcagtattataaggagcactatggttcgcactcgttttctgagcacatagcgcaccgaccgtgcaacgaacgtcatcaatacctcctgtgggacttgggcttttcgcccaaaatgcgaaacatgccgcgtttcgccgattagttagccgcgacgatacatgatgcacctcaagatacgggagatatacgccttgagcgaaaaacggaacagcggcgaatgtcggttattctggattttggtccatctcgggccgcgtcgatgcgtcggcccgcgagaaatcaggctcgcgcctcaccttcgaggcggcgaacacaagaagcggcagagcggcgaacgcatagttctcgcattggatgtacaggtatgcgaccaggacgagccagcagatgacggtcttgtgccagacgccggattcgcccgaacccgcgccggcaacgccaccaccactattacccccggcaacatcagcaacgtcggcaacgtcggcgacacaaacaccgtgcgccagctcgtcggacgatgcgccatccgcaccgccacggcataccgtcctcccgcgcgtcatgcagaccatcgaggctccgaccagcatggccagcccgatcagcccgtattcggcgatgacgctggtatacgcgcacatcgtccacaccgtgtccgcgttcacgccggccgcgaatcccgtggccgcgccgccgttcatgccaagaccgcccagcagccgtccggctttggccgcgccggcccacaccgcattgatgatgttgcccgcgccataaccggtgagcagcgtccacggatgggtgagcaatccgcatatcggatcgaggctttggtagatccgcgcgaagaacgagccgtctccctcggccccgttttccgcgatggcggagagtctggaatccgccagcacacccagcaggcccagtgcgcatgcgccgagaatctgcagcatgccccggacgcggcgtgcgccgtcatgccaatcggtgcgcgccacaagggcgatcagcaacgccacgacggaatcgatgacgattctggtgccggcttgcatgagcaccgcgccgacggcatacgtgacgatgaggtcacgcagccgtttggcgtagatgcggtcgcgcccgcgcatgagccacatgagcggaagcagtatgccgaacaggtgcatgccgatatagctgggctcggcgaacaggaactgcggacggccgccgccccacaccgagttgtcgctgatgtattgccggtacatgaggtgcgagaaatagtcggtcaacggtttggcgtgcagacggatggacagccattgcacgacgcccactccgaaggaaacccagtatgatgcgatgagaatccgcaatggcgtacgccacggaatgcgtttgatgtcgaacgcaagggcgatcgcccccaaagtggcgagcacgcccagcaatccggtgatgctcatgaacgcggcgttgaggtggatgccgaacttcagccatcccgggatggacaggattatgcaggccaccggtaggaggaacattggcaggtaccggttggctgcgatgcgcagttgccgccaattgcataggcagtacacggcgaacagcgccggactgattggcgaccagaacggcgcgtacaggccaagcgtggtgccgtccaccggaagaaaagcgatggccagcaacagccaaatgacgttgcgttcctgcgatgtcagaaatcgcaggaacgaccggtattgcggtcggccatgatggttgcccgcgtcgatggtgtcgttgcgtacgcatgcctggttcatgtgattctccctccccgccaaccttactcgttcatcatgatgcgcggacgggtcatgctttccccgctgaaagtgcaatggcccgaacattgacaaggtcacaccgaatgcccccatcattggcacattgtgcgatctcgtcgcggctggctgacgaaataatgttggccgaccggttacattggttcggtacagtggcggcattatcggccactgaatcaagcgattcgcggcagaacgacgaaaacaacacctgggcgaaaagaggcaggcatgactacgaatcgaccgctcattgcggtgactccgctgatggattacgggcgcgatagtctgtggatgctgcccggatatatggaggcgataatgcgggccggcggtacgcccgtcatgttgccgctgaccgatgacaccgacattcttgcgcaatgcgccgaacggtttgacgcgtttctgtttacgggcgggccggatgtgggaccgatggttggtgcagcggcctccgccaccggccgtagcgaggtgctctctcctgagcgcgaccgaatggaatcgattctgttgccagctgtaatggcttgggacaagccgattctgggcatctgccgtggcattcagttcatcaacgcagcgctgcgcggcacgttgtggcaggatctgccaagccagcatccgagcgatatcgaacaccatatgaatccgccgtacgatgcgttcggacataacgtttccttggtgcccggcactcccttggcttcattgttcgcagggcagactgagattgcggtgaatagctatcaccatcaggcggttcgtgagcctgctgctggactcgaggtcatggccgtcgcgcccgacggcgtgatcgaggccctgtaccggccggcaagccacttcctgtgggccgtgcagtggcatcccgagtttctctacaaggtagatccacgctcgcaggcgatttttgatgcgtttgtggggagttgccgataacagcaaaaggggctgctccggtttcccggaacagccctttttcaacggtagcagtcagcagattgatttagtcatcagtgctggcttgccagcgctgattggcgcgtgcggagaccgccgtccgaaggcgaaggcgtacgaaggtacgtcgaacctgaggaaaggcggtatacgctccgccaatcagtgctggttgttgagacggtggtacatctcggacagctccagttccttctcgaactggcgagcggtggtgttctcgtcgatgacggcgagctcaacaccggcgatgcgggcgaagtcttcccaagcctcacgaccaacggaggtggtcatgcaggtgtggtgagaaccaccggcggtgatccagcactcaacagcggtcttcaggctcggcttcggctcccagacggcgcgggcgcacggaagctccttgagggagccctgcggctcaacgacgtcgacgacgtccatgagcaggcggaagcgttcgcgaacgtcggacatggagatcacgacggcgtccttggtgggcttgccggagaagaccaggcggaccgggtcggccttgccgccgatacccagcgggtgaatctccagcttcggcttggcgatggtgccgatggacggggaaacctcgagcatgtgggagcccatgtcgagctcgtcgccctcggtgaagttgtaggagtagtcctccatgagggaggcgccaccctcaaggccgtagcccatgacggcgccgatgcgcacgaggacggcggtcttccagtcgccttcagcggagaagccccagccgtactcggacgggaagcgctgcgggccaacgcccggcagctgcggcagagcgccgaggtcctcgaagttgtcgacgccggcggtgcagccgttggcgcgcatcatgttgaccatcgcggcctcttccttggcggcgatgaacagggagtcgtacttggcgtccagcagagccgggtcgacgtcgtacttggccttgtagtcctcgatgatctccttgacctggtcgtccttgacggcgtcgtacgcagcgacgagctcgttgacggcccaagtgttgatggaggcgccgaacacgcgctcggcctcggtcttgtcgccctcggtgacggcgacgttacgcatgttgtcgccccagcgcatgaccttcatgttgttggaggcatcccagccggcgcaggcgcgggcccaggtgccgaccttctcgacgacctcaggatcggtgtagtggccgacgacaaccttgcgcttgatgccgaggcgggagacgatgtaaccgaactcacggtcgccgtgggcggcctggttcagattcatgaagtccatgtcgatggtctcccacgggatttccttgtggtgctgggtggccagctgcagcagcggcttggtcagcacttcgaggccgcgaatccacatcttggccggggagaaggtgtggcaccaggtgatgacgccgatgacgttcgggttggcggaagcctcgaccatgaactccttgacaccgtcggaggacttcagggtgggcttgaggacgatcttggccggaatcttgccggtgttgttcaggtagtcgaccatttcagcggagtgaatggcgacctggcgcagggcttcttcgccgtacaggtcctgcgaaccaacgccgaaccagatttccttgccctcgaaggggttttccataaccatagggttacttcctttacttctttgtttatgggggtttgtttaagtttcattcgccgaccgaggctcccctcagtcagctatcgctgacagctcccctcagagaggggagccaagacaccaccgtgctggcggagtcagcgctgatttgatgtgtgtgtccgcaaggcgcggaaggcgaaggcgtacgaaggtacgtcgagccttccgtaacgcggcggacactccatcaaatcagtgctggccgtagacgttctggtagcggtcgttgagcttatcgatgtcggcctggtcgatctcgatgatgtcaccgagctgacgggcggcccacatggtgtgagcgacttcctcggtcatggcagcggccttgacggcgccttcagcatccttgccgatggtgaaggggccatggttctgcatgaggacggccggggacttcgggtacttcttgagggtctcgacgacaccctcgccgatcgcctcggagccgatcagacggaacgggccgaccggcaccgggccgccgaactcgtcgcccatcatcgtcaggccgcacgggatgttctgaccagtggcagcccaagcggtggcgtaggtggagtgggtgtgcacgacaccgtagacgtcgggcatgttgcggtagatgtaggcgtgggaagcggtgtccgaggacggggcttcggtgccgtcgaccacgttgccgtcaaggtcgcacacgaccatggaggacggggtcaggtactcgtagcgcaggccggagggcttgatgacgaacaggtcggcggtgtgcagacgctgggaaacgttgcccgcggtccacacgaccaggttccacttgatcagctgctggtgcaggttggagacgacctcacgaacctgcttgacctcggcgcgaacctcggggccgtaatcagccaaagttgccattattggttttcctttccactgtgatggatggacgttttttcaaaatctcaaggacctccctcaatagagggaggtcagaaaggcttacttatcttcgaggttgatggtttcgatggcggcgtgctcgatgggcaggcccttggtgaagcgggcgaagaagtcctcgaaaccaaccacatcggaagccaccggcttctccgtggtggactgggcgtccttgaacacgcaaccgtcaaggaagtcagcgaggttgctgtgatcttcgttggtgttccacaggtagttggcgagcacggccataccccaggcgccaccttcggcggcggtggacatgaccttgatcggggtgttgaaggcagcagcgagaatcttctgagccaccttcggagtggcgaagatgccgccgtggcccacgagagagtcgacctgcacgcgctcctgcttggtcatcacgtccatgccgatcttgaccggggagaacgcggagaacagctgggcgcgcatgaagttgccgagggtcatgttggcctcggggctgcgggcgaacagcgggcgaccttcaggcagaccggccaggaattcgccggaacggaacgggtagttcagcaggccgccgcagttggcgtccacgtcgtcggcgatggccgcgcggaacagggtgccgtacagcataccggcgtcaaccggctggccgatggccttggcgaactggccgaacaggccgacccaagcgttgaggtcggaggtgaagttgttggcgtggctcataccggccagatcgccggccggggtggtgaccaagtcaacctcagggtggagggccttgagcttatgctccagaaccaccatggcgaagatggaggtgccggcggagacgttaccagtgcgtacgcgcacggagttggtggctaccatgccagtaccggcgtcgccctcaggcggggcaagcacgatgccgggcttcagggcgccggacggatcgagcagcttggcgccttcctcggtcagctcgccagccggagtgccggccacaagcggctcaggaagcaggttctccagcttccacggctgggctgcgacctcaggcagagcgtcgaacttctcaatgaatgcggtttcgtaagtgtgagtggtcgggtcaatcgggaacatgccggaggcatcgcccacgccgaggaccttcttaccggtgagcttccagtgcacgtaaccggcgagtgtggtgaagtaggccaccttggagacgtgctcttccttgttgagcacggcctggtacaggtgggcgatggaccaacgctcggggatgttgtactggaacagctcggagagcttcttgtgagcttcggaggtgttggtgttctgccaggtgcggaacggcaccagcagttcgccggcctcgtcgaatgcgaggtaaccgtgcatcatggcggagaagccgatgtggccgacgtgcgtgagcttctcgccataggcggtctcgacgtcgttggccatggaggcgtaagcggactgcaaaccgccccagatctcctcggtggtgtagctccacagaccatcttccagatgggaagcccagctgtagtcgccggaggcgatggtctggaagttgtcgtcgatgaggacggccttgatgcgggtggagccgaattcgatgcccagcgtggtcttgccagcgcgaatcttctcggcgatgtgggcgacctgctcggccgcgttgtcggttgctgccatatctttcctttgccttggagcgccggcgttgttatccccttccttggggagggtgttagcgctcacaatttccaaaaaacattgtaccgacaacctgcattcgacacaacttataccgtgtcacgcatcataacggtttgataacagcgccaatttaccgccgaggagccggtcccaaggaccgccgagcacgcacctcggcgggaatcagccccatgccgtgctgggtggtcaggaaggtcggctcgccgccctcccccagcaagcgcagcgtctcgcgcatggcggccacgccgagcccctcgaaatcgggatgcacggtggtcagcggtgggtacatgttatccacgccagacatgtcgtcgaatccgaccacgctgatgtcttgcggaatccgaagcccatgctcatgcaacgcgcgcatgatgccgacggcctgattgtcgttcgcggcgacgaccgcggtgggcaacgccgcgcctcgacgcccatactcatcaatgagatgattcatgtgcgcatatgcctcagaggcatcccacgtatggcagcgcacgatctgtgaatcgatggatcgggaggcggcgagcttgcgccacgcatccagtcgggtgtgggcgtcgcgccattcgttgggaccggcaaaatacagagccgatttgtgcccgtattcgcccagcaaggccaccactttggccattgcaccccactggtcgataccgaccagcgcagtgcgacgcttgttttcggtggagataaggcccaatccctcacgcacggtcatttggccgtgggtggcggtgacgatgacgcgcggctgagtgactcgtgcacggcaggcggcggcgaacatcacgtcggtcggggtcaggaagatgaaggcgtcgacgttctgctcgttgaaggtgtcgcacaggttgtcgaagtcggcctgcgcgcacaaggcctcgtggaccatcatcacgctcatgaacagaccgtgctcgcgggccatggattcgatggaggagatggaggaaatcgggccgaagaatttgaggcctccggcgatcagccctatggtgcgcgaacggcgggaagccagtgcgcgcgcggagttggaggggcggtagccgagttggtcaatggcggcctggactcgcgcacgggtggcgtcggaaacgtccggcgagtcattgatcacacgggagacggtttggtggctgactccggcgagcttggccacttcgaacatggacggacgtttgcttggcttgcggctggtcaccatgctacctaacctccccgctggcggccggcatccgtgcacggccaggcttgtaccttaatcaatactgactttagcgcgtccacaacagttttgcgttagcgctcacactgtcgtgtcgcacgcggctcaggtcaggtgccatgagacacgatggagcggagtcggcccgtgttcggcgatggcggcacggtgtgcggcggaaccatagcccttgttatgagcccattcgtaggcggcgtaacgtgggttgctttgcgcgaggtcgaccatcagccggtctcgggtcactttggcgatgaccgccgcggtggcgacggtggcgcaatgctggtcgcctttgactttggtcgttatgtcggctggaatcggcacgtccggcgcgtcgaacgtgttgagcgccttggtgatgtaatcgctcggcccgtcgagaattccggcgactttgggcagggcgcgaacgcttcccccgcaatttccaatggattcccctacggagcctcccggacgaccttccacaatctcccccgcagactcccccgaagccttttttatcgtcgattcccctccaagccgtaagccaagttcgcgttcgacttggctgagcgcgcgcagggcggccacgccaagcgcgtaggtgatgccccattcgtcgatctcggcgttgctggcctggcctacggcgtaggccgcgcaccagtcgcgcagttcgtcgaaaatcgcctcgcgcctatgttcggtgagcattttggagtcggccacgccgtccggcacgccgaggtaggtccgcccggacagttcggcggaatcatcgccgtcaagcggcgccaaatcacaggcccagatggcggcgcacccgaccatcaccggaccggcgagcgcgccgcggccgacttcatcgaatccagtaataaggtcatagccctgggccgcaaggctgcgttccaagtcaagtgtcggggtaatcatgcgcggctcccatcgtctcacaatggttaggattcagacggtccaggttcaaatggttcaggattcagacggcccggaactcaatcagttcaaagactcacacggttcaaaaaaagactcaggaattcgagccggaagcgtcaggcacgtccttgaagacttcgtggtggtcatcaatcgcaccaagccggtcaagcggccagtatttcgcgattccgactccgaccacatcggagatgggaaccaagccgcgatcgccgtcatcctgatgatagcgggagtcggcggaattggcgcgattgtcgcccatgacgaacacgcggccctcggtcacggttaccgagaacgggaaggcgctcgggtccacgccggggcgaatgtaggaggtctcattgatggccacgccgttgatggtcaccggctggcccgcgcccttgcattcgaccacgtcaccgggcaggccgatcagtcgcttgatgaggtacccgccaccgggagcgctgctctgctcctcgttcaaccagttgttgggatctttgaataccacgacgtcgccgcgctgcaaatcgaagatcttgggggtgagcttgctggtcaccacgcgatcgccgggcaccatggtgtccatcatcgagcgcgaaggaatctcgtaaaagccgacggcgaaaatgcgaatcagcagcacgataagcacgggaacgccgcaccacaggaaaaagtcgcgtagggtgaagtggtcatcatccatcgatgatgctgccgcggcattcgcaccagcggaagaagcggcgtgcgccgggcgcgccggtgccgggggaaccggggacggggcgatgccgtggtcggcgacttggaacgtacgggaatcgcgggcatcggcctcgtcatcatacgaggtctgattgctctccggattgtcggaaaccgggaattcgccgttatcctgatcgtcctgcataccatctcctcgcgattcatgctgccggatatgaggggtgccggcgcccgtccatcatacgtggaaaatacggaaacagcccgaaaccgaaacggttccgggctgaatttcacggtttattcgcgcacctgcatcatcaggcccacgattgcacccgcgaatcgactcacttagcggagttgtcgcggcgctcggcaatacgagcggccttaccgcgcagagcgcgcaggtagtacagcttggcgcggcgcacacggcccttacgcacgagcttgatggagtcgatggacggggagtgcaccgggaagcgacgctccacaccagtgccgaagctgatcttgcggaccacgaaggtctcacgcacgccagcgctcttacgagcgatcaccacgccggtgaaggtctggatacgggagttgttgccttcctggatcttcacgttcacgtcgacggtgtcgccgggacggaaggccgggatttcctcggccggcttcatgtgcttggcgtcaaaagcctcaacagcgttaaccattgttttccttcagtgctgccgcatatcagccacagatctggggccatccacgcgattgcgcatcgcgcgcgttgacctgttctcgttatccctcgagtttgcccttgggaagcctgccgatccgccaaaagccaggccttgcggccgttcggactggacccacggagacgcgggcttatgcggcggcccacttctcgacacagcaatcgattattgtacggattcttgcggacagtatcggcgtgtcgtcgtctctctccgttattaacgcatcagtttggccgaggcagcacggatggcggattcgaatactttccgtccctcctgctggtcgcatggataccgacgatggtattgatttggcgtttcagcgcacggcttgaagaaggtgagagtccgatggacggtgattattccagtagtttcgccgccggcaacagtcatagttgagggggggagcatacggagcgttccataactccctctcagtcagcttcgctgacagctcccctcagtattgaggggagctagaaaagcgaatcagaattcgcgacgtgggcagtcgccagactgcccaccagacagcacagccgcggtcgcgcgaatcacgaattctgaccgagcaaagcgaatcagaactcgcggttcttgcggtagaacttgatcaggctctgggtggaggcgtcctgggcggcgagggcgtcgtcgtcctgggagatggccggggtgatctgcttggcaagctgcttgccgagctcgacgccccactgatcgtaggagtcgaggccccagacggtgccttcgacgaaggtgatgtgctcgtacagggcgatgagctcgccgactgcgaacggggtcagggccacgccgaagatggaggtggtcggacggttgccggtgaacacgcgggccgggacgatctcctccggggtgccttcggcgcgcacttcgtcggcggtcttaccgaacgccagggccttggtctgggcgaagtagttgcccaggaacagctcgtgcacgtcctggtcgccgtccttggtcgggttcggggtgttgacgaacgcgatgaagtcggccgggatgagctgggtgccctggtggatcagctggtagaaggcgtgctggccgttggtgcccggctcgccccagaagatctcgccggtctcggaggtgacgggggtgccgtcccaacgcacggacttgccgttggattccatggtcagctgctgcaggtaggccgggaagcggtgcaggtactggtcgtacggcagcacggcgtgggaggcgaccttgaagaagttgcggtaccagacgttcagcataccgagcagcaccacgacgttcttctcgaacggggtgttggcgaagtattcgtcgatctcgtggaagccgtgcaggaactcctcgaagcgggccgggccgaagacgacggccagagaggtgccgacggcggagtcgacggagtaacggccgccgacccagttccagaagccgaacgcgttgttcgggtcgatgccgaactcctcgaccttctccaggttggtggagacggcgacgaagtgcttcttgatggcttcggcgttcttctcgtcggagccgtcgatggcgccgttggcggtgagctcttcgagcagccaggtgcgggcttcgcgagcgttggtcagggtctccagggtggtgaaggtcttggagacgatgatgaacagggtggtctccgggtcgaggcccttggtcttctcggccaggtcgttcgggtcgatgttggagatgtagcgggcggagatgccagcgtcagcgtacggcttcagagcttcgtacaccatgacggggcccaggtcggagccgccgatgccgatgttgaccacggtctcgatcttgcggccggtcacaccggtccacttgccggaacgcacgtcgtcagcgaaagcgtagatcttgtcgagcacctcgcgcacgtccttgacggtgtcctgaccgtcaacgatgtacttgccctcgtcttcgaccgggcggcgcagcgcggtgtgcagcacggcgcggtcttcggtgttgttgatgtgcacgccggtgtacatagccttggtgcgctcatcgagcttgacggccttggcaaggttggcgaacagctggagggtttccggcttgatcaggttcttggacagatcgaagtgcaggtcgccggcgtcgaaggacagcttctcgacgcgctcggcgtcctcggcgaaccacttcttgaggctcacgccttcgacctgaagctcgtcatagtgcttctgcagggcagcccactcaggggtctgggtggcgtcaacgggcggattgatggccataggattccattcctttcatcagtgactggagcgcccttgcacacggctcggatgcgctccgtatcaccaaacagaatactcacaaattcggacatgaacagaacaaaatgagtcagcgatgtcggattgccatcgtttgcattatcgaacagttcacggcgcggcgcaaccgtcatcttcgactgagcggtcgcgacacaaccgccaatccgccgattggacttttcgtggggatgtcttatacttgacttcttgtgcgcggctggcgaaataccttccgcgaaccaagccactttagctcagtcggtagagcggctcactcgtaatgagcaggtcgtcagttcgattctgacaagtggctcggatgccctaggctggctggtctgtaatggctgtccggcctagggttttgcatatcttccacacctgtggaaacgcggatatgcacgcgcgagtggcggaattggtagacgcgcaggatttaggttcctgtgtctttgacgtgtgggttcaagtcccatctcgcgcaccggcttgagcctcttggaagcattggattgccaacgcttccgggaggcttttcgtatatgcgcgcggcagctgcaagcccttgcggacacctctacatatggcaatgccaaggcggcaaatataatgggccacagcattgcgggtctgagcctgtgcgccatgagcctgtgtgagtcaaggagagaagtgtatgtccgccattcttacgccggttggtctgttgctgatcatcctcgccggctatctgttcaagcggttcggcctgttcgggcagaaggattatcgcgtgctgcaaaccgcggaattcaacatcgtgctgcccggtgccatcgtatactcgttcgccaccaatccgcatgacatctcgctgctgcttatttcggtattcgcattcctgtttgcttttatcccggtcgtgttcatctttctggccacccgcaagcgcaatgtgaccgaccgcgccttcctgatgctcaacggtgccggcttcaatctcggctgtttttctttcccggtcgtccagtcattctggggtgcgggcgcggtggtgccggctgcgatgttcgatatcggcaactgcgtgatggtggccgccggcaccaatgtgctcacccagcaactgctgcatattcagcccggcaaaacacttgccgaacaacacgccggttcggctcccaccctaccgtacgaaaagcccaaggatcgcgacgccaaacggcttgcccgccgcgcattgctgcgcaccatcggcaagagcttcttcggctcggtgccgttcgacacgtatctgctcatgatcgtgttgaccgtcgccaacgtgaagattcccgattggatcgcctctataacccagccattgagcggcgccaacgcgctggtgtcgatgctgatggtgggcatgctcatggacctgccccaatccaagcatgacgtgaaggaagtcatggccgtcatcgcttggcgtataccgttcagcgtcgccttcgcgttgatcgcgtggttcctgctgccgttctcggcttcgattcgcgccgtgatggtgatctgcgcgttggctccgatcgccattttctccacgctgttcaccgacaaagtactcggcaacgccaaactggccggcttctcgctggcaatcaccgcgatgatttcactggtgatgatggctgtggctcacgcgctgatgggcgtgtgagcaaatgcgcaagtaggcacacggcgggtgcacggtcagacgagacgcagcccacataggttcgtcccccggccgccagctgctaccggcgcagcagcttgtgcgccagattgctcacgccgaagcggaacttatccaccggcaacgtgaatttgcctaccatctgctcgacgtagccgttaaagccctgcttgaattccagcacgccgcggccctcgtcgttcggatcgtcgaacacgccggaaatgccgtagaagttgtagcggctcacaccctgttccacacacaggtgcagcattgctccgtactgaatcagcgccgaggcgtagaacggcttgtactcctccaacgaaccggaatactgatagaccacctcattggggtgactgacgaacattgaagccgccgccggcagcacatcgcccttcctggcatatccctccacctcagccagacgcttgtcggcggccgcgagattgcgcgattcctcccccagctgacgttcgatgcgcgtggtcggacgttcatcgtatttcgcctgcaatcgagctaccttggcctgcaaggcctcgcgcttggcggtcatatccgccacatattcggcgatgtggatttccgcgagcatgaaatgcgcatctgcgccatacgcctgcttgaactggcggaaatagtccgcgccgcgcgtcgcgaacccgcggcgttcaccggtccgccgttcgatatcggcgaacacgtcgaactcgtcggggccgatttcgcgaacgtgcacgcccatcgactgcgcccgcttgacgctccattgagcgcgtttgccgaatgatgccagcagttccttgccgttggtgatgccggtgagatccttgacgtacatccactggcagaccacgtcataaccggtatggaatccgccatgcgtccagccggcatcggtgaatccggccagtagtgcatcgttcggctcgccgtcgggctgcccgttcgaggaatacagacggtaggcgacgttaggccagcatgccacggaaacagcatggtggcgacgggccgattcacgaatcgcctcggttatggcccgcagcagagccggatcatcgctaatgccgatggggccgaaatatacggagccatctgcaccgaaacgaccattgaggtacagaattacgcagccggttaccagattgccggatgcgtcgcacacgccaacgcattcggcttcatgcccacgaatcttggcaagacggacctgcccggaccattgctggaagctgccctggcttgtggcttcggaaagccggtcgagctcttcgggcgtaatcacgccaaacgtatacgtcgtatctgttcgattcgcagtcgcgctcatctcgtcgtcacctgtgccttatttctgtgtccgtgctcgccactgtttgtcagcgatgcagcagcttgtgcgctgcttcggatacaccgaagcgcagtccgtccaccggcagcgtgaacttgcccggaagctcttccacgaatccgccgaagcgagtcttgaactgccagacgccgtaggaaggatcgttggcgtcgaaaatgccggaaatgccgtagaagttgaagcgctccacgccacgggcgatgcagtcaagcatcgcctcgaagtggattagggaagacgggtagtaatccatgaaacgatcgtcctcgccgctggacaggcagacgacctcgttcggatgccagaagtagacgccggcttccaccggaatgaccgggccgtccgaagcgatgatgccattgacttcgccgatggtcttttccagcgccgcaatcttcttgtctgcggtggcgatgcgcttttccagcgttgccgggtcggaagcacccttcttggccgtgccttccggctgctgttgcgtgcgctggagcaggcgttcgaggttgcgcttgtctttggaggccgcattcagcttggattgcagggtgtccagatattcgtcgaaatgggtttcgaccaccttgaactcgatcaggtcgccgaaggtatcgaacagacgctcatagtaggccagatcgcggctcttgaagccttgacgtgcggcgctcatatcgcacagcttgacgaaagtgctcagttcgccgcgttccagtcggcgcacgcgcagaccggaatcctgggcaatgcggatgttcttacggcggtacttggagaacgaggccagcagttccttctcattatgaatgccgtcaagccccttgacgaagttccagcggttcaccacggattcgtagcccacggtgaaaccgccatgtttccaaccgaagcgggccatgttgtccatcatcgtggtgtccgggtcgctggtcggcttgccgtccagatcatgcagacggtagactgcggccggccagcaggatacgctgatggcgtgatgggccttggccgaacgacgcagggcttcggtcatcgcctcaaccacctgtggattgtcataatcgcacagcggtccgcaccagaccgagccttccaaaccgaaacgggaccgcgtgtacaccacgtagcaggcggcaatcagcttgtcaccgcgcttgacacccacatagtccaccggaccgttgaacgcacccatggcggccatctgcgaggtctgctggaaactaccttgcacttgagctgcggagaacgcatccagctcggcaggagtgatcttggtaggggtgagcgaggcgacgcctgcatcggattgcgtcataatcgaaccttcttacttgtcgttactctgatcgttactctgggctctggaacggcctgtgtgctgcgtccgtttaccgcgacagcagcttgtgcgcaaattgcttcatggcataggcgaccggtttgaccggcagtacgaactcgcccggaagttcctcgacatatccgttgaagccctgcttgaactccagtacaccacgcccctcgtcatcgggatcatcaaagacgccgtcgatgccgtagaagttgtagcgagacagcccgtgttccacgcagaaatgcagcatcgcgtcatgctgaatcagcgcggaggcgtagaagggcttgtactgctcgacgctaccggagaacaggtagatgacctcgcgcggatgctccacgaatagtgatgccgcagccggcagtacatccccgtctttggcgaactcggccgcctcgttcaggcgcttttcggctgccgccagattgcgggtctcctcccccagctgacgttcggttttggtggtggggtgttcggcgtttttggcggtcaatgccgccaccttggccgaaagcgcttcacgcttggacgtcatgtccgctacgtattcgtcgatgtggatctcggcaaccataaaatgcgctttgctgccgaacgcttccttgaaacggtggaaatatgcttcgccacggtattcgaagctacggcgttcagcggtttgctgctcgattcgtgcgaatacccccagctcgtcgtccgacagctcacgcacgtgcacacccatcgattgggcacgcttcacgctccactgggtgcgcttgtcataggacttcagcagacttttctcatcggtaatgccggtcagatccttgaggtagcgccaacgcggaaccgccgtgtagcccacggtgaaaccgccatgagtgaagccgatcgcctcgagctgttctatcagcttattgtcgggagcgccattctggtcatccggcaaagaagctccattggtgtcgcgaagccgatacggggattcaggggtgatttccagctgtgaagcaccctttgccttggcatggcgtttcagcgcatccatgaagaaggtcaatgcttcggtgtcgtgatagtcgcacatcgggccatcatggatgaccgcaaatgtagagaatcgagagcggtgagtttcgaacagtgccgccgcgacgatcttctcgccctccttgagggccaaatattcgacgtcgatcccctgcgcggtgcgaaggcgtcccatcgccgaggtttgttggaaattgccttgtggatgtctggcggagaaatcatcgaactcctcgtctgtcaacttcaccagcacaaaatcacgcatgcttccctttgcctccgagtcaatcaggctcaccatgctagcatagcgcgcacacgacgaatggcggccgagcagatgaggtgtgcacatcgttcgcactattgccgccacgatggtccaaagaacaatggcccaaagatgatgaatgtccggcttgcagtgaatcaaacgcagtgctatattctctacttggctcttgaagccacgccaccttagctcagtggtagagcatccccctcgttcgtgggaaggtcggtagttcgattctatcgggtggctcttgttcatcaagaaggccgacgcactaagcgccggccttctttcgtatcgcccttgctaggtcataggcgcttgctagacactcgcccgattcgggggctgagtgctgagccgcgactcaactgtggcttagtcgcggctcagtgcagctagacagcctagacgacttagtgcagcagggcctcgatggcggggaccaaggctttcagcgccttgcctcggtgggaaatcgcattcttctcggccggagtcatttcggcgctggtcagcggctcgccttcatggtcaggctcagtgctgacgcgaccggcaggctggtcgtccgggacgaacagcggatcgtaaccgaaaccgtgttcgccacgagcctcgcggatgatacgacccggcatgtcgccgagctccactgtctccgacttgatggcgtatcgagcatgcaccggggcagggctcccagcggcagccgtggtgtgaacggtgatgccgtcggcagccactccaccggtcacgtcggcaccggtctcggtgtccgggaccaccagcgcggcggcgcaacggaagcgcgcggtacgcttgtcatccggaatatcttcgatttgggcgagcagcagcgcattattggccttgtcgtggccgtgagcacccgcccagcgagcagacagaatgcccggagcgttacccatcacatcgacgatgagacctgaatcatccgcgacagcgggcagaccggtacggatggccacagcgcgggccttgagtagcgcgttctcctggaaggtgacgccggtttccaccggatccggcaggtgaaggctgccagcggacaccagttcgatgttttcggcatccgcgccaagatcctcttcgagaatgcggcggatttccacaagcttgccttcgttatgggttgcgacgacgatttgcatgaggttctcctttaagaaggctccccttgtcaggggagctggcttagtctagggacagagcggcacgctgggcggcttgcagttccttgttgcccttttcggccaagtcaagcagggtgccgagttcggcacggttgaacggacggtgttccgcggtgccctgaatctcgatgaaggtgccggaaccggtcatggccacgttcatgtcggtcatggcctgactgtcttcaatgtatggcaggtcaagcatcggagtgccgttgatcacgcccacagacacggcggacacatagtccttaagcacgcggctggcggacttgatatggcggtgcttctccgcccaattgactgcgtcgaccaaagccacgtacgcaccggttacggaagccgtgcgagtaccaccatcggcctgaagcacatcgcagtcaagctgaatctgattctcgccgagcgccttcatatcgatgacgccacgcaggcagcggccaatcagtcggctgatttcgtgggtacggccaccgattttgccacgtacggattcacggtcggtgcgttcggcggtggcacgcggcagcatcgagtattcggcggtgacccagccgaggccggagtccttgcgccaacgcggcacaccgggagtaaaagtggcggtgcacatcacgcgcgtgttaccgcattcgatgagcacggagccttcgggggcgtcggtgaagtggcgggtgatgcgcacagggcgcagttcgtcgaccttgcggccgtcggcacgaattatttggtgattgccaagcatgtctttgatttcaaccatgcgccccagcatacgccatccgctctatgcctggatagcaactcgtcaaccatcatcgaactccagcgcaatgtcattccctgcttacatatccatcccatgacacttggctgcacgccactattttcttatgcaccactcgcttacagagtcaatgcctgcgtacctgatgaggattgggaaagatcgtccgctggaataaggatgccatattccatgaaagcttggttgaattgcttgcgctgcatagcgttgagttcgtaatcgattaacggcaaatatgtatagtccatgtcatgcaacggctcttcatatcgatgaagcacgtgcataattgccgcgctcggcagtggggaccaccatccatccaagccataccggtacggaggaaccaatgtcaagcgtctgttccttgggttgatatcccaacgcagaaaacggtataaaccagcgagaaacgcaatccagcacgcatcgttcacccgtgcaaccgctcggacgaacgatatacgttgatgttgaacattccgagcatgaatcagattgacgcagagcatcttcaacgtagaccaggtcgctccgctttctattgcatcgaaatcaggaggcctacgcagttgcgccaacaacatgtgcaattcgtcttccggaatcgtttgcgagggggccacggcttctaggtgaagaccaaaaccagcccgctcaagcccctcgaccaaaacatcaaacaacatacctctttgcccacgcaatacgcgaccaattgcagaccgatccaaaccagtgcgctgtgcaagctcataggcattccaaccagtctgcgacatcacttcattcagcacagccgcacacgaattaacagggcaaccagataccacaccgtgatgcacgacatcgcactgttctaacgctcgatgctctacagcgcgccgctctgatacgtcatcgttgcccgccgcgttctcatcattgagagtttcactcatcgaagtcaccttgcctcggccgatttcccggtcatttcatcaaaccgcaatcatcatatcccacaatcccatgacgatacgattcgtcatatcccacaattcagagacggtatgattcgtatcgcatcagttcacacgattcttcaacgattgctccgcaaacgattgctctgcacgcatcacggcattctaccggcacactattcctcccaatcagcccaacgcaacatcacacgcaacatcacacgcaacatcacacgcaacatccctcacgcaacacccctcacgcaacacccctcacgcaacactgcgccatctctgtaacatcaccgacaacacggcaatcccacaacgtctcggtgcaatatcctctgaaatggtttggttttcactccacctcgtcggcatcctgaccaggataggaatatgtgtcgttccgcaccatgtacaaaacgttgtcaactgacaacgttcttcaaatcaattggataagacaaatggccatttcccgccaattcatctgaatcaagacgttgtcaactgacaacaaaatgtacattgcaacagcatgcacatatacatatttccccggtgagcagtacccccccccaaaaaaaaacaagggggcaccctcagctggaaccacgtccggcgaaccgggacgcagttcagcccgaggggacgcggccaatacagccccgggacacagccacagggggtgcaaacacgggggtgcgaccggggttgcatctccccgcctcggcggcgaccacaggagtgcggccaacacagacagaggggcacagacagagggaagagtagccaatgtaaccagagggatgcggccagtgcgatacggtcagaggactttggtctctgtggtcgaaccgttaagcggacagcccagtgggctgtccgtaggtaaggggagcagctatgctgcgacggattcctatggagacgaaagttctcgtcagagaacctgagtctccgtaggaatcacgggctcgcccttcatcaggctttgtgcggtgatgggcagttcggacaacgccttggcgcggtagtcgtgggcggccatgatggcgtcatggccctgccactgcgcatcgatatggccgtggtccacgaaatcgaccagcaggttcttccacgtcggttcgggcgtgaaaccggccagtttctcttccgagccggaaatcacgtgttcggcttcggctagcgcgtattcgtaggagcggaatgccaacttgcgaccgggcactgtggccttgtccttggacttcttcatgaccggaaccatcgtgccgtcagcgccttcacgctcggtgagcttgtacaccatcgcacaagtgggagcgccggagccggtgaccagcatggtgcccacgccataggagtcgaccggcgcggtctgcaatgcggcgagcgcgtactcatccaaatcgttggtcacggtaatggtggtgttcgtggcacccagggcgtccagctggttgcgcacacgctgtgccatggcggctaggtcgccggagtcgatgcgcacgccacccagttcgggaccggccacttcgacggcggttttcacggcttcctcgatgttgtaggtgtccaccagcagcgtggtgttcttgcccaatgcctcgatctgcgattcaaaggcgtcacgctcggaatcatgcaccaacgtgaagcaatgcgcggcggtgccgatggccttcagaccatacagctgggcggccagcagattggcggtacccttgaatccgcccactacggcagctcgagcggcggccacggcggcccactcgttagtgcggcgtccgcccatatccatgcaaggacgatccttggctgccgacgccatacgtgaggcggcggaggccactgcggaatcgtagttcagcacggatagaatcaacgtctccagtagcgtgcattcgccgaacgtgccttcgacctgcaaaatcggggagttcgggaagaacatctcaccttcgcggtaaccgcgaatcgtaccggaaaagcggaagttctccagccacttaatggtctcggggcttaccacgtgacggtcgaccaggaacttcagatccgcttcatccaagtggaaatgttccagcgcatccagaatgcggccggtgccggccaccacgccatagcgacggccttcgggcaagtgacgcgtgaacacctcgaacacgcacttgcggtcggcggtaccgtctttcagagcggcgtcgagcatcgtgtattcatacatgtcggtcatcagagccggcgaataatcgaccattgcaaggcctttcctacataagtggtgaagttgcacctaagtgtagtccgggcaaagccgtgcgggaagggctcgtcttattctcgtatcgccagattcgatattgccgggttcagtatcgtcatattcatcggcactatggcggtcggtcacaccgaccataatcatcacgaccagccaatacgccagccgcaccatacggcccactggcgaagcggtagactcgatgcatgagattcatcgtggcgttgtggcgctttgcgatcgccggtttctgcttcgtgggcacatatgaggcatggtccaaaccgcagttctgggtgtatttcacgttccagaccggtttcgtgctgggcatcgtgatgctgtggtccggcgcggccacactgctcaaaggtattcagccgcctgcatggcttaaggggtgcctgactgtgtacgccatagtcaccgcactggtggcgttcttcctgacgcctccggacgacccggcatacgtgccacaggttattggcatcatgaccaatacgatgctgcacaaaatcgccccgattatggcggttatcgatttcgtgctattcgacccgcaccggcgtttccgctggcattacatgttctcgtggctggcgtacttccctgcatacttggtcttcgtgctggcccgtgcggcgatttggccggggtccggaccggcggccggcggcagtccgtatccgtacgacttcatcaacctcgacgcactcggctggcaagggttcggcattagctgcggcaagctggccatagcgttcttcgtgatatcgctcgttgtctggctgctcgaccgcgcactgccgagcaaggccttactcggatagacgcgcccacgatcgacgcgcattggtcttagtgcccagccggcatccagctcagcactcgatggtctcaacattcgatggtctcaacattcaatggaataggcgcggtttttgtactcgcgccaatccggccagtcttcaccggcgtcgatggcacgcttgatgtcgccatagtaatggagcttgcgctgcacgtgcatggccgcctcgttgagggctcggcgctgctcgtccaaggattcgcggcgagattccagcagatcaaggatttcatcgatatgctcgggctcattggactcatacacgaagaactttttaagatcgtcaatggtcatgccggcgttcttgaagcagcaaatcgcgcgcagacggtcgatatggcagtcttcgtatatgcgctggccggtttcggtgcgctccacgttggtcagcaatccctgatcctcgtaatagcgcagcgtagagggctgcatatggaactgcgtggccacctgacgaatggtgtaggacatcatgactccttactgcggcaacacgccgaagcgtcgcagccgtttgcattcaagttcacttgaactggaaccatagtatccaagaacacttacgaataccgctcaatcggcgtcggtttgcccatcgcaggtaagcattcgtaagaacaagaatgacattgtaaggagactcaatgttcgagccaaccgccatctatgcccccaacccgcaccgttacgacacgatgacctacaaccgtgccggcacctccggcctcaagttgccggccgtctcacttggcttctggcacaacttcggcgacatcacgccattcgaccagatgaagtccctggtcttcaccgccttcgacaacggcatcacccacttcgacctagccaacaactacggccccgaacccggccaggccgagaagaactgcggactgctgctcgccaagtatttcaaacatcaccgcgacgaactcgtcatctccaccaaggccggctatgaaatgtggacaggcccctatggcgacctcggcagccgcaagtacctgctcgccagcctcgaccagtcgctggaacgcttgggcttggattatgtggacatcttctaccaccaccacccggatccggaaaccccgcttgaggagacgatgggcgcgctggctcaggccgtgaactccggcaaggccctgtacgtgggtctgtccaactacgatggtccgacgatggaaaaggccgccgcaattctggcagaactgcacgtgccgttcatcatcaaccagaacaagtacaacatcctcgaccgcaccgttgaaaagaacggcctgaaagagaccgccttcaagctgggcaaaggccttatcaccttctgcccgctggctcagggcctgctgaccaaccgctatctcaacggcattccggccgacagccgcatggctcacgatccgcgattcctcaacgattccgccctgaccgagaaactgcacaagcaggttgtggacctgaacaatctggccgccgaacgcggccagacgctggccgagatgagcctggcatggctgctgcacgacggcaaggtgacctccgtgctgaccggagcctccaagccgcagcagattctcgacaacatcggcgcactgaagaacacccacttcagcgacgaggagctcaagctgatcgacgagatttccgctcggtgaccattttggctcccctcgctgaggggagccaagtaccacctttagcgcgtcatttcctcgtaaatccgcttgcagtcggggcaaaccgggtacttggacggatcgtgcttgggcacccaaaccttaccgcacagggccaccaccgggcggccggtcgcacgcgattcagcgatacggtccttggatacgtagtgcgcaaaacgatcggcgtcgccaccatcgtcacgaaccggcgactccttggtctccggacgctccagcaccgacgtgccggcaccttggtccgggttgcgcagcggttcggcatcatcaacgaacatctcggcaaaagtcatggtgcacttctttcctcgcattcaacgattcgactgcactccatcatagattcccgtcgttacccgcgaaacccagtggcgcgtaatccgcacacctccacacacccatgtcgcgcatcacgccaccccgccacatacaatgccacatacaatgccgcacacgacgccacaccgacgccacatacggcaccgcacacactgcctcatacgccgacgcgacaacaatgcacgctcggcagcacgaagcacaccactagcggtaggctataaagcatgactatcgcagtatgccccggctcgtatgaccccgttaccgccggacacttggatgtaatcgagcgctcggcgcggtttttcgacgaggtgcatgtggtggtggccgtcaacgccgcgaaaacaccgatgttttccgaagccaccagagtcgacgtgatccgccgcgcccttgacaaagccggttgcaagaacgtcaccgtttcttccaccgacggcctgatcaccgactactgcaagaaggtcggcgccaccgttatcatcaagggtctgcgccagaacggcgactatgaagccgagctcggcatggcgctggtcaatcgcaagctcgctggcatcgaaaccctgtttttgccggccgatccgattcttgaacacatctccagttccatcgtcaaggacgtggcccgccatggaggcgacgtgaccggcatggtgcccgattgcgtcgtgccgatgctggccgatgccctggccgaggaacgtcagcggaaggactgatgcactaatgactatgagcgatgaccaccctactggatacgtcgatctgaccaaaccgaatgcggacgccgcatcgtccactccggagccgtccgccccggaaccgcccgcgtctacgcaagccgcgccggcacccaccgaagaggccgatgttctcgccggatcgccgcccgccgcgcctacccctactccggcacaaatgcaggccaaagcgcaggcccaagcagctcagcagacccgggcacaggctcagaccgctcaggccgccggcattcgcccctcgttcatgaacgaaatgcccgacctgcgagaaaccacggacgacgacccggccacggtcaagagccacgaggaattcaccacggtgtatgacatcatcgaccagctcgaggcggcactgggcgaagcgaagtccagcatattcgcccccggcatggtgaaggttgaccgcgacgaattcaccgaccagctttccgagttgaagaaaatgctgccggtgcagttggagcgcgcctccgccctcatgcgcgaggccgagcgccgtctggaatcggcacagacccagtccaacgccatcgtcgcctccgcacaaagccgcgcagccaacatgatcagggacgccaacgaacaggcacagttcctggccggccaagagaacgtcaccgagcttgcacggcagaaagcgcgcgcgattcttgaccaggcacagaccaaagccgaccatctgacccaaggcgcggaccagtactgcactacggtgatggaagggctgtcccagcagctcggcaaactcagtcaggatgtgcaggccggtcttaacgtgctggaagagcgccagcgcgcggcccgcgaacagatgccgcacctgacgctgaacgactatcccgaagcccagtaacgccagcaacgccggcaacatcagtaacgcgaataacgccagtaacgaataactccagccaacatacgaaaggcaccaagaacataccatggcacgagttgaagattccccgtgggccattccggtagcgcagattgcttcgcgcgccggtcaatccaagccgattgacgccgatttcccggcaccttccggcattggcgacagcattgtcggcatcaaggaaggtgagcccgtacacgtgagcgggcagttcgattcgattgtggacggcctgatcttcaccggccgcctggtcgcgccattcgtcagcgagtgcacgcgctgcctgaagccgattgacgaggactggccggttgatgtgacggtgttcttcccgtacgagtcgggtcaggacaaggccaacggcaagggcggcaagagcaagaaggacgacgaaatcgacatcatcgccggcgaggacgagtcggaagacacgtatccgctgctggagaacggcgcattcgcggacatcgaggcgatgatccgcgacacgctggtcgaatcgctgccgttgcaaccactgtgccgaccggattgcaggggtctgtgctcgcagtgcggtgccgatctgaacgaggatcccgaccatcatcacgatgtgacggatatccgttttgccggattggcggggctcaaagcccagctcgaggccgagcagaacggcgagcaggccgagtgacgcgcgcctgaacgaagtttgtacgagccgtgcgttaagataacggacgcttaagctcaattgttcgaacgaaatagaggatactcaaatggcactgcctaagtacaagacctcgcgcgccaacacgcattcgcgtcgcgcgaactggaaggccaccgctgctgcgaccgtgaactgcccgaactgtggcgctccggccctgccgcacatggcttgcccgagctgcggtaactaccgcggccgcacctaccgctccgccatccagccggctcacaccaagtgagtcctgcgataacggcttgaatgaaggccctgccatcgacgggtggcggggtcttcgcataagtgcaccattgcgtacaccatcgcatcgcaaacaacacaacacaacacaacacatcaccatcgcgtgaaggaccatacaacaatcatgagtaatgaaaccccacagcagccgacgccggccaacgagcttcttgaagcgttgggcaccactctcagcccggatctgctcgtgcaggcactcacccaccgttccttctcgcatgagcaccccggcgtggccaattacgaacgcctcgaattcctgggagacgcggtgctcgaactggtctccactgaaacgctgttcaccattcacccggatatgaccgaggggcaactggccaagatgcgcgccaaggccgtctccgaagacgcgctgagcgccatcgccaaaaccaagctcaaggtgggcccctacattctgctgggtcacggagaagccgagcagggcggcgcggagaagaactccatcctatgcgacatcgtggaatcgctcatcggcgcgaccttcctggaacacggcatcgacgaggcacgcaaggtgattcaccggcttattgacgacacgctcgccgaagtggccaccgagggcccggcacttgactggaagacctcgctgaccgtcaaggcgcacggcctcggcaaggaggagcctgtctaccatatggaggtctccggcccggaatacgcgcagatcttcaccgcgcgcgtctcattgggcgagaacggcgacatcatcggcatcggtaagggctccagcaagcgtaaggcgcagctggcggccgccgaagcgggctggaagtcactggactcgttcaagacgcggactaagtaagcccgctgtcggatttgcgaatagactaataccaacatgagcgacgagtcgcgccggggccacaagtctcggggaagcgactggaatcagacacgcgggcacccggccccatcccaaggtcgggcaggttcgcgacaaaacctatgaggtgagaggaatcatggctttacccacgcctttgcaggcattcagcggtgtaccgaaaatcaacacggcccccgataagcagaccatcgtcgatggcgagaagatgactggcgcccaggcgctgattcgttcgctggaggacctcggcgtcgaggacgtcttcggcattcctggcggcgcgattctgcccgtctaccacgagatcaaagacaacacgaagttccgcttcgtgcttatgcgccacgagcaggccgccggccacgccgccgaaggctacgcactggccactggcaaggtgggcgtgtgcatcgtgacttccggcccgggtgccacaaacgtggtcacggccattgcggacgcgaacatggactccgtgcccatggtcgtgattaccggtcaggtgggcgtgcaagccatcggcactgatgccttccaggaggcggatatcgtgggcatcacctacccggtgtccaagcactccttcctcgtgacccgcgcgcaggacattcctcgcgtgctttccgaggcgtactacatcgccaacaccggccgccccggcccggtggtcgtggatctgaccaagaccgcacagaccggcgacatgtactactcatggccgcagcgcatgattctgcccggctacaaccccaccaccaaggcgcacggccgtgtgctgtccgacgcggcgaagctgttctctcagtcgtaccgcccggtgctgtatgtgggtggcggcgccgcccgctccaacgccggcgcacaggtcaaggctctggccgacctgaccggcgctcccgtggtcacgaccctgcccgcacgcggcatcattcccgactccgacccgaagaacctcggcatgctaggcatgcacggtacgattgccgcaaccggcgccgtgcagcgcgctgacctgcttgtggccatcggtgcacgtttcgacgaccgcgtgaccggcaagctcgacgccttcgcaccgaccgcccgcgtgattcacattgacatcgacccggctgaaatcggcaagaaccgtcagcccgacgtgccgatcgtgggcgatgtggctaccgtgctcgacgacttgattcccgagattcagcgtacgcaggccattcagggcaagccgaatctggccccctggtggaaggcgatcgacggctggcgcgaggaatacccgatgacgtgggatgagccgaccgacggatcgctggccccgcagtgggtcatcaagaagctctctgagatggccgatccgtccaccatctgggtgaccggtgtgggccagcaccagatgtgggcttcgcagttcatcgattttgagaaccagcacgcttggatctcctccggaggcctcggcacgatgggctacggtctgccggctgccatcggcgcatccgtgggctcggcccgtgaattcgagggcaagaagccggtgtggctgatcgatggtgacggttccttccagatgacctctgaggagctggccgccgcgttcctggaccacgctccggtgaagatcgcgattctgaacaactccgtatacggcatggtccgtcagtggcagacgctgttctacgagcaccactactcgcagaccaacctgctcgatggtgaagcgcacggtgccgatggtgcggcggcactggccgacggcgatgcgccgctcgaagtgcctgatttcatcaagttggccgaggcatacggctgcgtgggtatccgcgcgttcaccgaggaagaggcgattgccgccatcgaaaaggcgaaccagatcaacgaccgcccggtgctgatcgacttccgcgtgtggaaggatgcgatggtgtggccgatggtagccgccggcgcccccaacgacgaggtgacgtacaagcccggcatcaagccgctggctggcggcaccccggctccgggaaccggtccggacgagcatgcgaccggcgtgttcgagcacgagaccgccgctgccactgcgagcgagcactgaggagaggagaacactcatggctaactatcctgcatcccagcctggttcccagcgtcatacgctgtccgtgctggtggagaaccgcccaggcgtgctggcgcgtatcgccggcctgttcgcccgccgtgcgttcaacatcaactcgctgtccgtctcccccaccgagcgtccggacatctctcgcgtcacggtgaccgccgacgtggaggccgtgccgctggagcagatcatcaagcagctcaacaagctgctgcatgtgctcaaaatcgtggaactcgacccgaactccaccgtggaacgcgaactggtgctcatcaaggtggccgccaacgaatccaaccgttccgacgtgctggagatcgtgcgtctgttccgcgtgcgcgtggtggacgtgaatccggaatcgctgaccattgaggccaccggtgccgaaggcaagatcgacgccctgctggggcttttggagcattacggtgtgattgagctggtgcgctccggtgccgtagccgtgacccgcggcccgcgcgccctgagcgaaaaggtcgtcggttccgaggttaccgggcgctgattcggcgactgcgggaagacccagtccaagctcaaaaggcggatgcgcatgatgcatatccgccttttttcatgcgtgcatacctcatcacccgtactgcaagcaaaacgacagcacctcatgctagcattatgacagcaacaaggaggtgcatcatggcaacattgaccatccgaaaaatacccgatgagcagattcagcagctcaaagaagtggctgagaaaaacaaccgctccatggaatctcaggtgcgatccattcttgaagaatggctggctggcacggtggcgcatgaaatcacgcgaaagaccaatttctatgacgagatccgcgaattcatgaagaacatggattttgagggactcgacaagggggaactcccactatccgagcgaaattccgccgattcccgaccgccagtatcttttgaataggaatcggccatgattattctggacaccaacgtcatcagcgaaatcatcaagaaacagccagacgaacacgttgccaattggctgaggaaccaagatacaagcaatttggcaaccaccgccatcaccgtcgccgagttgttggccggaatatgtcgcatgcctgaaggcaaacgacgaaagtacacagatacgaccgtcaagctggcgcttatgacattagaggacagaacgttcgcatttgacactcaggcagctgcggattatgcccatatccttgtcgaacgcgaacacaggggcacacctaccagtattcaagacgccatgattgcggcaattgcctgttcctgggatgcggccatagccacgcgcaatatcaaggacttcgaaggtaccgacgtggaattgattaatccgtgggagtttgcatagcgggaggccccggcaaactgccgaggccttgtgaacgttacggtttctcccgctactccaattgttcggagagttcgagccattcggcttcgagatcatcgctttcagtattgacggcggtgagttgttcattgagcttgttgagacccccgtagtcgctcgggtcatgggcggccatctgcgcctcgagatcggccttctgctcttcaagcttagcgagcttacgttcgatggcattcacgcgcttggatgcctcgtggaaggccttgccggtgagcttcgaggtggagtcctcaccgttattggctccctctgacgagggagctatccgcgaagcggactgagggagagatgcggcagcgttgacggcggccgccttacccttaccagacttcgccgagctgctaccggtgcccgcgaagccaggcgtgtcagccggcaatcccttgccgttcttaatagcctcaaccatatcgaggtagtcctgcacgccgccgggcaagtgacgtactttgccgccaatcagcgcgaactgctgatcggtgacgcgctccagcaggtaccggtcgtgggagaccacaatcaacgtgcccggccaagtatcgagcaggtcttccatcacggcgagcatatcggtgtccagatcgttgccgggctcgtccatgatgagcgcgttcggctcgtcaagcagaatcagcagcagttgcatgcggcgcttctgaccaccggagagatcgcggatcggcgtcatcagctgggcggattcgaagccgagacgctccatcaactgtcccggcgtcacttccttgccatccacaatgtagctcggcttatagcgggaaagcacttccttgatcttgtacttgccgagcttctccagctcatcgaggcgctgcgagagcaccgcgaacttcaccgtcttgccaatgttcacatggcctgcggtcggggtgagtgtgccatcaatcaacttaagcagcgtggacttgccggcaccattcgcaccgacgatgccgaagcggtcgcccgggccaatcagccaagtcacatcgtcaagaatctcgcggccggaaaccgtcaccttgcgtgcagccgaggtgacaccggctgcagcagtgtcatcatccgaatccgttgcagcagtgccaccgccgatggtttcaccacccgtgttcatgcgacgaacctcgcgatcgtcagcaagctgcggattgccgctctcagcctcggccttcttacgcgcttcctcagcggactcgacggcttccggcacgccggcgtccaccaggcgcgggtcagtcatgtcggtgaccgccacctcaacggaaccatgcagctgcggctcggcgtacatggcgttgaccacatccacgcgggaagcggacgcggagagcgccgccacatccgggtcgatatcggccatgccctgcggtttttcgaaaatctgcgtcacgtcgaccaaatcgaccacctgtttgccgagacgggaggtggccatttgcttcagttcaagtgtgttacgcatcggcggcacatcggcaatcaattcgcgtgcggccttgacgtggaacttctgcttggtggagcgggcacgagcaccgcgggaaagccatgcgagctccttgcgagccagattgcggcgcttggtttcgcgcacatcggcttggcgatcgcgttccacgcgctgcagcatatatgcggaatagccgccctcgaacggctcgatcacgccatcgtggacttcccacatcgattcgcagacctcgtccaagaaccagcgatcgtgggtcacgagcaacagagcgccctggcctttggaccagcggttcttcaaatgttcggcaagccagtggatagtgaccacgtcgagatggttggtgggctcgtcaagtgcaagaatatcccaatccttgagcagcagtcgggccaaatcggcgcggcgacgctggccgccggacaaggagccgaccttggcatccaggctcatgccgccgagcaatgcctcgacgatttcacgggaagtgttatcggacgcccattcgtagtcggcgcgcccctcaagtgcggcttcgcgaatggtggcgttgtcatcaaggggatcacgctggtcaagcatgccgaacgtgagtccgccacgctttgtcacgcggccggaatccggctcctgagcaccgcggaacaggtgcagcaacgtggatttgccgtcgccgttcttgccgacgatgccgatgcggtcgccttcaaaaacaccctgcgttacatcagtgaagatggttttggtagcgaaagcgagcgaaacgtgttccagtccaatgtcataagtcggcatgactcaccaatgtagcgccacgcttgcccagcggcggcccgcaaacgttatttgttcagcgtctgagcgtaggagttgcagcgggccgcaaaaccggagaacacttgctcggcgagcggttgcagtagctggtcgtattgggcgaactgctcgcgcaattgggacttggaaccacccgcggccttgagatccttgaccatgctcggctcatccagccattcgtccagcagcgagccgcacacttccaggtggaactgcatgcccagcgcggatcccagtcggaatgcctgcaccttggtggaagacgaacgcgacagcagctggccttccgcgggcaggcccaccacgtcgttatgccagtgcagcactgtcagctgcttatcccacatggagaagaagtcatgcttgtccacacgcttgatcggcgcgaacccaatctccggcgcatcgcccttgcgcagctgcgcaccaagcgcagtggcgataatctgatgccccaggcatacaccgagaatcggcttgcctgaagccacggcggcacgcgccaacttggcttctgccttcagccccggatacttatcgtaatcaagcgcgcccataggcccacccatgattaccacgccagccagttcgccgaaatcaggcaagtccggtttctttttgtcgacgatattcatcgtcaccgtctcaagaccgatgtcctcgaggttcgacaatatgcgtcccgggcgttcccatgggacatgttgcaaaatgagcacttgtggtgtggccatgacttctattgtggcacgagcgttccccgtttgcgtaacgagcagggcaaatccatgaatctcgcagtttccgcagcggtcaaagacgtgttctcgcgagactgttgtcccgcttctcatccgtctgtcacctcgttcgggccccacctgtgaagcgttcatcaaactcttcgagtaacgattcagcatgtctggttcggaccctacgcttgagtgttatgggaaacagccaagaaccgcaggatttcaacatttccgtcatgccttcaagcctgacgccagtgcatgttgcaaaggccgcagaaggcctgaatctgtatgacaccgcctcgcatcaggtcagccatttcgtgccgctcaagccgggcgaagtcggcatttatgtgtgtggcgcgactgtgcagtcgtcaccgcatattggccatatccgtgccgccgtggcgttcgacatcgtgcgccgctggtttttgaagctcggctacaaagtcacttttgtgcgtaatgtgaccgatatcgacgacaagattctcgttaaggccgcggccgcaggccagcgttggtgggcccgcgcctattactacgagcgcgaattcaccgaggcatacaacacactcggcgtactgccgcccaccgtggaacctcgcgccaccggccacatgtcggacatgatcgacctgattcagcgcattctcgacaacggacacggctatgtggtcacggatgcggacggcaagcccaccggcaacgtgtacttcgatgtggcatcctggccgcattacggcgaactcactcaccagaagcagacctccgaagtcgatgaggccgccgccgtggccgaccgcatgggcccgtccgtggacgccaccggtgccgacaagtacaatccggtcgacccggccgatgcctcccccgacaagcatgatccgcgtgatttcgccctgtggaaggctccgaaggacaccgatcccgaggacgcccgttggtcgacgccgtttggcgtgggccgccctggctggcacatcgaatgctccgccatgtcccaccgttacctgggcgatggcttcgacattcacggcggcggcttggatctgcgcttcccccaccacgaaaacgaaatggctcagacctgtgcggccggctacccctccgctgcgcgctggatgcattcggcatgggtgaccgccaagggcgagaagatgtcgaagtcgctgggcaccggcctgtccgtgccgagcgtgttggctgagcattccgcttgggtggtgcgttacgccctgggctccgtgcagtaccggtcgatgctcgaatggtccgatcaggcgctggtcgaggcgcaggccgcatacgaccgcgtctcgaacttcatcgagcgtgccggtgtggcgctgggtggacagccttctcgcgaggaagtcactgccgtctccgccgacgatttgcccgccgatttcgtggccgccatgaatgacgatgtcaatgtgtctggtgcaaccgccgcgatcttcaccgccatccgttccggcaatacgttgctttcacagctggctgaccgcgccgattccgaaaccgccaaggccgaggtgcgtgaggcgctgctcgccgtgcgtgccatgctcgacaccttgggcctggacccgctggccgaaccgtgggtgtccgccggcgctgccggcggtgccgctgatggcacggccgagtcgcccgagcatgcagcgctggaggcactgatcgccgaacagctcaacgcccgtgccgaagctcgcaaggccaaggatttcgccaaggccgatcagattcgcgacgctctgaccgaggccggcatcgccatcgaagacggcccgcagggttccacttggagtctgaagtagtcgcttcaaacccatcaatcagtcaaacacgaagtccacgtccacgatgtgcaggcgcttgctgagctccttttccagcgagcgcttgcattcgatgaggtcagctacatcaatggtttcgccgatgccgctcagatacacgtcaacggtgtagttcataccggtcttgaagatcagcgtctgctcgtagtcggtgttggcaggcagatggcgctgtgcctcggcctccacgtaggcgttggtttcatcgtcgtcatgcacgccgccgaccaattccacgaacgcctctttgagcacgctgaacggctccttgatggtcaatgccaccaaagccacggtgatgaagaaatcgccggtgtagtgcaggaagtcaagcggaccgccggccggtagcagcatcaggaagatggcaactacgccgatgccgaacgacatcgatccgtcgaccaacgtgctcttgcactcggcggtgagcatggtgctggaatcgccgatggatcggttggagcgccggtaatacgtgtataggctgaagcacacgattacggtcaggatctcgtagatgaccaccgggccggtttcaatgcgttcgccggacccgaacacgaagtagtcgtacgctactcggcacacgtcaatcagcgaatacaccaacaacgacatggtgaaaatggccttgcagatcgcgtagataggttccagtgcgaacatgccattggggaagcgctcggtggttcgcaccgtgcgcgacgagaggtacaccgccaccattccggacaggacggaaatcgcggtgaaggagaagtcgaggaacatggccttgagaccggtcatgaagaacacggccatgccggctaagacctgcagcacgttgatgacgataccaacgatcagggctttgcgttcgagtagtttttgggtgggcatcagtgggccttccttattgcacggcatgtctgcgttggcccgaacgtcatggttcggagcgcacggcagtctgcgtataagcggtgtccagcgattttcaaaacagcgtaagtattccaaaaaacacaggattctttacggtttccatggtatcggaagcactcgattggcttcgccacgagcggacggcacggcatttgccgtctgaatgcccaacatccctgactactacgcggcacattccccgaaaagcgtcgtccccaacaccgcaatttcccgcgtggcggctagactgttgcccattatggcagctttttcatctttgacagacagactctcgaatgcgttcaagcatctgaagagcaagggcaagctttccgaggcggatatcgacggcacgatccgtgaaatccgccgcgcgctgctcgacgccgacgtggcgctcgacgtggtgcgttccttcaccggcaaggtgcgtgagcgtgcactgggcaccgaggtgtccgacgcactcaaccccgcccagcaggtggtgaaaatcgtcaacgaggagctcaccgacgtgctcggccaaggcgtcgaccgtccgctgaacttcgcgaagaacccgccgacgatcatcatgctcgccggccttcagggtgccggtaaaaccacgctggccggcaagctcggctactggctcaaggattccggccacacgccgctgctggtggcggccgatttgcagcgtccgaacgcggtgacgcagctgcaggtggtcggcgaacgcgccggcgtgcccgtctatgctcccgaaaagggcgtccaatccgatggcggcgaggccgtcgcagctccgggccagacctccggcgacccggtgaaggtggcccgcgattccatcgaactcgccaagcagaagctctacgacacggtgatcatcgataccgccggtcgactgggcgtggacgaggagctgatgaagcaggctcgcgacattcgcgatgccgtgcgtcccaacgaaatcctgttcgtcatcgacgcgatgatcggccaggacgccgtcaagaccgccaaggcctttgacgagggcgtggacttcaccggcgtggtgctctccaagctcgatggcgacgcccgcggtggtgccgcgctgtccgtggcgtccgtgaccggcaagccgatcctgttcgcctccaacggtgagggcctgaaggacttcgaggtcttccacccggaccgcatggcctcgcgtatcctcgacatgggcgacatcatgacgctcatcgagcaggcgcagaagcagttcgatgaggaagaggcccgcaaggccgccgagaaaatctccgaaggttccttcggcctggacgacttcctcgatcagctgcagcaggtgcgcaagctgggctcaatgaagtcgctgctcggcatgattccgggcatggcccagcaccgcaaggaactcgagcagttcgatgagagggaaatcgaccgcaccgaggcgatcattcgctcgatgaccccggccgagcgccgcgatccgtcgattatcaatggttcccgccgcgcccgtatcgcctatggttccggcgtgacggtttctcaggtgaacgctttgctgcagcgtttcgagcaggccgcaaagatgatgaagcgcatgtccaatcgtggcggcatgggcggcggcatccccggcttcggcggcccggctatgggcggcggcaagaagaagggcaagaacaagaagaagggcggcaagtccggcaatccgatgaagcgcgaggccgaggagaaggcattgcgcgataagctggccggcaagtcctccggttcgaccggcggttccgccttcgccaagaagccacagaacccggccctgcccgctggccttgagcagatgatgggcaacgtcgacggtggcactgaactgccgccgaacctcggcggaggccttggcggactgttcggtcgctgatctcacaacttggctcccctcgcagaggggagccaaattatatctcggttcaatttatatttcgaaaggaacttccatgacgacaatcctcagcgcggtggcaatcatcgcactgttatggacgaccttaagcgcgctgcccgccggtctcgaggcccgtatgccgcttccgtacatgattgccctgacgccgctgttgtgtgttcctttgatgattctggccgcggtcgccgcatggcaacatgaatggactgcgatgtcgttgcttattgtggtcgcgctgattgccagctcacagcgcatcaactactggggtacgtcaatcgacccggccgggaaacgcaaagaatcccaccgtgaaacagcccgtgaaacaacttcgccgacgctgtcaaaaagccataacagcaatacatcgggtacctcaaacacttcgaaggaggggcccgaaaccatctccgatggacaccgtgaaacaacgcgtgaaacactctcgccccagttctcggttatgacgatgaattgtcgatacggacgcgccgacgccgctgaaatcattcgcaatattcgcgaacgcaatatcagcgtattggccttgcaggaagtcaccgacgacctcatcacacgtcttaccgaagccgacatcaacgaacttctcccctaccatcagttcggagacgccaaagagaccgataatggcggattcaacgtgatctattcccgctacgagccgagcgcagcggtgcccaacgtggtctccatccctgccgccgacgttcccgccatcaccctcaaaacctccggtaatcgcacggtgacactttgttcggctcacccgaaatcgccgatgcgcggctgcgcggattggtcggccggcattttgggtctgcgagaactcgcccgtgcaaaatccgtcagcaatcgcaatatcgtcgtcgttatgggcgatctcaactcgagcaccgaccatccgagcttccgcgcgttgctcaagtccggattcaaggacgcaagtctgattcaagccgccggcccgaatctcaccttcccgagctggctcaagtggccgcgcatcgagctggatcacgtgctgttcactcccgggctcaaaccgtccggcgtgaagtcgtttgaggtcgagggcactgatcatctggccctgaccgcaacgcttgcactgcgatagccggcattttcgcgatacattccccggaatgttgcgcaacggggaacgcgcaccacaccgcaaccacagtgcgccacgcccagtccggccctgtgcgctataataggccagttattcgcgcgcgcgtggcgccctctacaccccgagccgcgaggacacgtggattccggacggccatgccccacatggcaaaccgagaacccgcacacctagcattacaaggagagccattttggcaaccaagattcgtctgaagcgacagggcaagaagttctacgccttctaccgtgtggtggtcgtcgattcccgcaagaagcgtgacggcaaggtcatcgaggagatcggtacctacaaccccaacacccagccctcgaccatccagatcaagtctgatcgcgctcagtactggctcggcgtcggcgctcagccgtccgagcccgtcttcaagctgctgaacatcaccggcgactggcagaagtacaagggccttgaaggtgccgaaggcaccctgaagaccgttgaggctggcccggacgccgaggcccgcatcgcggccgttgaggaccaggctcagaagctgaaggccgccaagtccgaagctgctgccaaggccaaggctgaagccgaagccgctgccgccgctgaggaagccccggctgaagaggccgccgaagaagctccggctgaggcctgagcggaaacgaaaggctagctatgcttgcacaagctgtggaacacctcatcaagaacatcgttgattttcccgacgatgtttccgtcaagtctcatgagaacgcgcgcggcgaactgcttcgcgtacgcgtgaacccggaagacatcggccgtgtgatcggccgtggcggccgcaccgccaacgcgattcgcaccgtgattcaggcactgtctgaccacaaggtccgcgttgacatcatggacgtccgtcgataaccgataaggaacgattcacagcatggcacagcaagacatgcacgacgaccctcagcagctcgagttgctgagggtcgctcgtattggccgcgcacagggcctgaagggcgaagtcaccgtgcgcctgtacaccgatgatcccgagtggcgcttcgagccggactccgtgctctacagccaggatggcgagaccgagtacatcgtcgagggctcgcgcacgttcaaggatcgttggattctcaagcttgagggcgtcgacgaccgcaatgccgccgaggccctaaacggtgtcgaactctacggcgaggtcgacgatgcggaggacatgctcgaggccgacgaatggtatcccaaggatcttattggccttgaggcccgtctagtcgagggcaacggtctgggactgcccgccggccaagtggtcggcaaagtggtggatgtgatcgactcccccgcccaatccctgctcaagattcgtttgaccgagccggtggtaaccggccagaattccaagggcgaggatgtggtcgaaaagaccgcgttggtcccgttcgtggaggccttggtccccgacatcgatctggaggagcaatacctcacgctcgatccgcccggcggtctgattcccgggctgtaaacagtctttcaaaccaataccgagttccacactcaatttattccattgcaaagggcggtctttctgagactaatctcagaaagaccgccctttgattgctccttaacgcttataccgcgtaatatggctgagcctcacagataaccaaatggaatgccgaagcgatcaagacccgtaccgatcagctgatatccgttgcgctaaaactactgcgactgcaataaactataaaaaatgtgtaacgcttacacgtttatgatatgataaatgtgtaagcgtcgcacatttatcataggatatccgtcatgaagctccagcgaaaagcactgaaaacgctcaagcagtggaagaccacacctgaccataagcctctcctgatccgtggcgcacggcagacaggcaagacatggcttgtcaacgagttcgcgaatggacaatacgacaacatcgtctcggttgatttcatgcagcggccatccctatccgggatattcgagcaggatcttgacccgcaacgaataatccgtcagctcgaactcgccgccaaccaacggatactccccggcagaacactgctcttctttgacgagatacaggaaagtccgctcgcgttgacctctctcaaatacttcaccgagcaggcacccgactatgacatcatcgccaccggctcctacatgggaatatccaagcacggcaaaacctcttttcctgtaggaaaagtcaccatgatgaacctacatccgctctccttcgtcgaatatctggacagcatcggacaagacatgatcgccgacaccatacgtgaaggccggttcgaggacattccacaagctctcgaacctcagatgaatgacctactcaaaacatatatgtgggtcggcggcatgccagcagcattaagcgctcacctggataacgggattccgcaggatgtgcgagctgtccaacaagatattctcaacgcctacgatcttgatttttccaagcatgccgcatatacgctgggcgagcgtatccggcttgtatggaacacactgccatcacaacttgccaaggagaatcgcaaattcgtttacggtgttgtcaggcaaggagcccgcgcccgcgaatatgaggaagcgctcacttggctgacggactacggaatcattaccaaagtcccctgcctcgatgctctgcatattcctctgaccggatatgagagtcttaacacgttcaagatctatctggaagacacgggcatactgggcgcactgtccggtctcgacgtgaatactctggtgaacaagtcgaagctcttttccgaattcaagggcgcgttcgtagaacaatacgtatgtcagcagctggtagctcaaggaatcaaaccccgctattgggctaacccaaatcctcaaggaaatgcggaaatagatttcgtaatggaacagggagacgaggtttttcccatcgaagtgaaatcctcttccaatattcgtgcgagaagtctctcgtatgtctgcaacagatacgggctccacggtatccgtataggagaaataggctataggaagcaatcttggctgacgaacatcccactttggtgcgtggatgggctgggcgaatatctcaaacgtcaaatcgaaaagagcagggaaaatccagcgaccatctgattctttttctgatttttcgggtatgtgaaataggtggttgagttttggtgattctcatacatcaattcggacgaggatgccatcgcatatctcaatggcgcactcgaagaggatgatcccgcatttgtgcaagatgcgttcggtgtggtcgcacgcacacgaggcatgaccaatgtggcccgaaaatccggtctcggccgcgaatccttatataaggcgcttcgctcgaattcgcagccctcgtccaacaccatcatgcgagtcacaaacgcacttgacgcagaactctattccctgccgaagcgtaatcgttcacccgcgcgcggccgcggtgacgcgggtcatgaaacggtcgaggaattccggcacgttgacgcccaatgcgacttgggtgtgtttgtcggggtcctggagccgtgaacgatcgccgatggtacggcctcggaacgggccctcgagatcgacttgcaagttgaacccgaaggtcgtgaccagcgatgggtcgagcgcggcggccacggccagcgggtcgtgcagtccacatccgtgaatctccggctggttcttcaggtagaagtcgatgtagtagtcggtcatggtgacgaggaagtcgccggccggcgtccccagagacgcccattcatgggctttctcacaggtgagcgcggtctggtgggtcacgtcgaggccgatcatggtggtgcgtgcgccacacttgaacagatagtctgctgcctctgggtcttgggagatgttcgcttcggcggccgggcttacattgccgggcaatgtaagggcaccgcccatcaacgtcacgttcacaccggaatccttcaggtccggagcgttgcggaatacggtggccatggtggtcatcgcgcccgtaggtacgatggccaggtccgggccgtattcgcgcgcggcggtgatgatgaaatcgaccgccgagcctggtacttccggagcgcgcaaggagtcggggatgattgcgccgccgatgccgttgggatggtggaccgccaccgagccgggagttggtgaccacgaagcgtccgtttgccagccgtccgcgccgccgttctgccagcgcgcgtaggcctgggcccgctcgtctggtgtggtgccacgcattttcggcaatgttgccggggcgatgggatggtcgactccgggatagaccggaacatcgtcacggccgaacaagtgcagtaccgccagcgcgttgcgcgcggccagcggcaccgcgacattgccgtaggtggccgtgataccgatcaaatcgatctcgtcggcactgcctagggcatatgcgatggcgagcgcgtcatcgatgccggtatcgaggtcgaggatgagttttttgcgcacaattatctccttgtggaactacccgggactactccggcgactacccctcagtctcgctacgcgagacagctcccctgacaaggggagctgagaaagttcagccgagcttggcgagttcttcgggggtgagttcgagctggtcggccttcagggagtcgaggatggtttcgggacggtgcgcgccgggaatcacgaacatgtggtcgcccttggcgagctcccatgccagcacgacctgctggtagctcacgccgtgggccgccgcgacctcgcggaacgggtcgaacttggtctcatcataggggtgacggtagccgccgagcgggctccagcacacgaaggccaagccaaccttggcgcagtagtcgagcgtgtcctgggtctccaggtgaatcggcgagtactggttttgcacggccacgagcttgtcgcccagaatgccgcgcgcaatgtcgatttgctcgatggaggcgttggagataccggcctcctgcgccacgccctcgtccaccagctgcttgatggcttcgacggactcgttgtacggcaccttcggatcggggcggtggaagtacagcaggtcaatggtgtccacgccgagcgccagtgcgctctccttgccgcgacgaatcaggttctccgggcgaccgtccacatcccacgtggggcggccgtcggtgaagttgcggaagtggcccaccttggtggccaccagcacctcgtccttcggccccttccaggtctcaagggcctcgcgcaccagcttttcaccggtctgttcttcgccgccggagcagtagtaggcccaagcggtgtcgatgtgacggcagccggcgtccagcgaggcatgcagggtttcgatgccgacctcgtggccacgattgttttcgatggtcagcggcatttcgccgtggccgatggcggtggtggagaacggtccgaggttacggaacaatgccatggtgattcccttcaacagtaatgagacggtctgtgtccgattccagcgtaagcagaacgctggatttaccgcccgccgaacgagccgccacccgagccaccgaacgagccaccgaaaccggagccgccgcccgagccgaagctggagaaatcgccaccggaatcagcggatggtgctgccgcgctgatggtcgagctgatgtcagcgagtccggagttcagctgcgagccgaggtcggagaatccgccggcaaacgacgtgcctccgtaagccggagctgggccgctaatgcccgggtccatctgcccggcagcatcgtcattgtggcggtggctgtaccagccatacgggcggtagttccagtagaacaacgagttggaggcgttggcatccagccaagccggatcgttgacctgaggataggccttggccagctcacgcatcacgcgatcggaaatgccaaacgcggcggcgtagaccatataccaatcccacaaggccaaatcggcggcaccacggtcggtgaagttggagaagtcttccatataacgcttaaggcccagagtccggccggcaatatcctggccttggtcggtgagcacggtcatcgcgccggccatcgagcagaacaggccgaccaggaatatcggcagctcgataagaccagccaccgggtatccgataaagctgttggccagcagcgaaccaaatcccagcacggcggccaatacgccgggtaggatccattgccagcccacagagcgcgtggcacccagccgctggtattccatgctgcatgcaccggtgaatttgccgagctcaatatagccgtcttgccaattctggcaggtcgccttcatctggttcaggtcgaataccgggctgcccacgcgctgcgaaatgacgatgagcaggttcagcagcgcatcttccgattcactcaatcccaactgttgcgcgttgggtgcctcatcaatggcgagcggcagaatcacgatggtgctggtgatgcctgccgcatactgcttgccttggtcggcggcaatcatttggctcaagcctaccggcgtggcctggctcatgtcgatgccgcgatacatgtccgacggccccggatagacggcaatggccttcttgacggcgagcgacagcatggtggcggtcagctggcggtcttcatcggattggcgcgtcgacggatcgaccacgcgaatcagacgggctgcggaagccggactgatgccgggctggtcgcgccagtattcgacgctgccacggtattgcgcacgccggttgctggagatcacagcccagataccccacgcgcacaacgcgatgccgagcacgatgctgacaatccaggacacgagacgagctctggcagcgaatcgttgcttgtcgagccagcgctgctgttgcttatattcgtcctgtttcaggtccttgagatgattgccggttcccttgcgggcgatgcccttggctttggcggcatcgaacgccgcgaccacatcgaggtagtcgccattgtggatgttgtaggccgtgaacgtgtagctgccgtcgctgttgcgcttggtttccgaagtgcgctcggtgtgcagccatgcccatgaggttttgccggtgatgccgttggggaagtggacggtgccggtgaccgtgccgataggcacttggttcttcttgccgaacggctcccattggaaggaggccacgtctttccatttggtggccacatcgtgcatggtgaagctcacgtcgaacttcatactgtcggcctcggtggtgaccggaatattccagccgatctccacggtcatgttatcttcggtggcggaggcgctgggcttgaggccatcggtaccgggcgtgtatgcctttggatggtcgctgccatcgctcacatcggcgatataccaatggttggcgtagtcactgttccattccttgtcggaagagacgtcactgggcagcttgggctcgctctgttgggcatagtcgatgccgtctgtgacgttgcgcacactgatatcgctgatatcagtcagggtgccggagttcagcgtgtattgctgaaacagttgcttccacggcttggtgttgtcgtcactgtcggtacgttcacgcatcttgacgtcgatatgctgcgtgaccttcaaatcaccgttcgcggtggcggtcacatcatagtccagcgtgcggtagctgaggtcggccgaatcgccgaacgcggaagtcccgattatcgccaaggtgataactgccaacaccaccgtggcaacaatgctgacgattccggcgcgaatgaatcgcatccacatatcttccctctcttaaggcaatacgggcccggccggcggcataccggacgggcctggagcgggtcagaactggacctgtggcacctgacgggaggcatcatcggcctcgaagtattgcgcctgttcaaagtggaacaaaccggcgatgatattcgtcggcacggtttcgatggcggtgttgagcttcaggaccacgtcgttgtagatctgacgggcgtaggcgatcttgttctccagttccttgagctggttctgcagatccatgaagttctggttggcttgcagctgcggatatgcctcagccgtggcttgcaggttgaacagggcgcgggacagctggttttcagcggcggcgcgctgagcagtggtcgtgctcgggttgctggccgcagccactacgccggcgcgggcggcggtcacctgagtgaagacttcagactcgtgggatgcgtaccccttgacggtattcaccaggttcgggatgaggtcggcgcgctgcttcaactgcacgtcgatttgcgcccaaccgttcttcacacggttcttcagcgtcaccaggttgttataggcgctgacgccccaaccaatcaagacaacgataataacgacaacgacgatgctgacgatcagaccagtactcacctatgctcctttgctggacctcgctgcgaccattcttccatactcgcacgttaacagaaaatttatcacggagtattcatcgtgcggacttgtcttgtaccgctttacccgccgttctcccgtcgatcgaccgaagcgggaagtcgccgcccagtccgacaaagtattccagctcgctccgttgcgagaacgataatactcggcaatactcgcgttgaatatgcgaaagcccgccttgcggcgggctttgccgtttctcctacgcacaaatcattacgctgcgcgcaggaaacgatcagccgaaccttccagagatgtagcgctcggcttcttcgttttgcgggttgttgaacatcgtgatggtgtccgcgaagtactcgaggtgaccgggctggcccactgccttcaggttgaagaaggcggtgtagtcggcgatacgggcggcctgctgcatgttgtgggtcacgatcacgatggtgtagtcgctcttgagctcgttgatcagatcctcgacagccaaggtcgaaatcgggtccaaggcggagcagggctcatccatgagcagcacctgcgggtggacggccacggcgcgggcgatgcacagacgctgctgctggccaccggacaagccgatgccagggttgtcaagacggtccttgacctcttcccagaggttggcaccgcgcagagcccactcgaccagatcgtcggcgtcggacttggccaggtggtggttgttcaggcgcacaccggccagcacgttctcacggatggacatggtcgggaacgggttcggtcgctggaagaccatgccgacgtcgcggcgcacggccaccggatccacgtccttgtcgtacaggttcttgccttcgagcagcacctcgccctcgacgtgagcgccagggatgatctcgtgcatacggtccaaggtgcgcagcacggtggacttgccgcagccggacgggccgatgaaggaggtgaccttgttcggctcgatgttgatgttcacatcttccacggccagaaagtcgccgtagtagatgttttcgtggttgacgtcaatacgttgtcccatgatgtttccttatatttccttgtgttcttaaggcttaggcttagcgactggcttagcgttcggtcttgacggcgaagaccttcgccacgattcggccaatgaggttcagcagcagcacgatgacgatcagcacgagagccgcagcccacgcacgttccatcggaatcgtggtcacgcaggtggcgtcggcgttgggcgggcagttcgcgctgagcttcgagtactcctggtagacgaacaccggcagggtggtcatctggccggagaacaggttcacgttggtgctggagatgtagccggcggtcatcagcaacggtgcggtctcaccaatcacgcgggcgatggccagaatggcaccggagacgatgcccggcagagcggtgcgcagcacgatcttggtaatcgtgcgctgcttggtaacgcccagagccaaggaagcctcacgcaaatcgttcggcacgatcttgagcatttcctcgctggacttgaccacggtgggcaacatcagcagggagagagccacggagccttcgaaaccgttgatggtaccggggcccagcagaatcgtgaacatcgagaaggcgaacaggccggccacgatggacgggatgccgctcatcacgtcgacgagcagggagaccgtggtggcgagcttgccgcggttcgagtattcgaccaggtacacggcgcacatcaaaccgatcggaatggagataaccatagcgccagcggtgatttcgagagtaccgatgatggcgtgcagcacaccgccgtaaccaccggacggggtctggttaccaccgaccacaccggtcatgttgtagctcaggaagttcaggttcaggcgcttgatgccgttgacgatagtggtccacagcagggagatcagcgggatgcaggcgatcacaaacgccaccgcgatcaggacccacatgaagtggtccatgatattacggcgctggatggcggaacgggtcgggcggaaacgatcgaagtcgatttcgggcgcgccgtccatcggagtcttttcagtgttctcagcagcagtcatcacgcagtcgctttctcggtaagcttacgggcgatgaagttgaccacgaacgtgatcaggaacagaatcagaccagttccgatcagcgtggagacgcccagatcgttggcttcagggtactgtgcggcaatattcgcggcgatggtctggttctgcgaggcctgcagcagcttgatggagtagttgaggcccggggacaggatcatcaacacggccatcgtctcaccaagcgcgcggccgagagccagcatggaggcggacacgataccggacttgccgaagggcagcacggccagacgaatcatctcccacttggtggcgccgagcgccagcgcggcctcttcgtgcaggcgtggggtctgcatgaagatatcgcgggacatggaggtgataatcggcaaaatcataacggcgagcaccacagccacggtggcgacggtgcgcggcgggttggcggccgggccctcgaacagtggaatgaagcccaggtggttggcaacccagttccagaacgggtagatggccggcaccagaatcaggccgccccacaaaccgtagataacggacgggatggcagccagcaaatcgaccacatagctcagcgcggtggcgagcttcttaggcgcataatgcgaaatgaacagcgcaatgccgatggacacgaagaaggcaatcagcagtgccagcaaagacacgagcacagtaccgaacaacagcgggagcacgtagccccagaagctgctggccttgccgccggtaaagctggacacggtctggctgttggcggcctgatcgccaccgatgagtggccaggcgcggaagaacaggaacaggaacacagcggcaagtacaaccaggatcaggatgccgcaggcgtatgccacaccgcgaaacaccttgtcggcggtcttgccaccaactggctgcacagccgttttgtcttgcgaactcacggattctccttatatagggtggttatcaagtattcaagtggtgcggttttcgtctgtgacgttgccaaaccgttcgggtcctgacccgctttaagccgcagccgtatggtttacgactgcggcttaaagttggcggcgactgctcttactactacagtctatcgttcagttgtcaggtccagtccacacgacccttgcgggccgacgtcatcacttggtcttgatggcctcgatggacttggtgatctcggacttcagggaggagggcagcggagcggtgccggcggcatcctgagcggccttctggccctcgtcggaggtcacgtaggtcagccaagccttggcgaactcagcctgcttggtgtccttgtaggccgggcagacgatgtcgtaggagaccaggacaatcgggtaagcgccctcggcctcggtggcgtggttgatcttgatgacgatgcggttgtcacccttaacggtgtcgtcctgcttggaatccccaatgaccttggagccggcctcggcggaaatctcgttgtacttgtcgccgaccttgacggccacggtgcccaggtcgccgacctgagagaagtcagcgtagccgatggtgccgtcggcctgcttgacggtggagatcacgccagaagtgcccttggcaccctggccaacctcgttcggccagttctcggagaggtcgtaggtccagttgtcaggggtgacgtccttgaagtaggagacgaagttctgggtggtgccggacttatcggagcggtgcaccacggtgatggcggtgtcgggcagcttcaggtccttgttctgatcggcgatggccggatcgttccacttggtgatcttgccgtcgaagatcttggcgatggtggcagcgtccatgttgatgtgcttgccggcatcggaaacgcccttgaggttgaaaaccacggcgatcggggagatgtagaccgggacatcgaaggcggtgccttcagtgcacacggacttggactgctcaacttcgtcatcggcaagggccttgtcggagccggcccaagcggtggcaccggtcaggaaggtctgcacgccagcgccggaaccggacgggttgtaggcgatcttggcctcagggttggtgccctggaagccggcgatccaagcttcaacagcggcctgctgagaggaggcgccggcgcccgagaagttgccggagatcggggtggacttggaagtggaatcggaggaggagctgttgtcggtcgtggtggcggtgttatcgccgcaggcggccacggaagcgagcatcacaatgccggacagagcggcaatggagcgaacgaggatgttcttctgcatgattattacttaatccctctatcaactattcgcgggcggctcagcgctgcccggtcaattcatgacaactacaagcgtattggtggtttcaagggcccaaaaccgaaatcagtaaacagaagatgaacacttggatgtttgtgggctacgttgaggctacgtagtttttggagcgggctcgcctgcggcgagtccacagcgagcccacaatccacaacaaaaaaaggcgacccgaaggccgccttccatttactccgcgggagtatcgatcttgtatccgagaccgcgcacggtagtcagatacttggggtgcgccggatcttcctcgatcttggagcgcacgcgcttgacatgcacgtcgagcgtcttggtgtcgcccacataatccgaaccccagatgcggtcgatcagctggtgacgcgtcatcacacggcccttgttctgcatgaggtattcgagcagttcgaattccttgagcgggaagaacacggtttcgccgcgtacggtgacctgatgctggccaacctgcatggcgatatcgccacacaccagcggaatatcgtcatccacagtgccggaagcctgggcagtggcctgattgcgacgcatcacggcacgaatacgtgccagcagctcacggaaagagtacggcttggtcacataatcgtccgcaccaatctcaaggccaacgaccttatcgatttcggcgctcttggcggtgagcataataatcggcacacggctctgctcacgaatgcggcggcacagtgcagtgccgtcaatgcccggcagcatcaaatcaagcagcaccaaatcgatgccgcccttggtgaacagttccagaccttcctcgccagtggcggcggcggacacgtcgtacccctcgcgtgtgagctggtataccagcggctcgcgataggattcctcgtcttcgacgataagaatgcgtgtcatagtagcctttcttgggtatgttcccgtgcgcataggcgcaaagttttccgacattatcgtaaccatttgttctccgttagcctgctgtttcccgaaagtacgtaattgcgtaattgggctacgcgcggtgtgcgcacctcgcccactgtgtgattgtgtggcaatggaatggcaccatgtcgggcaccaaccaaggccctacgcttgtgtcgactcgtccgaccgggcctcgtcgtcatcctcatccggggcggccggcagctcgatggtgaacgtcgacccctcccccgtacgcgaccagaccgaaatccgaccgccgttctcctgcacgcagtgcttggtgatggccaagccgagtcccgaaccgccggtctcgcgcgaacgggccgggtcgacccggtagaatcgctcgaaaatgcggtccagcgatttggcggggatgccgatgccctgatcgaccacgcgaatggtgactttgccatcgcgctcccccacgccgaccgccacagtggtgtgttcgggcgagtaatggatggcgttctctacgaggttcttgacggcggtttgcatggcctctttgtcggccttgatcatcggaccgttcgtggctgggctgcctgattcttccaaggaaccttcgccatcggccggctcctcgaccttcgtgggtactgactgtccgttgacactcagtcggatatccacatggcgggagtcggcttgggtctgattggcggcgatggcggcgcgtgccacatccagcgcggaaatgcgccgcgcatcgatcacgctttgcgggctttgggctttctgcaagtcgataagatgatgcaccagttcggtcaggcgcgcggattccttggagatacggccggaaaaataccgtacggcgtccggatcatcggcggcgtcggtcacggtttcggccagtagcgcgatggcaccggccggagtcttgagttcgtgcgaaacgttggtcacaaagtcacggcggacggcctcgaaacggcgctgctcggacatgtcgttgatgaagatggcgtacaggtcatcgccgatatcgccaatgcgcacacgcaaatacagcgtgttggacgggcgtgactggccggcctccagtcctcggccattagaggacggataggaattgcgattgaccggcagctgaacctcacgctcacgcatgccaccgtcggcggcggcctgagtgaggatgtcctcgacttcacgcgagttgagtcggtcgccggagactaggccgaatggcactgagccgggacttgaatattggaccagaccgttgcggtcggtgacgatcagggcttcgggcaggacttcaatcaggcgacgctcggtggggcgcacgggcgcatcatcaccgaatagagaatgcgtatcctcgtcgccggacaggtcctgttcggcggcgagccggcctgaaacgcggcctttgttgtaggcgatgacggcaacccacaccagtatcagcgcggcgagcaccacaatcacgacgatctgccagatatccatgatttccagagtaaaacgtgcgaggcgtagtgagatgcctaaactacgtaagttcgtctattgttcatttttggcgggacgacataacaaaatgctcccgctggcgggagcataatatggggagctctatttacagctcgtagtccttgtccttgctttccttgatcaggaacagagcgagcagagcgagggcagtcatgatggccatgtaccagcccacaccggcaacgccgaacttggaggtgaccagttacaggcgcttgacgatgtcgacagccagacgggcggcggtatcggcgtattcggagatgtcgaactccttgaatacctcgtaatcggtgtcggcgttgtcggaaagggcacgaatcaccagtgccggcacgttattgcgggcggcgacctgtgccacggcggcgccttccatctccacggcgtcagccccggtgagtcggatgacctcctcgaccttttggggcgtgtccacgaagtagttgccggaggcgatgatgccggtgatgtgggtaatgcccgcattggcaagcgcctcgtcggcgacttccagcagacggtcatcagagtggaattcctccaccggagcgtccgcagtgccgggcttccactggcctacgagccgcatgtcagtgtcgaggtagcgcagggtgccgccgagcaccacgtcgttgatgtgcaggtgggtgttgaggttgccggcgatgccgctgaaaatcacggcgtccggggcaatctcgtcaatcagcagctgcgtggtggcggccgcattgaccagtcccatgccgcctaccgttgcggcaaccttgatgacgtcagaaccgaaggagtcgaccgtgccggacacgatgtcaaggctgcccttggcggtgtgcgtcacatgcgtgagcgatttggcgatcagcgccacttcctcatccaatgcgccaataatagctacagttttcatacccatacgtaagttcctttcacaacactttcggctccccttgtcaggggaggtggccgccgaatggcaggctgaggggtagagacgtttcgttgcattgctcccgcgagagagccgatgacgcaactcagtgccaacgccgtgtggctacggcttccgcaagctcgcgcagcaaggcctcggtttcttcccagctgatgcacttgtcagtaatcgacttgccatagaccagctgatcaagcggcgcggccttctgattgcctccttcaataaagctttccatcatgatgccggtaataccctgttcgccagctgcaattctgctggcaatattgcgcacgacttcggcctgacgatgttcgtccttgccggagttaccgtgcgagcaatcaacaatcagaccatgcgaggctgcggattcggcgggcatttcggcgcgtacgtcttccatggctttggccacggattcggcatcgtagttcgggccgtgaatcgagccgcgcaacaccacatggcagtccgggttgccaagggtctcgactgcgcaggcacgccccagatggtcaatgccgaagaacgtgtgctgctgagcagcggcgaagcaaccgttgaccgctgccttcaccgagccgtcagtggcattcttaaagccgaccggcatggaaagcccgctggccaattggcggtggatctggctttccgtgttgcgcgcaccaatggcgccccaactcaccgcgtccgagatgaactgcgggctggtgggctccagaaattccgtggcggccgccaatccttccttcagcacaccaagcaaggttttgcgagcaagcaacaggcccttgcgaatattgtggctgccatcaatatccgggtcgttgatcaggcccttccagccaatggtagtgcgcggcttctcgaagtacacgcgcatgacgatgagcaactgttcaccgagctcatctttcagcttggccaatcggcgcgcgtagtccagcgcggccttcgggtcatgaaccgaacaggggccgacgatgaccaacagcctgtcgtcttggccgtacaggcacgcgcgaatctcatcacgcgagtaggcgacgatttcctgagcctgatcagtcagcgggagttcagcgagcacttgcgcgggcgtgggcagcggctccaactccaatacgcggcggttgatgatgcgactgacacccacctgatcttcccaacgcggcacatcagtggcaacgagcgggttcttcccctcccccatcgcctgacgaatggcgcgaagctcttctggggtgttcaacggctgcggaccgacttgcaacggatgcagcgaatgtgctgcttcctcctgctgctgcataacatctctccttgggtcagtatccttcccaaggataaggtgtcacgggaacaaactgacatgaccaccgttattggcaaaaaatgctcactgagtgggtctcagtgagcatttttacaaagacaaagctatttagccgagcggcgagcggtgacggcgtcggctagggtgtgcagcagttcgttggtgcgttcccacggcacgcaagagtcggtgacggactgaccgtagaccaactggtcgagcggggccggcttttggtgaccgccgaccaagaagctttccatcattacgccggtgatgccttgttcgccgtgcgccaggcgctcagcgatctcttcgatgacttcggcttcgcggttttcgtctttgccgcagttgccgtgggcggcatcgatgacgaggccatgctggctcgggccggacgctttggaaaccttgaggtcttccagagcttgacgcacagattcggcatcgtagttcgggccgtggctggagccgcgcagaaccagatggcaatccgggttgcctttggtttcggcggaaatcacgcgaccgtccaagttaatggacaggaagtgatgctcgaagccggccgcgaaacaggaatcggcggcggccttgatggagccgtcggtggagttcttgaagcccaccggcatggacaggccactggccagttcgcggtggacttgggattcggtgttacgcgcgccgatggcaccccagctgatcgcgtcgcagatgtactgcggggtgatggggtcaagccattcggtggcggcgggcaggccgaggctcagcacgtcggtgagcaccttgcgggccagccacatgcccttacgaatattgaagcgaccgtccagatcggggtcgttgatgaggcctttccagccgatggtggtgcgcggcttctcgaagtacacgcgcatcacgatcacgagtcggtcttccaactcgcgcttgacggcagccagcttttctgcgtactcgtgcgcggccttcgggtcgtggattgagcaggggcccacgatgacgagcagtcggtcgtcgcggccgttgagcacatcgcggatttcctgccgcgagtggagcacgagctcgctcatctcatcggtgagcggctgctccctgaggaaagcacgcggcgcgggaatggggtcaagctgacgaatgttgacatcgacggtctcaggaaagacggcctgctcccccaaacgacgttcatcctcggaactatccggaccacgtagtgctgccattgctcgactcctttccttgtatacgtactgtcggtatgtcgccatagacgcaaaagcccaactatagcagtttgttacggggactgcttgttgggccggcagttatggactttgggtggactcgcctgtgtggactcgcctgcggcgatgctgtgttgttgtgcggcctgcgaccgcggtctctccctctgtcagcggcttcgcgctgacagagggagagaccctagcagccgacaggctgcgagaaaacacagcattggccgtcaggccgattccgggaggctgacgaagtcaggccaaagcgcccatcggatcccatgcggggagcatggtggctggctcttcgagggccttctggtattcctcgggcaacagggccttcgggacggctacctcgtagacgtattcggtgaaccagtcgtcggacatggtgaagtagcccttgtcggcgatcttggcgccccaagagttctccacgcgccagcggcgggtggtgccgtcgtcggccacgtcaacgccggcgaaagccatggcatggttcatggcggagtcgccgaagcgcacgcgggcttccttgtccaaatcgaagtccacgtcgtacacgcggccgtactcgaacaggtcggtggcccaagcgccgttctcacggtccatgaacgggtggcagtcggcaccgaaccataccggaatgccctgctcaacgagaatctgcttgacgcagtccttcatgaactggtttggcacgttgaggtactcggtggcgtcgccgccagccacattgccgaggtgctcgatgccgatcttcttgcccttggcgtgctcggtgcgcggatcgtccaccaggcacacgtagtcctcaagatcagccggacccacgtacttcttccagaactcaaccggcgtaatctcgccgtcgcggtggaattcgccatccttgtcggtccattcccagtcgaaggaaaccggcggctcgcccaggtggatggtcagaatacggtggccggcagcagtggcgtcggcaataatcgcctcgaccttggaggcatcgccgtcagcggcgtacatgtgcgccacggcggtgtgcagcatgtggcgcagctggatgttcatttcaccggtgttcttggaggattcggtctccgggaacaggtccttgggcacagcgccgtacttcttgtacacgttcatggccatggtccactggccgccatcgcccatcacgtcggcgagcaggtgctgcatcaggcgggagtcggaaggctctccggcagccaccagagcggccacatccttaaggaagtagttgacgcgctccagcttgtcgtagtacatcgcgtagttctgggagaactcgaactccttcaagttcatgttcttcttggccacgaaacgggccacgttcagggagctgaacagccagcagcggccggagcgatcctgatgggtggcttcgccattgtcaacgatggtggagaaacgacgctgcatcagacgagcgcggtcataattgcgagccaccttgtcgatgccggcggcggtcaccgcgttcatggccagacggttggtgccgctctgtgcgaaatcgccgcgcagggtattcaacgcttcaccggtcagaggcgtcaattcactcatgtcatactccttctgtgatggtgcgcttgtggcgcagattcaaacgaatacggcacctggctcgaaagcgcaggtgccgtaattcttaccgctagtagtctaatcgaaggcctgtcattcgccgttctgctcagatacggccggattctcctgagtcggggcctccggttcgccctgtgtctggtgctcggacggctcagacgattcggactgctcattctgcgcagccgaatcagccgaatcagccgaatcagccgaatcagccggtgccgcatctgtctcattgtgatcgtcggcagccgactcgtttccactcaactcacccggctggtcatcggcctcgttgtgtacaggcttgacttccgggacgggcgcaaccaccggcaatgccgccacggcagcggcttcctgatcctggccagaggccgccgcattaccgccgaaagcgaatccggagaacgcctgcgagaacatagaacgcagttccgaaacacgctgggtgatgacggactcgcgttcctgcagatcggcgatgcgcttggacagaccgtcaagctcgctttgggcggcggcgcgacgctcctcgatctgcgcatcggcttcctcgcccgccttatgtacgattgcggcggcctggatgtccgcctcctcgcgcttggacgcggcatacgaatcggcttggtcgcgagtgttcttggcctgaccgaccaactcatcggcttcccgcttggccgccacacgacgctcttcgaggtgctgcagcagttcgttgaccttcttcgtggcctcatcctgctgagcggcgatgtcgtgacggatctgctcgacctcggcgttgacctggctcatcgtgctggtgcgcttgacctcggcctcatcagtgatttcctgacccttggttttggccgcatcaatgatttcgctggccttgcgctgggcttcggtcatcatcttggacacttgctcgcgcacgtcggcgagcttcttgttggcctcggcgagcgccgcctcaatctgatcgttggaatcagacttaagcttggtgatctcctcattggcgcttttgcgcattgcggcaacctgctgggtcgcctccgccttcatgtcggcgatttcgcgctcttgagtggagcgttcggaagccatcttcttggtgtgctcttcgcgcgcgttgctgagctcaagctcgacggtctgacgctgttcggtgatggtcttggcagtttcggagcgcagttgtgcggcatcctcgttagcggaggtggtcactgattcggcctgattgctggcgttcgtcagaatcgaggcggccttggcattggcgtcgtcaacaatatgctgggcatccagcttggcgttgttgatcagtgtttcggcctgagcctgagccgtggtacggatggaggacgcgtcctgcttggcgcgttccagcagttcggtactcgtctgttcggcggaggcaagcatctgctgggcgttcgctcccaaggaagcgaagctgttgccttccggcttcttgttcttctcttcctgaagttgggcctgcagttgcagaatacggtcgtcatccgccgcaatctgctcacgcatgctggccaacgtctgctgcgcacgcttcatactctcctgagtagcgtcgaaggcagcatcaaccttctccttgtcatatcctcgcagcaccaccgggaaacgatccaccatcgctgtttattcctttcgcacacgcataaagctcttggcacatccttgaagcactgtagcgcatcgcactagcgctgagcgttgagcgacgcgcaatcgttacaatgcgtgcgaaccatgttctattccggcgtggcgcacagcgtgctaggcgatgaggatgtcggagctggagggcttgagatagtagcgcacggcttcgcgcaccacatcacggccagcggcgatctgctggtcgagtggtagaccatgctggctggaatgcgccggaacgaccggagggaagctgacgaatccgcccagcacctgctcctgggtggcggtccagttgagcaagttgtagaacagcgaattacatacgaacgtacctgcgtccgaactcaaggtggccggaatcgaatcgtccgtgaaatcattcaggatcgagcgcaacggcaggcgggtccaataggcggccgggccattgggatcgatgggttcgcggcgtgggatcacgttgtccgcgtctggcttgatcgcgtccatcaggttggtggcgcatcgttcaagcatcacgcctcgggctgcgtgcttgagcccggtggcgatgacgatattgggcttggtggcctcaatcgtctctttcagcgtgggccaggctttggcgaagctcaccgggatgctgacagcatgaacggtgacggcgacctgctccaacggatcgtccggagcagaggagacgcccagtccctgctcggcgatggccttgggcacttcgacggcgggattgacctccacgccgtcatagtggtcgaagccggagatcacaacattgagttcacgcataatgccagtctagcgatgcatctggccggccgcttgggccagcagggcgtgcatgcgggcgcgggcctcttccttgggatcacgaccgagaatctcctcggcgatacgctcagctgtgggaatatcttccagcgtggtgatcttcaggttggtttccgcaccggagacaatggcgacgggttcatcaggcagataatcgaccactacgcgcgtgtcgtcggtgggatggaagtccgggtcggcggcagccaaatcgtaagcgtgacgaatcgtcgcgaagcggaaggattgcggggtctgcgcgcggaaggtgttcgggcggtccggcaccgacttgaccactttcaaatcgcccagatcctcggtcaacagcacggtgtcggttgaggcgtaggccacggttgcggccgtgaactggtcgagcgcatcaatcgaaccgtcgatggcggactgttccacgaacggacggacggcgtcatggatcagaatcttggcatcgtccggaatgccagccgtagccagcatgtcgagcgcggtggcggtactgtccacacgctcgtcaccgccgtcaatgatgacgcggaccttggtgtagcccatctcgccaaccaacgtttccacttcaccgcgcaccttgggattgaccaccaccacgatgtcgctgacgcggtcgcaatgttcaaaggcatcaatgctccagcacacgatgggcttgccgcccacggagacaagctgcttgggattatcggggtcgaagcgcgtaccgaagccggcggccagcaccacggccaccaccggcacggtttgcgccggtttggcgccctgagcgggggccggctggacggtaggcgtctcgacgggggtatcgaaatctctctcagtcataggcaccaccgtagggtgagggctggccgtccgtgaactgcatcacatcttctccacggaatgtgctcgcattctccgtttagtcacgcacgatgagggcgaggaggcggccttcgtgtgttttgttggcgagcgcggcgcggcggtgcgagtaccacagtgggttttcgagcgtgcacatgctgtggctgatgttgtcgatgcgctccgcgagctcggccgggccttcgccatccgtacggcacagttcggcgagttccgggtcttcctcaaggtactgggtggcggcgtgcacgcgcggcatcgaatcgaccacctgatgtacaccggcgaaagcgaggtcgatcatcgcggcttcggcgatgtcgatgccggcaccgccgaaacgggtcttcgtcttggtcagcgggaagcgcttgatgaactggtcggcgatctcgtcgcccacttcatagcagtcgccgcagatgcgcgggccgagtgtggccacgatgttcgccgggtcggcacccttgctcttcatcaggtccaccgtggcgccgatcacgccgcgctccagaccacgacggccgcagtgggccgcaccgatgataccggtgaccgggtcgcccagcagcaccggcagacagtcggccgcgaacatgcctagggcgatgccggattgtgcggtgacctggccgtccgcctcgatgacgtgcggagtgtcagtctcaccatgtgtgccggacacgtcgaagccgaagggggtgttgatgacgaacgagtcgtccacgtccacagccacgccggaatgtacttgggagaccagcgataggcgggcttgcaccgcttcggcgagtgcgatgcggttcgacagcacggcctcaggttcgtcgccggacttgccgccgaggttcaggttgccgtaatcgccggcgctcaggccgcccagtcgcgtggtgtacaccaccttgatgccgggggccagtgcgatggggatggtcaccggaatagggcgaccggctttatcggtagagctgatgctgttggaatcgaggatttcttcgctgtattcaggcataaggcattctttcttgggtgcgggcggtgttcatgattttcatgaccacccccccagtcagcgggggggcggagtggtaggttattcggctttgagggtgggctttttggtgcgcgagcggatggcggcgttgatgggcacctggtgcgggcagggcatcgagaacacgtgcgccggattattgatggcgggtactggcgcgccatcggcatcgcgcaggccggtttccggcacggtaaagaccaatggtctctcgccaggcagcaggaattcgacctgttgaccgggctcaatcttgttacggctcatcagcgtgacacgtccgtcttcgtccgcgctccagctcagcacttcgcccactaccagccatgagcggaagtaggcggagcggtcggtgttctgtgtgaccttgtgctccgggtaatagaagccggtggagtagtcgcggtgggccaccttgtcggtttcctcgagcagccattcgggcagttcgacgtgtggggccgggcgaacggccgcatgtttccaatcggtctcaatctgttcgaccgcggtgttggacttgcggcgcgtggaacgggcgtgagagctcatgccgtcgggttcgacggcggtgccggccggcgtaccagaggcagttgagtcgacggcatcagcaaccgtcacgcggtcacgttctgcggcaaccgagccggtgaccgaatcggcaaccgcagtatcagagccacggtcatatccctcatcggccacaccggcgaacgcggcatcagcattgcgcatcacttgatcttcggttccttggccaaaatcggggtcgcccgggcgaatcacacggtcatggaaaggcttcaaaacattgccatcagcgtcttcaaaaccgcgttgaatcatgtattcattaaccgcggttttgtaggcgttggtcatggcggcgatatagtaggcgcttttcgcgcggccttcgattttgaggctggtggcaccggagtcaatcaaatcatccaagtgccccagcatattcatgtcctgcgaattgaacagataggcgccgttctcggtctgctcgatcgggaagtactggccggggcgcttctcttccacgatcgaatacttccagcggcatggctgggcgcattcgccgtgattgccatcgcggccggtcagatagttggagaacaggcagcggccggagaaggccatgcacatagcaccgtggacgaagcattcgatgtcgaggtcatcgggaatgttggcgcgaatatcacgcacggcctgcaagtccatctcgcgggccaacaccacacggcgagcaccaagctcgtagaaggcgttcgcagcctgataattagtcacgccggcctgggtggagacgtgcagttccagattcggagccacctgacgggccatcatcatcacgccaatatcggagacgatcagcgcgtccacgccggtgtctttgagctggccgacgtactcgtgcatggcttcgatctcgttgttgcgcggcagcacgttgcaggtcacgtacacgcgagcgccgcgttcatgggcgtagcgcgatccttcctcgaaatcctcaaggctaaggtttttgggggccgatcgcatgccgaaggctttgccgccgcagtagacggcgtcggcaccataatcgaccacggttttcaggcccctcaggttgccggccggggacaacacttcgggctttttgcgggtggggaggttcatcgtcgtattcatcaccgcaatagtgtagtggtggccgtgtaatgcgggaggggctaccgttaggctggatgacatgaagatcgatatcgtgagcgtgttccccgaatactttgaggtgatgaacctcagcctgatgggcaaagcccaggccaagggattgttggagatcaaggcgcacaacctgcgcgactggacccacgatgtgcatcattcggtggatgatacgccagtcggcggcggggccggcatggtgatgaagcccgaagtgtggagcgaatgtctggacgaactgctgggattctcgcagccgtccggctcccccgccccatccggcgcaccggtgctcatcttcccgaacccatcggccccgttgttcacccagcgcgacgccaccgagctcagccatgccgaccatctgctgttcggctgcggccggtatgagggctacgatgcgcgcatcccggactactaccgcgcccaaggcgtcgacgtacgcgaatattcgatcggcgactatgtgctgaacggcggcgaagtagcggtatcggtgatgcttgaggccatcacccgcctgatgcccggattcatgggcaacccagattcgattgttgaggaatcctacaccggcgagggcgcactgcttgaacatcgccagtacaccaagccggccgtgtggcgcggtattgcggtgccggatgtgctgttgtccggcgaccacggcaaggtggaccgttttcgccgcgacgaagcgctggcccgcaccgccgagattcggccagaccttatcgcggcactggattgcaaggcgctggataaggccgatcgcaagaccctgatggccttgggctgggaggtctccgccgcccatccgcgccggctcgccgattaattcaccacacggtgggagattcactacgcggcggaatcgtcggaacgctctatatccgagtcgtcatccgcggattcgatgtagaagacggcggtttcgccgtagttgcggctttcggtgatttgccagcctccgggggcagtgggatcatccgagcgtaccgagcgttcgagcatgatcaccgtgttctcgttggtggcgctgcccgccgccagatcggacagtagctgattgcattcagcggtctcataggcatagggcgggtcgatgaatatcacgtcgaatggttcgccgaagccgccagccacttgctcggcttttttgaccagcacacgggccttgagcgaagcatcccacgaacgattcttctgtagctgcgccaaggtcttggtaatcagcgccgccgcaggccgggaactttccacggccacgagttctcgcgcgccacggctcagcgcttcgatgcccaacgcaccagtaccggcgaacaggtccagtacacgggcatcatccagcactccccatgagtcgaggtgcgagaaaatcgcctctttggtgcgatccgtggtaggccgggtacccgttttcggcgtagcaagcgccacacccttgaatcgtccagaaattacacgcatagctttcactgtacaggttcatctgcgcataccaatcatgaacaacaatggggtgctcgaagcgcaccaatgatatatgcacttcgagtacctcatgtacgaatggtcttgcctccactgaagcacattcgagggcttcccgaccgtgatttcctcacgatcggcatacggaaaaactatatcgtgcgattacgggggcgcagccctagcctcagctggaggtgcctcagctggaggtcaggaaggtttcgttgcctcgggtgaagtcgaggacggcaccggcgagttggacctcacctgccagttcggggtcggcggccagaagctgcccggcacgggtgcgggcgtcggcgatcatgtcggcgtccttgaccacgcgcaggagcttcaggctggacttgccgccggattgggcgtcgccgagcacatcgccggcaccgcggaattccaagtcggcttgggcgatttcggcaccgtcgagcgagtggtgaatcacttcgagccgttgctcggccggggagccgggttccgcacgggaaataaggaacgcccacgagttggtgccgccacgccccacgcggccgcgcagctgatgcagctgagagaggccgtatcggtcggcatcaaagatgacgatgcagctggcctgcttgacgtccacgccgacttcgatcaccgtggtggacaccaggatcggagtctcgccgccggcaaaatcggccatgacctgggttttgacgtcatccttgtcgcggccggtcagagtcgcaaaccgaatgccttggaactgtggaagtttctgcaaccggtcggcgatttcggccaccgcatgcaatggcgggcgagccacggtttcgccattttcgtcgaaggtttcgtaggggtcgtcgatgccgatggcatcggccgccgcgcgcgtcacacggccgcccgcagctgtgcgggcactggaaccagatgctgcggcgcgtccgcgggcagaaccggctgctgccgaaacgccggaaccgccttcgttctcctcatcatccgcatcaatgcgcgggcacacgatataggcccgctcccccgcgtcgactcgcgcgcgaatgtgcgcgaacatacgccccatggtggcggcgtcggcctcattgaccaccacggtacgaatcggtttgcggccgccaggcaattcggtgagccaggaaatatcgagatcgccaaaccaagtcatggcggcggtgcgcgggatgggcgtggcggtcatcaccagtagatgcggcgtggtgccgtcatcggttttggcgttgaggctttcgcgctgttccacaccgaaccggtgttgctcgtcgatcaccaccaaggccaagtgcggggcttggaaggtcttggaaaacgccgcgtgcgtggccacgataatgcccggctcaccactggcggccgcagcgagcgccttacgccgggcggcaagcttcataccaccggtcagcagggtgacgggaatttccgcagtcaccttggaagaagagaccgtcgaagcaccggacgcgcccatcgcgccctcaacgtcggccgcggcatcggtctccttggcacccggctgtgcaagggtcaaccccgacaccatcttgctgatggtctcgtaatgctgttcggcaagcacctgagtgggagccaccagcaccgcctgatagccggcgccgaccgcctgcagcatggccgcgagcgccactacggttttgccggagccgacttcgccctgcaacagacgctgcatgggccagtcacgttcaagatcggacgcgatgtcgtccaccacctgactctgcccggctgtcagtgtgaacggcaacgatgcgatgaagcggtcgcgcaaattgggcaaattgggcagatcaggcagatcggtcgcagaaccgcgctccgatgcttctggttgcgtacttggctccgcaaccgcttcgcccaccgacgctcgagctgtttccagcgcctcgttcagcgggcaaggatgcgccgatgacttgtgcgcgtgctgtcgagacttcagcagcgaggtctgcgaaacgaaagcctcctcatagcgcagggtttcgatggcctccttgaaccgggccgtggaggccggatcatgaatggccaggaacgcctcagcccgatgcatgaggttcttggccttgcgcaccgattcgggcagcacatctgggatggattgggagagcgcctcagcaccggattcggcggtcgtgccggacttctcttccccgttttggacggcgatggtgtcagtcgcgggagccacaatgccggctgccccagcgccagcgagttgcccgtcaggcgtggatgacgtgcgggcccccatcatccacagcaatcccagaatcgtctcatgaatatgttcggacgagatacgcgaactggcgtgatataccgggcggggccggcagacgcgggtaagcgcctcttgcacggtatcggcgtcgtatttcaacgcggccccggaaggggcagtcgcggccggcggatacgcggactgcgcactggcatacggatcggcacttcccgcaaacgcaccattgccggatgccgcgccccgagcgtaaccctcaagccccgctcctgctccggccggcacgggcgcgacagtgaggatttcgggatgggtgaactgcagctgacccatgtattcgccgggcataccggagaccaccacagacgtgccggcgcgcagtcgcacgctgacccaatccacatacgatttacgatacgagaagaacgtgagccgggccgtactgccgggtacgcgacgagaccgggcgaagtcggcgtcatcgaccgtcgcttcgagtcggtagccgcggcgagcgttcatcggcaccacgcgcatatctcgtatcacggcggcaaatgccatctgctggccgggtgcggcctcgcggatggcgcgaagcggcaccggttcggtgacgcggaaaggatagtaggtcagggcgtcgccgacagtgacgattcccagcgatttgagcgcggacacgcgacgcttgttggtgaccagcgaagcgagagtggtgcccatagtgatgctcatattggcctattctattcgcacggcctctttaggccgcagaaacaacaaaacccgccaagccgaagctcaaacgggttttgctccacgttagtacgcgattcacgcggccacgcgctgaaccttgccagccttgaggcacttgacgcacacgcgcaggcgagtgttctcgccatcaatcgtggtgcgcacagactgcaggttcgggcggaagctacgcttggtacgacggtgcgaatgggaaacggtgaaaccggtctgcggtcccttgccgcacactgcgcaacgagctgccatgatggactcccttaaccttgatgtgtcaagtctttcacgcattcgaccgccggtttcacccgacatgccgaacacacaacttcacaaatatatagcccaataccgacaaccgcaactcttgcgtgtatcatgggcgaacctcggcggttcacgcgcggttcgagcgtaacttgcgagtgggccatcagcggttcacgagcggctcggcattggttcgccagcggtccgcaagtagttcgtcagcagttcgccagcggcgaattacgctgcaaatcatagcgtttacccgataaaacacgccggccttccttttccgcatccagcaaactctcatataatctcggtataagagacggcaagggacgaaggggtcctcgtgcaacttacgacgaaggaggctgtcatgttgaatctcaagcgaggtatcggcactcacgagcccagcgtgatttcactggggcaagtctgggtggacattatgctcaatgtggacaaggtgccggcacagggcggattcgccgtggccgatcatccgaagccctccattggcggcagctatcgcgtgctgcaggcggccagccgcatgggcgtgccgaccgagcacgccggcattctgggcaacggcctgtgggcgcatttcatccgccagtcattccaagacaacggcattacgcatatcggccaggatcgtcttgatgaggattccggcttccgcgtggtgctgagctccggcgcgccgaagaagacattcatcgcttcctatggcgccgaggctcatggcgactcggacacgttcgacacgctggagccgcagcccaaagacgtggtgcacatcagcggcaacacactgatggaccacacggccaccggcgtggacggattcctgctcaaggccggtaccgacccggctgcacgcgactacacgctggtgatcaaccccaccaatacgttgcgtttggtcaacgaccatatgcttgaggacctggtgctcgcacgcccggtctggtcctgcaaccgtcaggaggccatgacgctggccgagcgacttggtgcgccaatcgacgacagcaaagtcaccattggcggcggacttgacgacttcatgcaccagttgtgcgacggcttgggcgctacactgcgcgcgccgctggtggtgcgtgtcggcgcccgcggcgcttggattcgtgagccaggtggcgagacgattcatatcgagggatacccgaccaaggccgtacacacccgttcggcgggcggttgccacaccggcgtgatgtgcgcgatgctggcaaagggccatagtctggccgaatcggtaaagatcgccaacgcggcggcatccatcgccatccagcacagcctcaacggcgtgccgcaatgccccgattacgacgaggccatcgcgctgatcggcgaatagtcgactataggtagctccccccagtccgcttcgcggccagctcccctcagcgaggggagctatttttgctctggctccccttagaaagaggcccggcattattcatccgccgttcaaccggaatggctcccctaccctagtccgcgcttctacgatagattgagttgaatactgtcgaggagtgtatatgactgatcccacgaatgtccacgaaccggtgccgcaaagcgccaaactgaccgcccgcgagaagaagtggatcatctacgacgtcggcaactcggcattcgtgctgctgtccaccgccgtcatccccatttacgccaaatcgctgatgccggcggacggcgacatcgtgtccgcctggggctacgcgcaaaccattgcttccttggtcatcgcgctgctcatgccgttgctcggctccatcgccgacgtgcaaggcatgaaaatcaagttcttccttggcttcttcggcactggcgtggtcacctgctgcgcaatggccctgcccctgacctggctaccgttcctagtcgtctacattctggcgaccatcggcctcaacggctcgctaacgttctacgattcgatgctcatcgacgccacctcgaacgagcgcatggacaaggtctcctcgcatggctacggctggggctacatcggctccaccgtgccgttcatcttctgcatcgcgctgatcttcggcggcccgtcgctcttcgactggtccacggtggcttgcacgcgcgcctcgttcatcatcaccgccatctggtgggtggcattcaccatcccgctgcttaccagctaccgccaagtgcactatcgcgccacccgtgaccagctgggctcggccgtgcgcggcacgttcagcgaactggcgggcacgttcggcaaaatcgtgaagaacaagccgttgtggatgttcatgatcgcgttcttcttctacatcgatgccgtgaacacggtgatttcgatgagtacctcctacggtgccgagcttggcatcgactccacccagctggtggtggcactgctcgtcacgcagttcgtggccttcccctgcgcgattctctacggtcgtttggccggccggttcggctgcaaagtgatgatcacggcggcggtcgtggcatacatgtgcatcgtgttcttcgccgcgttcttcctgaagtcggccgtggagttctggattctggcgattctggtcggcatgttccagggcggcatccaggcgctctcccgctcgtactacggcaagatcatccccaaggatcacgccaacgagtactacggcttctacgatatcttcggcaagaccgcctcgatcatcggcaccttcctggtggccaccaccacgtccctgaccggcaacgcctcgctcggcgtgctctccatcgccgtcctgctcgtcgcggcactcgtcttcctgctcctgcaaaaggacccgacgcgggagtgatttgccggccctcggcaactctgtgccgagggcgacatctcgcagcatagaaatcctcgacatagggatgccgccgtttgaagtcggtatgtgacatgccgcccggaatcagcatcgccagcccgataatcacgcccacgcagatgcccaggaatgtcagaaaatcgttgagtggcgtcacgccgagaatggaattatcggaatcgaacaggttgccgatgccggctcccgcgataatcgccgcgacaccgccggcaatcagtagcgcgaatcggcagcggtgttcatcgtagccggtcagatcctgcggtaaggcagccacattagccagcgtgccgggacgtgatgaactggttccgtgcaacatttcgccgggcaatgcatttgcggagctcgggccattgatgccgtcaccgccggaccgcgctgattcaccgatgttcccatcagcatccttcatatacgcgggttccccggctccctccccggttacggttctggcagccgagccatggtcgccctccgctgcgccgcgcgcggccgcacccacgttcacgctcgcactcacatcgccaagtaccaggtcatcaagcgtgcaaccgaacaggtcgcagatcataagcagcttgtccatctcgggataggccttctcggattcccatttggagatggcctggcgcgagacgccgagcaacatggccagctgttcctggggcatgttgcgttgtgcgcgcaggtattgcaggttggcgcggaagctcatcggagtgtcccttcataggtaatgctcatcatgacatattcggccgatgccctcactatgccacggcaaaccagttccgcgccaccatcttcaggttgcatattcgcgcgcaaccacaggttgcatcggcggaatcccgccattctgccggctccgcggcattctagcccgcaccccgattggaccggcataatcggaatacatcgattatgaaaaaacgctcgcggccacatggccaacgagcgtgaatctcgggtgggcgatgtaggaatcgaacctacgaccccttcggtgtgaacgaagtgcgctagccgctgcgccaatcgcccgagcctgtgatgaaaaaaccggcaacattctgccggcgattcatcgagtgggcgatacaagattcgaacttgtgaccccttccgtgtcagggaagtgcgctaccactgcgccaaccgcccgggtcatcatccggtcgaatcaatcagcatgaatcaaccatccgagagcggacaacgggactcgaacccgcggtctcaaccttggcaaggttgcgctttaccaactaagctatgtccgcatgtgttaccttcacaggcaacaggtgacaaagatacgccaatctcaggaaaaagccaagcccccgcgtgtcccaccggttttccaacgattatcgagcgccgaagtgaagttcccgaactacgccgacgtgccgtccttcatggaatcaggcacggtatgggcttcatccctcaacgcgcgataatggcggtatgacgcaacgacaactgatgcgggccacagtcgaaacgcccatcggccggatgatgatggcctccgacggcgagggacttaccgaactctgtcttgaagactggtggtgggccaccgatcaccaagccgttctcgattcgaatcgcgaatccgatagtgaacccgacgtattccgcataacccgcgaatggctgaccgcctatttcgccggcgaacgccccggctcggatcaggtgccgcctttgcatcccgccggcacgccattccaacatgaagtgtggaatctggtggccgaaatcccctatggcatgacggtaagttacggcgaactcgccgccgaattggccgaacgacgcggcggcggccgcatggccgcgcaggcggtcggaggcgcagtgaagcgcaatccggttaccatcatcgtgccctgccaccgcgtagtcggctcgggccgcgcgtttggcggctacggcggccgactcgacatcaaggccgagttgcttgaactcgagggcgtggatctggcgcgcttcgatctgccgaacctttgacgggcccagcggtccgcctcgtcaaaaaggattgagtggttaaccctcccgccggcgggagatggcgcgtagcgccggagggtggtcggctggctggcatcgcaaccctgctacccgacaattttcgacaagccgacgggaatccttccacgaattgttcgccgtcggtgcagtcttgctcgatcgcgccggccaaaaccgtacaatccctacaatggaatgcatatggttaattgctgcgcgcagccgcacggccgcacgcgatcgcaagaccacgcagcccaaggggatatgcaatatcaacggaagcaggaggtgcgcatgaccggcattatcgattacgcgcacaccgaaacgcgctccttcgccgacttgccgttcaacgaaatcgacgccttgatcatctccacgctcatctatgaggatgtggccagtgtctgtccgacgttgatgctggatgagacgcggtcaggctcgttcgccgcacgcattcgcgctttcgaacccaagcatccactgatctggctgaagggtatctggcatcccgagcttgaatcggtaagccttgacgaggccaaccgcgagctgcatcgttcgccggaaacacatgccgacgacaagccgcacgaagcccaaatggtttcagtggtcaacccggacctgacccacgacctgttccaggccgcaggcgaaaacccccgctacgccaacgttcgcctgggcgcggtggtcgagcacatcaatcagggtgagcaaacccaattcgccgccgccaccttccaactgcccgacggccacaagcgccgaaagccgacctacaaaggcacgttggttatttccttccgcggcaccgatgattcgctcatcggatggaaggaagatttcaatatggctttccagtatccggtgccggcgcaacgttcagccagcgcctatctggatatggtggcgcgactgtgggagggtccgattattctggtcggccattccaagggaggcaatctggcgatttacgcggccatgaacgccgatcccaaggtgcgcaagcgcattcagcatgtctattcactggatggccccggtttcccgccggagattgtgaccagccccgcctaccgcaccatccagccgaaggtgacgaaaatcgtgccgagttcgtcgattgtgggcatgattttcgagaccccggagccttgccgcgtggtctcttccgattcggatggcatcatgcagcattccgccttcacctggctattggatggtgaccagttcatcaccgagccggatttgagttccagctcgcagttgtttaacgaggagctgaaccattggatcgccacgcttacgcccgaacagcgcgagcgtgcggtggatgcgctgttcaccgtgctgcacgccaacggcgccaccagcttcagcgaggtgatgagcaacttccccgcttcgattccggcgatgcttggcgcgtacgttgggctgacccccgcagaccggcgtcatttggttgaggccctggcgatactgttcaaggcgtccacggccaaacgcaagccgacgcccgccccggcttccgcaccaagttctgcgacctccaaagcaacagccgagatcccagcagaaactgcagcaggagcagatagcgcagctccggccagagccgatactgatgccgatgccggcaccacagcttcgccatcagcggaggacgcaactgaaatcgccgattagctcatagacatgtccacaaataatagttatactgcccaataagttattagacagcgtgaccatatcacgctggtgcatcaggaggaagagatgccacgtccacgccatgattccgaggtgctgcccgccaaagaacgcctcgagaacgctttctgggaattgctcgccgaccgcgactatcgcaagatcaccgttaccgacgtggtgcgtgaggctggcgtgaaccgtaattcgttctactatcacttctccagcctgcccgaattggccgattcagccatcctgcatcaggtcgaatcgattccgatcaaccgcacccccgatccgaacggcaatcccgaggaacaatggcgagaccgcgtcaccgccacgctctccgatccagagcagcgtcagcgcctcgaccacctggccctgttggcaggcccgcacagcacgcttgaactgaccgaatcgctgcgcgacttctgccgtctgcaaatgctcagcacattgcaacgcgaccccaagaaccttgacctgaaaaccgatctcatggtcgagttcaccgtgggcggcatgctcgccgtgctgcaacgttggcccgaattgagcgacaccatcgaaatcaaagacctgcttaaagaagatgtggccgtgctggccatgggcatatacctggccatgagccaaaaggacatgcttaattactggaatcgcatcttcgtgcacaatgcgcaggattcgaccgcccccggcatgccggtcgccgccacgcatgccgcgccatccaccatctcatcgtcgaacggccccgcaggattccccgggtacaccgcttgaccgaaaaccagcgagtctggattgtttccgccgcacgaacctcgcgtgaggtttctcacaaggcgcaatcagcctctcatgctggcgtttccaacccacgcacaggaagatggaagcatgagcgaaacatcgaacaagacccgtctggaacatgactgcatcggccagatggaggtgccggcgaacgtctactggggtattcacacccagcgcgctatcggcaacttcccggtctccggcatcaccgatagccaacatcccgagctgattcgcgcctatgccacggtcaagcgcgcctgcgccatcgccaatgaggaattaggcctgatcgacccagccaaggccgaggccattcgcgccgcctgcctagaaattgaggccggcaaactggccgatcagttcccggtcgatgtgatgcagggcggtgccggcacctcgtcgaacatgaacatgaacgaggtgatcgccaaccgtgcgttggaaatcgccggccgccagcgcggcgattacacatacatccatccgaacgacgacgtcaacaagtcgcagtccacgaacgacacctacccggccgcctgcaaactcgcgcttatcgacgcgatcgggccgctcgccgagtccaccaagaaactcgccaaggccttccacgatctggccgacaaacatatcaatgacgtgacgattggccgcacgcagctgcaggacgccgtaccaatgacctatggtcaggaatttcatgcgtttgccacgctgttgaagtctgatttggctgcattcgatcgcgtggtgccgctgctggcccagctcaacctcggtgccaccgccatcggtaccggcatttgcgcggatctgcgattccgcaagtccgctatcaagcatctggcgcaaatcaccgggctgccggtcaccgccgcgcccgatccggtggccgccatgacggatatgggcgcgtacgtggccacgtcggctgccatcaagagcctcgccgtgcacctgaagaaggccgccgacgatttgcgactgctcaattccgggccgcgctgcggtttcaacgatctcaacgtgccggctcgccaggccggatcgtcgatcatgccggccaaagtgaaccctgtgatccccgaatgcgtcaaccagtgctgcttcacgattttcggcatggacgtgactgtgaactgggctgtggccgagggacagttgcagctgaacgccttcgacccggtgatggtgcatgagctgctgaccggcatggcgttgctgacgcacgccatggagacgttccgcgtcaactgcgtggaaggcatcgaaatcaatgctgacctggggcgttcatacgcccagtcctcaccgtcgatttccgccgcgctcaaccactacatcggctacgagcacgcggccgacatcgccgccgaagccgtacataccggccgtaccgtgcgcgaggtggccggcgaacgcaccgacctgcccgccgagcagttggacgagattctcgatccgattcgactggcccgcggcctcggccagacctgccgcgaacgccaggagtagcggaatcgaccgtaggccgattccgctttctgccaccccgtctccacgacttcaccagaaacgaccgatacagtaggcgtatgactgaatatgcagaagacatcgcacgcgggtttcaggtgaacgccggcaaactcatctggctgaccattgtattggccatcgtatttgtggccgaccgcgtcatcagccgcgtgttgcgcaagattctggacaattctcagattcccagcgcctcgattttcgtgaacctcacgcgcgtgaccatctgggtcaccggcgcagcgatggtactgcagcccgtattcggcatcaatccgaccacacttatcaccgcccttggtgttggaggtgtggcgatctcgctgggtctgaaggatacaatcgccaacatcatcggcggcttcggcctgatgctgggccgcgtaatccaacccggcgatctggtgaccattcaaggcgtcacaggcaccgtgcacgacatcacctggcgtcagaccgtggtgcgcacccgttccggagacatgatggtcatccccaattcggtactcaatacggccgccctgaccaagctcacgccggtcagcgaaggcatggccacgcttgagttcacggccaaggcctccggcgacccgtctgcgatcagtcaggatattctcgaccgcgtaaccaaagccaccgccgacgtggcgctggagggtcagccgccattggtcaagttcaccggcttctccccttacggcatgaccggccaagtgcttgtgttcgcgcgcgagggtgtgctgccttccaccatcaaagatatggcggcgcgagccatcgccggttcgggcaccgaataccttgttgaagatggcggctcgtcaggcaatctgtgatatctcccggctcgcctctctgggtccggctatgacagtcatgcgaacagcatccaaccggtaagcatcacagtcaacagtaggtacgcgataacgccgggattggcataggcggtgcgtattttaagccccgcaggcaactcctctggcgcaagatagaactcccagctcttgcgcttggtgataagcagtacgataccggcaatgcagaggcccaacatcactgtgccgtacaacatcatgatgcccatgtcgcccatgttgccggcttcagccatacgcatgatttcggcctcgctgaccgtgccgtcgaggatgcggggatcgatctgttgtatcaccaatggggcgagcactgacccgttcaggttgatcagcatgtgcatagccaccgaataccgcagtcgggaggtgcgcgtgtatacatatccgaacatcagtcctaggccaaaggcgtagaagaactggaacacgttcatatggaatagcgcgaatgccaatgcggagaatatgattgcggtcttctctccgtaccggcgcaggcgggagataatctccttgcgaaaaatccattcttcgcaaaccggtgccaacaggcctatgaacaatgcgttcacccgccagtcgctgccaagaatcacgtcgttgatgcgattggtggcctgaccatcagtggctccggcagacaatatattgccaatcatattgcccaagaacattaccggaatgcacatgacgaaaatctgaatgaactcccccgccttcatggggtactgccgggtgcgaataaccggtacgcgagtgaaggccaacatactcagcggcatggccaccacatacagcggtccggaggaggcgagcagcacagcccaagcgggcacatcggtgccaagcagcgttcgtagtgcttcagtggccagaatattcagtccgatccagaacaccatcataatggcgagcgccgagccgattgtcgaaaaccggcgatgggccgtgaaccaccaatcgcgtggagattgttgcggctgctgcgattgctgaggtgcctgcggctgctgcgccggcggcattggttcgctcatacttatcccccatagttactggccgcaaacggaccgatcacacgtgcaatactcttcaagaatacggcacggcgtttcgattgcattgggaatgggggaggaaatcatcaatgggcaaggaatgatcaacgtcaatcattcccaatgccgagaaagtcccctactctgcaagattgctgtgggacggcacgcgataatcgcccaaaaatcgccgccgtcccacacacatcattgccgataagccattcgacgatcgtacagtcacaaaaacagaacagaaccgcacgatcatcgcaacgccattcagcaggcgagcgcggcgaccggacgcggggtgacaatcacgtcatcgcccaccgccagaccggccggcagctcgctggcgggcagctgcacggtggccttgagctgttcgcccttgttccagcgctggtattcgccggaggtgatgaccgtatccacgcgcaccaaggagccaaggaagtgaatgacctccacgcgggcgcgttcgccgacgtgcgaatcgctgctgccggccaaggccagcgtcaggttctccgggcgcacgagcacggccacggaatcgcccttggcggagccggcgagcagcggcacgcgctggccgaagaccacggcctcgtcgccattggatgcgccgggcaggcggttggtgagtccaatgaacgtggccacgtactcggtggcggggcgctggtacaggttctgcggggcggcgatctgctcgatcttgcccttgttcatcacaccgatgcggtcggccacgaccagcgcctcttcctgatcgtgggtcacgaagacggtggtggtgccggtggtgagttggatgcggcgaatctggtcgcgcagctggacgcgcaccttggcgtcgagggcggagagcggctcgtcgagcagtagcacgcgcggcttgacggccagcgcgcgggccagggccacgcgctgttgctggccgccggacatctgctgcgtgtacttcttggcctgatcggcaagtcccacgagctccagctgttccatggcgatcttgcggcgttctgccttgcccatgccgcgcacttcgaggccgaattccacgttctccagggcggtcatgtgcgggaaaagcgagtaggcctggaacaccatggccatctcgcgcttgttgaccggcacgccggtgacgtcttggccgccgaccatgatgcggccgccctggatgtcttcgaggccggcgagcgagcgcagcgcggtggacttgccgcagccggagccgccgagcagcacgaccatttcgccgggcttgatgtccaggttgaagtcgtcgagcgcgtgaacggtggagccggggtagatcttgacgacgtcgcgcatctggatggagccgccgccgcgcttgacgctgtctttgagcagggccttggcggccttggtcacgtccttgccgcgcacgccttcgagggtggcggtgggatcgttcttgaaggcgtcctcggcggcagcggacgtggtggcgggtgccgaaacagaagccgcggcatcggcaccggcatggcgacgggtgaaaatcgaattgctgttcatcaggttacttaccttcccttgacttgcgcattgcgtcggagatcaggtcgagcgcaacgaggagcaccgcaccgaagagcagagccagcagcgacatggcggtggagatttgagaattggactggccgagctggtagagcgcgacctgcaggttcatacggccgagcagcgaggcgacggtgtattcgcccagcaccacggcgatggagataaaggatgccgagagaatcgactgccataggttcgggatgatcaccttgaagaacaccttgggccaggaggcaccgagcgagcgggatgcctcgaccagcgtcttgacgtcgatggagttaagccccacggcgatcgcgcggaaggcgaacggcatcacgagaatcacgtaggcaaagcacagccagattgggttggtgctcagcacgtcggcggacagccagcggtagatcgggcccaaacccaccaccagcacgatggccgggatggtcagcggcagcgtggccacccattcgatcgcgcgctccaaaaccttggagcgaatatgcacgatgaccatggtgggcaccagcagcaccagcatgatcaccacggtgaccgcgctcagggccagcgaggtgccgatgccctgccacagcacggtcaggtcggcacccagcgactcgccgttgccggtgaaaatcgcgatccacggcgcggccgaccagcggccggacagcgggtgacgcagggtgaagatgagcatggccagcagcggcacgaacaggaacgccagggtgacgaacaggatcacgaatttgatgatgctctgtttacgcgcacgagcggcgcgcagctgcggcggcttggttgcggaagtttcggtcattgccaacgtccggccctcttttccacggcgtggctcaacagcatgacgatggccacgacgatgatcattgcgaatgccagcacctgggcaaagccctgctggttggggtccagttcgttgcgcatggcaccttggatcataagcggcaccagaatcgaacgctgggagaacagggccgcggcggtcgcgtatgcggagaacgcggaggcgaacagcagcaggaacgcggagatgaagcggggtgccagaatcgggcaggccacgcgcgtccagtactggaacgtgttgccaccgagggattcgcatgcctcgcgccactgtggacggatcgaatcgaccgcgggcaggaagatgatgatcatcagcggaatctggaagtagcagtagatggtcaccaggcccggcaacgaactgagccagttcgggttcacggtgtagccggtcagtgtcttgataagcatggtgccgataccgttgatgccgatggtggcgatgaacgcgaacgcgagcatcacgccgccgaactgagcaagcacggaggagatggcggagaccatacgacgcagcaggccgttcggcttggcaccaatgaccagtgcgtaggaagcgagcgcgcccaccgctgcgccgatcagagaggatgctaaagacaccagaatcgaggtgccgaatgcggcgatggtgttggcctcgaacatcttattgaagttcgcgagcgtgaagttgccgctgcgatcctggaatgcaccgacaatcacgatgacggtgggtgcgagcaggaagcaggcggtgtaggcgaagaacgggagcgtggtggcgagcgtgcccagctcctggcggtgcttggccatcgccgaggagagaggagaagcgggagtagcggacggacccgcagccttggcggcagcaggtccgttcgatgcaatgggtgcgattgcggcggtcatcggtctgtgcctcagttgccgatcgtcttgtcccagttgttctggagccactcggtgatgcgggtggagtcgtcgttggtgtaggagaccggctcgccttcgatggtgatggcgtccttcagagtggcctggtcgacggtgccgtcttccttcatggaatcgagcagcaccgggttggcgccgcccttgaaccacaggttctgggcgtcggcggtgtacaggtactcctcccacaggcgggcggcggccgggtgcggcgcgtccttgttgatggcctggttgtagtagctgacgacctgggccttcgggaaggtcttgtacttccagttcacgcccttgtccttgagctccttcttgtaggaggcctggttgtaggtccagtcgaagaccacgccggtctggccggagtcgatggtgccgttggtcacgtcgacggtggtcaggttgccggcttccttgagcttcttgaagtagtcaaggccgggctgcaggttgttgatgtcgccaccggcgagctggttggccatcaggtagccgttgaaggcggcgccagcctcggcgggcttgccgttgagggccacggtgccggcgaacttcgggtcgagcaggtcgtccagggagctgatgtcgccgtacttgtcggcgttccagcccacggacatgatgccggtgtagtcggcgtagtaggcgccgtcggcgtccttggcggtgtccgggatcttgtcccaggcctgcaccttgtacggggcgaagtagtcggtggaggtggcggcgatggcctggccgacatcgaagacgtcgggggcggcgtcggtgcccttgttggtcttggcggcgtcgagctcttccttggatgaggcgttcgggttgagctcggtgaccttgatctccgggtacttcttcttgaagctctcgatgacctcgccgtagttggaccagtcgtgcggaagggcgatgacgttcagcgcgccctcttccttggcggccttctcgaggtcttccatggtgccgaagtcggcgagggaggtggctttggcggacttttcgttcacggtgacggccttgccggtgctttcgccggtgccatcggaggaggcgttgctcgagccgcaggcggccatcgagaacgcgagcacggcggcgagggagccggccgcgatcttacgcaggttgttcataatgttccttttctcaacatcatccagacgacagtctggggagtcgggcttggtatgcgcggcattcgcgcggcccgtgaatccaagaaaagaaactatgcgcctaatctgtcctgacactggcgcgcaagtgaattgcgttcgccatttgctgtacgcctgttgaacttaggaaaacttggcatgaattactgacaggtatgggcgatgtgtcaatagcggaaccggcctgcggccgattccgcaccacacttacctcagcacgccctcaatcaatcgcgtgatgagttcggtgtagctcactccggtggcatcccaagccttgggatacatggaaatcggcgtgaagccgggcatggtgttgatttcgttgaccatcaccgtgccatcaggcgtcacgaaggtgtccacacggctcaagccggcaccatccacggccttgaacgcgcgacgggccacgtcacgcacgtcctcaagcacgctgaccggcagattggcaggcacttccacgtggctggcggaggcatccatgtacttggagtcgaaatcgtagaactggtcgtcgttctgatgatcgagcacgatttcgccgggccagctggcctcgggctcgtcaccggccttcgggcacagcacggcacattcgatttcgcgaccatcaatcccctgttcgacgagcaccttccagtcgtgctcgccggcggtggcgatggcggcggccagacgatcctgctgggtctcgcggtcatcggctttctcgactttggtcacaccgaagctggagcctgcgcgcgaaggcttgacaaacagcggataagtaagaccggcgtcctcgatctcggcaagcacatcggcggcggtgaagttgcgcgcatcgaccgtcacaccgggcgcggtgggaatgccggcggcatccagtaccaccttggtgtaatgcttatccatgcaggcggcggaagcaaacactccgcaccccacgtacggcacacccatcatttccagcaggccttgaaccgtaccatcctcgccataggggccgtgcagcaccggcagtaccgcgtccacatggccaagggaggtcagcacatggtgcatttccgggtcggacatgctgacgaagctggtgccgaagccggaatcggcggaattgatgtggctgggctcgccgatgaagaaaccgtcctgtccgcgagaggggtcaagcatcaccgggcgcgattccggggtgatctttacggtcggcagctcgccgccgtccaagttccagccacgcggatcttcgccattgatgatccacttgccgtccttggtgatgccgaccggaatcggctcgaaccgttcagtgtccatggcccccagcacaccggcagtggagatgcaggaaatcgaatgctcgtctgcacgcccaccatagagcaccacaacacgcttcttggccataaccatccttttgttgaaactacaaccgttttcaagcctatgctttgcaccgccaaccggaccgaaccgcgctcggaacgccgcgcacaagagacgcacaccagtctactcgtgcacgtcaacgacgtatacgccacgcgactttgcacgtacaacgtatacgccacgtatacgtcgcttctctcgttattcgccggtaacctcgtgaccgaacagtccggcaagcatctccgagcaggaaatgccttcgttcagcacgcggctcatctgatacgccaacggggtcggcacatcaagctgatcgccaagagccaccaccgcatccgtggtgggcacgccttcggccacaccgttgctgaccttggtggcctcttcgaccgtcaatcccttgccgagattcgcgccgaacgtatagttacgagacagcgaagagccacaggtggcgatgagatcgcccacaccggccaagccgaagaaggtcttgggatcggcgccagcggctacgcccagcgcggtcagttcggccagtccacgagtttcgatcatggctgcggtgttctcaccgtagccggcaccacgggccatgcccacggccagcgcggtcacgttcttcaggctgccgcacatttccaggccgatgacgtcggtggtcacgaacggcttgaaataggaggtggtgcatgcctcggccaccttcgtggcattatcgaggttcgtgcaagccaccacggtggcggcgggatgacgatcggcgatttccttggacaggttcggtccggaaatggcggcgaaccggtcggccggcaagtcaagggattcgcggacgacttcgtccatacgcttgttggtgccacgctcgatgcccttcatcaggctgacgacgatggcgtgatcgggaatcagtcccttgaattcgacgagtgccactcgcgcgaactgcgcggcgatggccacgactacgatgtccgcgttcttgacggcttcggcgcgatccccagtggcggtcatgttgtccggcaacttttcgacggacggcaggcgcacggcgttgtggtggtgatcgcgaatgccctcgacaatctgctgctccttggcccacatggtcaccgtgttgcctgcgtccgccagcacttggccgaaagcagtaccccatgctcctgcaccgagaaccgttatatttttacccatatcaaattcctaccttcgcttgtcgcgcaacttcatcggcacaatcttgtgccatgctactcgcctaggctccccgtacgggaaccggtgcggctacttctcagccgggaacgggccgccggcttcaggccaaggcttacgactcatactgcggtagtcccagtagccttcagcggggaactgctcgccacgaatttcctccagtactgtgttcatgcgtttgagcacgcgccacatcagctcgttcacggcctcggcaggcggctcttcaccccatgagtccatgtcggcaagcagatcggagtaatcgagcgcatggtcatagcacatcaccacgtttttgcgcggccatggccaccagtggttgatggaggcggcaccccacgtcaccgccgggtacagcggcacctgatgccccagtctgcgcgaggattcaagggcgatatatcccacgccctccttaatgctcatcacccactttttcgggtcgcgggtcacggtgccttccggccagaccgtcagcgggcggccggacgtcagaatatcaatcgaggtctcttcgatctgcttggccttgcccgaatgacgctgcaccggctgcatgccgaccaactggaaccacttgccgatcaatggccacttcgccatctcggccttggccatgtaacgggggcggcggcccatgtggaacaggctcatcattggcacgaacacatcaaacatggtgacatgactggcggcggtgatgaacggtccggtttccggcacctgttccaagccccaggccttggtcttgcagctggcgcggaacacaatggacacccctcccagcagtcgtttggtggccttgggattctgggcgttgatttccggctgattgggcgtgcgggggccggtcgggtaatactgtgtcgagtccacaagcgtgtggcggacggccagacgcttgacctgctcatcactcagcgggcttacggccgaacgcggcgacggttttcctttggatgccatggtctctattgtggcacggaccaccgcccaacgattccagcgcaacgttcccgggaacgtgccgcggaaccacacctcgcacccccgcccagcgaaacattccccggaatgcgtcgcacaatacgcggcagcccgtctgcacacaccatgcgcgcagacgggccgccggggaaacgttcgaatcactccaccgcgatggcgtcgatctccacgagcgcacccttgggaatcatgttgttgccaaaggccacgcgggcgggcttgacggagccgatgaacgcctcagcgtaacgtgcgtccacttccttgaagtcctcgacgttcttcaggtagatggtggcgcggcacacatgctcaatgccggtaccggcagtgtcgagaatgtgcttaatattcttcagcgcctgtgcagcctgctctccagcggtctcgcccgccagttcgccggtggccggatcaatgcccagctggccggatacgaacacgaagccattggccttcaccgcctgactgtatgcgcccagcgcggccggcgcctcggaagtggctacggcttccatcttttcgctcatattgtgctccttctcatcttgggggcgcccacctgctgcggccggcgccggtacacatcaccaccggctacgaccaatcgcacgatcagcaacgattggcaatgccgattacgtagcagtctactgagcaaagtcgcgtttagcgcgcatgatgctcggcatacggccatcaacagactattccttgctattccagacgattccagacgattcggctaccgttctcgccaaaccggacggtttttccacgacccaagcgagccggcatcaccggccttgccattgccgacaccagcaccagccttgcacgcgccgaatatgcaaaaggcttccggcggttagccgaaagccatgctggtgggcttgatggggatcgaacccacgaccttctgttccggagacagacgctctatccactgagctacaaacccgagcaacttctttactgtacaccacatcacgttgcatgcggcacatacgtcgccaaaataacgagaaaatcgccattatcggctctacaatggggttatgtcggaacctacagatgacttcgaatacgaacgccgcttcttctgccgcgaactgccggcggaatacgacgacggcgacgccccgaccctcatcattcagagctactacgtgcatgccgacaattacgccttgcgcgtgcggctggtctcgcgcaaggttcacgtcgacatgacgcccgacgtaaatccggtggccgtgctggacgaataccgcgaccggttctcggaagcatatgtcaccgtcaaaggtccgtccgtgggcggcacgcgctacgaagtcgagcgcgaaatcgatacgcgtatcgcggccgaactcatcaagcgcggcggctcggtaatcatcaagaaccggtattccgtgtggattgaggaagacggctggagcgtggatgtgttcggcgggccgaatgcgccgctcatcgtagccgaggccgaacgatccgggccggttaccaatctgacgattccgaaattctgcatcaccgaaatcaccgatcaggcgcgattcaataacgatggtctcgccaaccgtccgttctgtaagtgggcggatgatttcgaggaggagctggcgctggaggggccaaggttccagcagtatttcgggaagaatcggatggtttagggggggggagcaatcgagtacgctcgtgagctcccctcagtcatctacgacgacagcccctctcaaagaggggagccaaaaccacttagtacatgagggtggctaggcgacgacgggcgcgggtcagacgcgggtcggtgggttcggggatggcgaagtattcgagcagacgcttgcgaacctgctcgatatcggccttgtgcccggcggccaaaaagtccagcaaacggtcgaaagcgtcttgaatctggccaccgatcatgtcgatatcagccacagccaactgcgcttccacatcgtccggcgctgcggcggcagcggcacgcacgtcacgtacatcagcggacccggagcgggccagcaacagcgccttcgcacgttcgcgggcggccagtgcatcggacgggtcggattcgagcacgcgctcgtattcggcggcggcaccggcgtaatcgccctcctcggccaaacgatgggcttcggcatgctccggcggcacctgctcagcacccacgccggcaccggtggcaccagcgctcttggcggcatcggaatcaggatcacccgagtacggcgcggtaccgttcacaccagactgcgcggcggcctgaatgatcttcggaatcacctcgtcggtaagttgcttgagctcgtcgtcacccggaaggccctgcaacagtggcatcggacggccggcaatcaacgcgaacagtgcgggcgcgccctgcacctgcaacgcttgggcaatcgaaggattggacgagatatcgatacgggagagctgaatctggccgttcagggcgttcaccgcgtcgcccaacgcacgggccatcgggaacaggcggtcatcggtcggtatccacaggagcagcaggatcgggaaggtcgcagaagtctgcaccattgcctggaaggtgttttcggtggtgtcgatcacgtacccaccagcggcaggagcgccacccgcctggccgggctcggccttgacctgatgcttcagcgcctccaaatcgacggcgcccgccaatgagactcccggattgaactgctgctctgccataatgcctcccgattccacgcgattcgcgtacaacaacaatcacatttgctgacattgattgtaatgccgattcccaccacgtagggattcttccactacgcggtgaaattcccaccacgtagcaaaacgcccaccacgatgtgactcaaaacggcaccattgtgcgaaaggtaaaacttaccgacatcgtggtggatgaatcatatcgtggtggggcgttaaccgcgcggtgggcggcggcaacaactacagcgcttcgacctttaccggctgacggtcggcacccacggcggtgatttgctcaccggagcttgccaacggaatgtacaaggccaccacgttcacatacgtgaccttcatggtgctggtgtacttgtcgctattgaacagcgccttctcgtcgtcggaagccggctgcgattcgcggccatcccctgccttgcgagtccattcgccgttaatacggccaaccaccagatcaccggcaccgtctgcagcacgcatcacccacatctgttcaggcacagcggtgaatttttgctcctgcgtaccgttgttgcgttgcataccttcctgcaccttggccgtggtactggccagttcctggcgcagcaaatcgtctgcgaacttggaagcgtattggctcttggagccgttctgcagcacatcggcgtattgggccaaggcatcggcgggagcggccaccagcttctcatcctttgcggtgcccatctgcgagccaatagtcggaatctcgaacttcggcagcttggcgccctcaaacagtcgagccatagccatcagcttgtaattctgctgggcggattcctgatcgaagaccagcaaacgcttggactgctgatcttcggtggtggtcgtgatggtgaacaccgagcgaggccatccgtcgtccgtaggaatcaccgtctgggcgatgtccttgggaatggtcgcatattcggacataccgccgccacgctgattgatcgtggtctggctgatgcgaatgtccagctggggcccgcccataacggtcgcatacccatcgggattcttggcctgatcggcttcatcgatcgtcttgagaatcttcagacgaatcttcttctcctgcgcctcggtcaaatccggcgcaaccttggtggaggtatcagcagccggcgtcggcagttggccttcacaggcggtcaacggcacgaccaatgccatgcaggcgagggcggacacacacagtttgttccatcgcttgttcatcagctttcctcctgtccgtcatcggccgagtcgtctccggtattgacctcttgggccaagcgggagaagtaggcctgcagttcgtcaggggtgattaccgaagtcgattcgttatcgccggcgctgaggccgggctcagcgccgctttcggcaccggtctgctggtcggcgaccaggttacgcgaacttgggtcgatgataaccggtgtttcggtggcttcagattgcgaggattgcgaggacgcacggcccgaacgccgatgtgtggcgtgacggcgacgattacgtcgacttgcaccatccggcttcccggacactgcgatgctggcgggtgcctcttcctcgattacggcgcttgccatgccttccaccatgcgcttgcggcgcttatgcggcggcatggcgaacacggaggcgcacagtacggccagcacggccagcaatccgccggacagatagaacggcatcgcaaagtccggcacttcggagcgcacccagtgcagctgcaccttggcgttggtgacattttcgcccaaatccacaatggctaccgtcgaggcgccggtcttcttgctcttcagcgaaacggacccagtgccgcatttcacggcagtccacatatcggaatccttgaacgacaccgcgtcatcggcactggtaggcgctccctgactcgtgctgcttcccttctgggtgctcagctcgctccatgatgccaatccggtgatgcgggtataggacttctcggacgcgacccatccggcaacatccttggacgaacccaacgccacgcacgcctcgtcctgagaggatcccgagtccacggttatcgtggcattctgatccaacaaggtcagcacattcggatcagtgacgacataccgggagccgctcatggttgcggaagcggtgatttcagtggagggcttccacatcgtggcattcatgtaccccaacaccacagccgccacggccaatagtccgaagataggcgtcaccactccacgcatgattttggcatgacgggatggacgcttggcgcccttatccggtcttgtagtctgttcttcagcactcataactcaaccattctacaatcttcacctgtttattacctaggagcgcagaaaatcaaggtttaccagtagggtgatgtgtcatgcgtaagtctgttaagtctatgttatctcccctcggcaaggccgttgcccttgcctgctcgctggcgatgtgcgtgtcgctggctgcctgctccagttcgagctcggactcgaaatcctcttcttccgattcctcttcatcttccgactcttctgacaagaagggccaaattgccggcgtgaccgccaagggcaagctcggcgagaagccgaccatctcctttaatacgccgatgaccgtgtccgacggctcttatgtggtgctgcagaagggcgatggcgacgtgatcgaggagggcgaccgcgtctgcgcccaaggcatcgcgctcaacgttaaagacggaaccgagctcatggacacctggaccaagaacacgccggattgctcgctgaaggtggattccaagaccctctcctcgacctactacaaccagatcaagggtgccaagatcaacaccacgattggctttggcgtcaacgctcaggattcgtccgggtactcttacattctggcgatgacgtttgtgtccaagtccaaggacttggagaaggccactggcgaggaagtcaaggatgtgccggccaatctgccgaaggtgacgcgagccaaaaacggcgagccgtccatcgacatgaacggtcagggttcggttgattcgctgatctcgcagacgctgatcaagggtaacggcgccaagctgaccgacaagaacaccgtggtggtcaagtacaccggttggcttacgaatggcaagcagttcgattcgtcctgggatcgcgattccacaatcgacgccgatctgttcagcgattccagcggccagcatcaggttatcgagggctggcagaagggtctggtcggccagaccgtcggctctcaggttctgctggtgattccgccggatcaggcctatggagataaggagcaaggtccgattcccgccaactccacgttggccttcgtaatcgatattctcgccgcgtactaaaagatatagcaggggctccctctgatgagggagcccctgctatatctagaacagcctgagactgtcgtcctcggtgcctttcatatcgtcgtaatcgaggatgaggcaggtgaagccgcggtctttggccaagacctgggcttgcggcgtgatggtttgtgcggcgaagatgccgtgcaccggggccagcagcggatctcgattgagcagttcgcagtagcgagtcagctgctcgacgccatcaatgccgccgtgacgtttgatttccacagccacatgctcgccctcggcattcacggccataatatccactgggccaatggcggtcgggtattcgcgacgcaccagcttggctcccttgccgatacgctcgatttgctcggccagatagcgctgcagatggtcttccacgccatccttgatgagacccggatcttcgcccagatcataggtttggtcggaatagatatgctgcagcgtcacttcaagaatgtccgaacccttgtcggcgctgacacgtagcaccttttccggctcaccagcggcgacactttccggggaatgcgtcgcagaatcaccatccacagccccaccagcgacactttcccgggaatgttgcgcggatttggcggctgggtcgatctcacgaatcgtgcagggcgcggtcatccagttcagcggcttgtaggagcccaattcggagaaaatcaacaggctggaatcggccttgatcagcaatacgcgcttggccaggggcagtgaggcgttgaggcggcccgaatactcggccgaacagtcggcaacaataactcgcataggccaccactgtagcgcaacacatggcatacatagcaaaaggggctctctggaaaaccagagagccccttaaggagttggttcaggtcactcggcggtgccggagtactggacgtcgtggccgcgctcgaccgccacggtgagtttgttcgagtcgaaggaaatgaatccgtcggtcacctcgaacatgtggcgatcgccatcgggctcaaccacggtgagcgtaccctgcttgatcaccgtgagcacaggctcatggtcgggcaggatgcccatgccgccctcagaggcgggaatggtcacgctcgtcgcctcgccgtgccacacagggtggtcagcggcgacgatgttgaccttcatcgtggttttttccgcagccatcacgcacccagttccttctgcatgttgtgccacttctcttcgaggtcgtcgatgccgccgatgccggagaacgcctgctccgggacgtcgtcgtacacgccgtcgcagatgcgggtgaaggcttcgatggtctcgtcggccggcacgtaggagccggggcgaccggtgaacttctcagccacatagaagttctggccgaggaactgctcgatcttacgagcacggttcacggtggtcttgtcctcttcgccgagctcgtcgataccgatcagggcgatgatgtcctgcagctccttgttacgctgcagaatcgccttgacgcggttggcgcagtcgtagtgagcctggcccacgtaacgcggatcgaggattcgcgaggtggagctcagcgggtccacagccgggtagatacccttggaggcaatgtcacgagaaagctcggtggttgcatccaagtgggcgaaggtcgtggccggggccgggtcggtgtaatcatcggccggcacgtaaatggcctgcaacgaggtgatcgagtgaccacgggtcgaggtgatgcgctcctggagggaacccatctcatcggccaggttcggctggtaccccacggcggaaggcatacgacccagcagggtggacacctcggaaccggcctgggtgaagcggaagatgttgtcgatgaacagcagcacgtcctggttctgcacgtcacggaagtactctgccatggtcagtgcggtcagcgggacacgcagacgggtacccggctgctcatccatctggccgaagaccagtgcggtcttctcaagcacgccggcctcggccatttcgccgatcagatcgttaccctcacgggtacgctcgccgacgccagcgaacacggacacaccaccgtggttctgggccacgcgctgaatcatttcctgaatcagcacggtcttgcccacacctgcaccaccgaacagaccgatcttgccgccctgcacgtacggggtcagcagatcgatgaccttgatgcccgtttcgaacatctgggtcttggactccagctgatcgaaggccggcgggttgcggtggataggccaacgctcggagacggtgatggtctcatccggcttcttgttgaggatgttaccggacacgtcgaagacgtggcccttggtcacgtcgccgaccggcacggagatcggggcgccggtgtcggagacggaggcaccacgaaccaggccgtcggtgggcttcagagcgacgcaacggaccgtggaatcaccgaggtgctgttcgacctcgagggtgatctcggtctccttcgcctcgccttcttccttggcgctggtgttgacgatcgttactttcagggcgttgtagatgtcgggcagatgacccaccgggaattcaacgtcgataaccgagccctggacgcgggtgacgcgaccgttggtaggctcggccgcagtggtctggttgtcagccatatgcgttcctactcttccttcttggtcagcgcgtcagcgctgccgatgatttcggtaagttcctgggtgatcgaggcctggcgggaagcgttgagcttgcgcgtaaggtcgtcgatcaggtttcgtgcgttgtcggttgccgtgtgcatggcgttctggcggcttgcggtttccgacgcggccgcggtcagcaggcactcgtggatacgggactgaatgtacttcggcagaatcgcatccagtaccttttcgaggctgggctcgaaagtgtacagcggagcgacatccgcagtagccggtgcctcttcatcaggatcgggcaccttggtctcgtttttcacgatttcgaccggcagcatgcgcagcacgcgcaccttctgcaccaccatgttgatgaactcggtgtagacgatgtagagttcggaaactccacccttctcagccggcttcatgtaggcgtccatcaaggtgttggagatcgtttcagcaatttccacgccgggctggtcggtgtcgccttcccacgtcgccgcgatgtcacgattacggtacttgtagtacgtcgaaccgcgacgcccgtacacgaacagctccggctgcttgcctgccgcatcgaggcgggacagcagcgactccgtttcacggataatcgaagaggtgtacgggccggccataccacgatccgaggtgagggcgagaacagccacgcgcgggttcttctcgtccttcaccgcgatcggatgcgtgatatgggtgtgggccaccaacgcttgcacggcatcgaaaatcgcatcggtgtacggcttcgcgttcagggccacatcacgggccttggcgatatgcgaagacgcgatcatctcctgagcgttgaagatcttcgccaacgactcggtggagcggatgcgtgatttcaatgcgagttgcgagcccatggcttacttttctcccgccacgatcttttcctgatcgaccggcgcggccttgtcaacgtccggcttcttctcgaccagcggcttgccggcggaagagacgaacgtcgaacggaactcgtccacggccttatcgagggcagcctcggtgtcggcggtgaattcctcggtctcgcgaatggtcttgaggatatcggtgttgtggtcgatgtagtccagcagtccctgctcgaacggaaggacgtccttcaggtcgaggtcgtcgagcttgccgtgggtgccggtccatacggacacgacttcctgttccggcgagtacgggtggaactgcggctgcttcaacagctcggtcaggtgggcaccacgggtcagctgggccttggaagccgcatccagatcggaggcgaacatggcgaaggattccagcgaacggtactgtgccagggagatcttcagcgtaccggagaccttcttcagagccttggtctgtgcggcgccaccgactcgagagacggagataccgacgtccacggcggggcgctggttggcgttgaacagatcggactgcaggaagatctggccgtcagtgatggagatcacgttggtcgggatgtaggcggacacatcgttcgccttggtctcgacgatcggcagacccgtcatcgaaccgccgcccaggtcatcggagaccttggcgcaacgttcgagcaggcgggagtgcaggtagaacacatcacccgggtaggcttcacgccccggcgggcggcgcagcagcagggaaatcgaacgataggcctctgcctgcttggacaagtcatcgaagacgatgagcacatgcttgccgttgtacatccagtgctggccgatggccgagccggtgtacggggcgatgtacttgaagccagcggaatcggctgccggggaggccacgatggtggtgtactccatggcgccggcgtcttccaggctctgcttcaccgaggcgatggtggagcccttctggccgatggccacgtagatgcagcggacctgcttcttcgggtcgccggattcccagttggccttctggttgatgatggtatcgatcgcgatggcggtcttaccggtctggcggtcgccgatgatgagctggcgctggccgcggccgatcggggtcatcgcgtcgatggccttgaggccggtggacagcggctcgtcgaccgggtggcggtgcatcacgtcgggggcctgggcttcgaggatacgacgaccctcaatgccctggatctcgccgaggccgtcgagcggcttgcccagcgggtccacgacgcggccgagatagccgtcgccgacgggcacggaaagcacttcgccggtgcgtcgcacttcctggccttcctcaattccagcgaaatcgccgaggatcaccacgccgatctcacgggcgtcaaggttgaacgccaggccgagcgtgccgtcttcgaacgtcagcagctcattggccatgcaaccaggcaatcccgtcacgtgtgcaatgccgtcaccggccgtggcgacatagcccacttcctgggtgggggtgtcgctcggcttgtacgacgacacgaagtcgtcgagggccttgcgaatcgaggcgggatcgatggtcagttctgccatgatcactccttctattggttattgttcagtcaagtctttgcttgtgtgtggtgttggacggattggctcggccggtcaggccggagtcgcctccgtctgcaccttgcgatgcaagttctgcagctgtgcgaccacggtgttgtccgtgacttcgtcgcccacctggatgcgcatgccacccagcacggtcgggtcgaccaccgagttgatgtgcacctgacggcccaccttggcggagtagacctcgaccagtcgcttgatctgctccttcttcagcggggtggcggtggtcacggtgaccatcgactcgcccatgtggcgggagaacttgttgatcagccactggatggtctccaagtagcggcggcggcgcaggttgcaagtggcgtgttcggcgagcctcatggtgaccttgttcagggtcttgccagagaacacctcgcggaacagcttcacacgggcctcgctggtggcctggtagtcgtacagcttggcgcgtacgaccggcaggttcagcagtgcggaatgcagctcggacagctcgatggatacctgcagcgtggcgtcagtggcgtccgcgtagtacatcatggcgtccacgccgaagtcttccactgcgttggcgatgtcgcgcgcacggctccaacggcgggagaccaagtcagtcatgatctccatggtcatcggatgcgcgttgtcaccgagcagttccttcaggacggccaccttgtcggcaaccgggcgggacgggtcggtcagtgcgcgctccagctgaatgctgtcatcgagcaccttggtgatcgtgaacagttcgttgccgatccgccacgcgtcctcacgggtgtcgcgcagtttcggggccagcgaatcacgcgactcgcggtctgcaatacgtgatgcctctcctcgcatggtcacctccctttctggttacggatggtcacggtcacttcttggcgcccaggtcgtcgatcatcgaatcgatcatcgaggactgcacgtcgttgtcttccagcttggcaccgaggatcttgccggccagggcggtggcaagtgcgccgacctcgcccttgagcgagacgatggcctgctggtgctgggattcgatcgagcgctgtgcggatgcggtgatctgggccgcatcggactcggcgcgggaacgagcgtcggcgatgatgtgggacgcttccgcacgggcgtcgtcgcgaatcttggcggcgtccacacgggcggtgctcagctgggcctcatacttggccttggcctcgtcggcgtccttcctagcctgctccgccttggcgatgttgccctgaatcttggcggcgcgctcgtcgaagatcgcattgaacttcggcatgaagaacttgtagaagaacaccgcaacgatgacaagaatgatcagcgaccatacgatgtcataaacctcaggaatgaacaggtcaatcccgcttgctgcttgtgtcatcaagccctcctttcagtgatggacataatcggttttcgtctgttgatctgcgcagatcagatgatcagggcagcgacgaagccgatcagtgccagcacctcgaccagagccaggccgatgaacatgatggtctggatcttgccggacatctcaggctgacgagcggtggattccatggccttgccgaagaggatgcccagaccaatgccagggccaagagtaccgataccgtaaccgatgacggacaggttgccggcgacctctgcgagggtgatgatatccattgtgtttcctttctaacgtacttggcgacgttataaatcttggggtttggtcggtctgcgattttcccagaccggggaccggaagcggcgggttagtcgcccgtcactcttccgggaagctcaggttgatgtacacggtggaaagaatcgcgaagacgtaggcttgcaggaaggcgacgaacgcctcgaagcaggtcatggcgaaaccaccggcgaaccacagcgcacccaccgggatgccctgcagcttgttgaccgcgtcaaccatccagaactgcgcgaaggccaggcaagtggcgaccataaggtggccggaaaccatgttggcgaacagacggatggtcagggaggccgggcggatgatcaacagctcaagcaggttgatcggagccagcaggaaatagaccggccacggcacaccgggggtgaacagctcgtggcgcagatagtggccgaggccctgcgagcggatggcggcgatccagtactggatcagtgtccagacagcgaacacgagcggcatgaccaccgtggcgttggccgccatgttcatacctggaatgatgccgcacaggttgaaaatgaagatcgtgaagaacagggtggtgatcatcggcacgtagcgcttgccacgggcctcacccatcacgtcatacacgaccttgtcgcgcacgaagtcgagaccgtactcgactacgccctgccaacggccggggatgagcttggcgcgctttgcggtcacgccgagcaccaccaacagcacgatggttgccacgatacgaatcaaaataatgcggttgatggcaaacggagttccctggaacagaatctccggaggaaggaagtcatcaaccgagggcagatgagcgcctgcctcgtcagccaacagcaatcctgcgctgagcgaaccgaccatatcacgcctcctgcttcttcaatgtcaggtgtcagtttaaacccaccgggcaggcaaatgtgacgtgctcgttactttcgtcttttttttgtctcctcggtgtggagtctgccgggcatggacacggagtctgcgctgggcattcggctccgaatgactgaagagtgattatttgcctgcgtctagacaatgtcaatattataccggcgagtctcctgaaatccctactgctgcaaggttttcccgggcgtttcgcgaacgttgtgcactattggtcgcattacgcggatgtgtggcattacgttcatcaagccgtccacatcgtggacgaacaaccgtccacgctacgaacgcaacctccaacagtagctccctctgatgggccgagccgtgaaggagaagcaaaggagctccccgtcgaggggagctgtcgtcgtaggcgactgaggggagatcgtaggctcagccctgaatcaccccatacccgtcatgcacaaacggcttgaaatcatcctggcgcggcccgcccggctcatgccgaatcgaacgatcagtaccgagcttcttctcagccctgagctgcggcacctcggtcaggtcatacggcgtggtctggtacacccagttgagccagttgcgccacagcagattggcgtgggcgcgccaggcgaacaacggttccagcttcggatcgtcatgcgggaagtagttcttcgggaagggcacgttggtcatgcccttggccatatcgcgctcgtattcttcggcgagcgtgtacttgccgtactcccaatggccgagcgcgaacacttcggagaagtcacgcgtggcgatcaggcccgggccggactgcggcccccaagtcaagatctgaaggtcatggttggcacgtacctcgttttcgttcacgccggcgaggcgggagtgcggctgcagatcaatctcgtcgaagccattggtcaggaagcagtattcatcctgcaggtactgcgggaatacgccgaaaatcttctcggggtaatccaccttgtggatgccgtagcggtagtacagtgcgcccatcgcaccccagcacaggtacatggtggagaacacatgggtggaggcccagtcgagaatcgtcttgaactcgtcccagtagtccacatcttcgaacggcatatgctctacaggcgcgccggtgaccacaaaaccgtcgtaatagttgtctttgaacgcatcgaggttttcgtagaacttgacgagatgatcggcggaaacgtgcgtggcctcatgcgtggaggtcttcatgaagtcgatttcgacctgcagcggcgacttggaaatcagacgcagcagctgtgtttcagtctcgattttcttaggcatcaagttcaggatcaccagtttgagcgggcggacgcgctgacgctccgcctcgggcttctccagagcgaagatgcgctccgaatcgaggatatctctggccggcaggccactggggatcttgataggcatgttcctattatgtcaatattcgggataacggttcagggcattcctataacggccatttatggcgcgttattaccccgactccgactccgccccaaacccctcgctgcgtgagccaattcacgttttaaaaccgcgggaagatgacgcgacacgccgatgttgactttctggaatctgcacctattgtagatagagctgtctgagagacaagccgacgcggggtggagcagctcggtagctcgctgggctcataacccagaggtccatggttcaaatccatgccccgctaccaattgaccgccgttcccggaatcatccgggacggcggttttttgcatttgcaggacttttgccgccgtcaaattaacgtcagtaagatcgttaagcgttacgccaagataattcgcaactttcaccatgtcgtcaaaggtccacggatagccaatcttgagcatgcgcgagaacgactgcggaaacttgccaagaatcgccgccacatccttcttggggatatgacggacagaaataatcatgttgatgttcgttatagccacatcgccggccgccatgctggcggtgctgggcattgttattgttgctgtcataggttccatattaaacacagttgtttaactttgcaacacgccgagaattgccaaacatgcacattgggctgtaatacttaacatgtgagtttagctaagaacgtcagagttacagcaaatgtgcgatacttactccggcaaaaccgagttacgcagcgcgaccttgctgccgctctcggtatgcatgagcagaccttttccaacaaaatgtgcggcacgcgaccgttcaccttgcgcgacttgacccgcattgctgatttcttcgatgtgagcgtcgatttccttcttggtcgttctgattatgcgaaaccgttggaggtggcgtgatgtttggcttcgtttcgttgggtgtttcttttgcgtccttggttatttcctgcgccgcgctttactggtcccgcatggcacgaatcgaggccgctggggccgtggagcgtagtcgttacgctttggagtcctcgcgcaagcatgtggggcttccctacgaccacaagatcgttcacgattgggagttaagaacacagttcggctttgctccgcaaatcaaggatgattggactcgtcgtaaggattccgacggcgtggctgattccgacgacgcttttgaggttttttcggacgggacgtatcggattgttcctaactcaggagtcttctctgttctgaagcccgttttctgtcgagagcatggaacctgcgatgacccagcctgtccctatgccatctgcgcaggcgttcaaagggtccgcacttcattggttctatgccccagatcgggaattgcgtatatcgacaccggtggagacgggttggagatgatacccaatgcactccaagctctagcttcgtcagatcgctcgactggtccgggcgaggattctgcggtggcgcgatcgtgatgaagaatcgcatggtctcgcctgtaagctccggcagtcttccgcagtcgttcatgacccactcgctttgcttgcccagaaccgtttcgccgatttgccggcagtcccatagtccggcatcgcagttcacgcctatcgctttgacgttgaaagctctgccgtctccgcagttcacgaggtatccgacgatcggagggtcgatgccggccttgctgaagtccgggcgcaggagtttgtcgccttcgagcatggcgaagagcggcgcggcttcggccctccatctccagccgcgcgcgaatgtcaacagcgacaccatgagcccgaaggcggctatgacaacggttatccaagtttgcacggtgaggccgagaaacgttatttgcgcgaggtctacgcccattgattcttccttcctccgtcatctgcgacggttggttttttgtgcgattcccagcttacgcatccgggggaaggaacctttttccaaccgttcgaccgatggaggttttgcagatgattgcgtatgtggttcgttgtgacgtgtgcgcggccgaggcgttcgtgccgttgaatcaggacccggatatggccatgtcggctcgtgggtggcgtatgaggccgcactcgaaggtgtgcccggattgcgttttcgcgctcgaggggccgaagattccaccgagcatggcggaggtgcgctgatgtcggtgtttgatcctgagtgcagcgggaaccgtttcagtgcggagttcaggctgaccggtgatggcggaagtccgtatgagttcggtatccgtttcagtgtggatggtgattatttcgcggttgatggcctgtcgatgggtgacatggtgcatatcaaccgcgagttcgccagggttatcagggaggcgaagcatgcacgggttgtataaacgttttctcgtgttctgcgcggtgttcgtgggtttgatgttcgcggtggtgggtttctgggcactgctgggtgtgacgtgcctgtgcgcaggcatggtgctggtcgcggcgtcgccgttgctgttggttggcttcggagtgtgtctcgcggccgtgaatcttggcgatttgctgaaggaagaatgatgccgaacggtgaactgggatatgtgttcaagagcgcggtgacggccaatggttgcctgatgctgtgcatcacgccgcacgcgcggcgtcgcgacttccacagcaaggtgtacgtgctcacggccgacgaggtgcgcgcgttgatcgaggcgctggccgtgatgccggacggtcccgagtagttctaggtatctttagacgcctctaggcgttcgtatgcgtgcccgacgctatcgggtcactgagaatggaatggccgtgatggcgcgtatggctacgcctagccctacctatgccccgctgtggtggcggggaggccggccgcattgcaactgcggtacttgcgagactaagaggttgccaccgaccctatccagccgctggtaaaggcggaatcgggcagcactaccacgcgattgtgtggggctggatttggggaccattcccggcaggcttcggcctgctcttgcaatcgacggccgaccgaccgaaagcgagacccatttgaggattctcggccgagatttcgcgttgcgcgtctcggccgagaatcttcgggtcttgacctctccagcctcactcccaaaagggacatgagaaaccaacgtaaggggattacggattatgagcagagcaacgttcgagatgaatctgaaggacgcgggtatccgactgcttccgaagctcaacgagttcatcgaatcacggaagaccacggaatcgtttctggtgaccatcgagcaaatcgcgcgttgggccggattgaccaggcgtaacgggcgcatcgacgacaatcaggcgttccatctgatgcagttggcgcaatgccccgtctctaagacccgcaagtacggaatgcgctgctgggatgcgcgcgaggccatgcaggcgttggcccggtggaccggctcgtgggcttgggtggtggactgatggcgcgcacgaaaccgagccttgccgaggcgttgagcccgtggagcgctccgcatgacgcggccgacctgttggagggcttccggctctccatcaacaccttggccgaggaacagcacactgggcttcctgattcgccgcgcgtgctgaacgccctgcgtctgtgcaagggcaccgaactggccgcgttgggaggcgactggccggcaatgggagtgcggcgcgtcggcggcgcgtggacgctggacgcacgccagttcgacctgtgggcgcaggggcagataagcgtattcaggcgcagggccgaggcggctcagccgaccgtgcagatgcagtctcgcatgagtttgatctaggagggatgatggggtatttgacgacggtcgaggtggccgaactgttgaacgtgaagccggatacggtgcgcaagtggcggcaggaagtgggcaaggggccgcgttggacgcgctggccgggcacgaggctggtccggtacgagagcgccgaggtggaaaggtggcgtcatgccgggcagaagggataggcaacgtgtgccgccagtcgtctcggccgaggtcatcgagcggtggggcaacgactgctggctggggatgcccggctgcacgaagcacagcgacaccacggaccacatcgtgccgcatatcgcgggcgggcccaccgtaccggcgaaccttcgccgcgcgtgcaagcactgcaactcgcttcggggcgaccggacgcttaacgggtatggcgcgcttatccatgcggtcatcggccctccggctggcggtaagtcaacgtacgttgacatgcaccggcaaccgggggccgtggtgctggacttcgacgcactggccaaggccatgatgccgggctcggacgccgagcacgtcaccgtggaatgggtgaggcgtatggcatcgggggcatggtacggggcctaccggcacatggtgcgcgtcacggaaccggtggagctgtggctggtgaagaccctgcccttcacgccacgaagccctcggctgctggacgagtggatagccctggactatgacatcacggtctgcgaccccggcaagcaggaggtgatggacaggctcagggcgcgaggcatggacgttggtaaacggttgcaggccggcgtgctccagtggtaccggcagggcatcactcagaccggcatcgatgtgaggctcaaggctcgcaggtcaaggctcgcggccctcgggctcgccaacggacccgatgccggcctgatcggctcgcaaccggcgcggccggcatggtgaccgtcgtttttttgagaagcgaagcgaaggaacaccccgcgcccaccgtttttggttccccacaaaacaataaaaaaagcccgaaaatagggacggcaccccaaaatcaggctatgaaaatgcttcaaacagggaatatacaccattactgtgattggagcaatttctcatggcaggtttcgagggcttggagaacgcgggactgatcgaaggaccgcaggaaaaggcgacacgggagttcatcaaggagtaccgggacggcaaggccgagaacccgatggccgacttcatctattcatcgatgctgagcatcgcccgcaacatcgacgtgcagaacgcgcgcggccgcgagataagccgcaacatgaccagtcttctgggctatatccaacagctcgagggcatgtacgacacgatggacgaagaccccgaaatcaccgaactgctgggcaaggcggcgcgatgaaccacgaccagccgccatccttgcaaccgcgccacgcgaccgcgcgtaaccaggaacgcgccaccgacggcgctctcgtggccaggttcagcgaactgctgggcaagccactcatcccgtggcaacgccaggtcatcgatgtcatcagcgagatcgacccgtccaccggcacctactggtacgacgaactcgtgctcaccgtccaacgacaggcgggcaagaccaccatcaccaaaagctacgacgtgcgcaactcgttgtgggggccggaccgcaagacctggtatctcgcccagaccggcaaggacgccaacgaccagtttcgtgatttcgtcaaatcatggcgcaaatcgagactgcggaaactcgccaaaccaccccgcctgagcaacggcagcatggccttggagttcaagaacggcagccagctgaggccgggcggcgcgaccgaggcggccggccacggcgtgcagggcgacctgatcaacgtggacgaggtatggagcctgtcaaaacaacaggcgaagaacctcaaggacggtttcatccccacgaccaccacgcgcctgaagctcaccggcgtgagaccgcagatatggtggacgagcacggagggcaacgccagcagcgagtatttcaacgaccgcctggacaggctgagggccggcgatatccccgaccgtaccgcgttctttgatttcggcataccgttcgatgccgacccggaggatctcgaaaccatatggcgatatcacccgggggccggttatttgttcgatttcgaccaattggccgggttccgccgtcagttcgacgacgacgcggagggttgggcgagggcgttcggcaacatccgcgacgccggcagcacagacagggccatcgactccctgctgtgggccgacaccatggacgagccggtcacgccggagcatgggatgcgcgtgtgcttcggcgtgggcgtgcccctggacgcgacccacacggtgatagccgcctgcatcggcgttggcgggggacggccgccgctcgtgcagatcgttgacgacctgccgggcaccggcgaatcgcccgcgagactgctggccctccaaaacgactacagggcaccggtatgcatcgacccgcgcggcccctccgccgccttggccgatgtgctcgccaatgcccatgacccgcacacgttcgagcgcgtctaccggctgtcggacatgagggcggcagatgcggtgacggccccgcaatcgttcgtaagcgcgttggagcaacataatctcacgcacgcctcggacaggctggccgacgagcaggtgtgcagggccacgaaacgcaagagcggcgacgcatggctgtggaaccgttcggccggcgacgtgagcgcgttggaggccatgacgatggcctactggggatacatgcacctgcccgaatgggaggccgacgatatccaggtcttctgacgacatgccgctggatgccgcccaatgccgctggatgccgcatcgtcatggacagaaccggccgcgccggtgcatggttggggccatgaatctcgtggaacgcctgctcaaccggatggcaccggcctaccgcgcggccaccggaccggaaggcccgctgacgaccccgccggcccgtaccccggccgaccgcgacgtgctgcactacagcaccgtgtttcgcgccgtccagattctggagaccagcatcgcggggctgccccttcgtcagttgcgcgatggcgtggagatcgtgccccaactgccgataatctcccgccccgaccccaaccgtcatcgcagcgagttcgtccgtctgaccgtgggcgacatggtggtgcggggcgaggcgttctggctgaaattgagaggcctggacggcaccgtgaaaggtctgcgcgtgctgcccgcctcgttggtgagcatcacggacctgagcggcgaccccgcgaacccgtggaagcaatacgggtacatgggcaacgtctaccgcgatgaagatatccttcacctgccgttcgtgagcattcccggcagactgcatggactgggacccgtggaggccggccgtgcggaaatcaacggtgccatggacgcgagggatgcgaaggccatgtggttcgacgaacccgcccagccgtccggcatcctctccacggacaagatgatcaacgacgaaatcgccaccaacaccaagcaacggttcgagaagaacatgaagggcgtcaaggtcatcggcgggggcatgacctacacgccgttgctgctcagcccgtccgacatgcagtatctggaaacccagaaattcgacaccaccctgctttcccgactgttcggcatcccgcccaagctcatgctcgccgaatccggttcgagcctgacctacagcaacgtggaacaggaatggagccagttcgctgacttcaccctcaacgcctacgtgcagccgatgaaggacgcgctgagcatggtgataccacgcggccagaccatcgatttcggctgggactcgttccgccgttcggacacgaaaacccgcatggagacctacaagatcgctatcgaggccggcgtgatgaccgtggacgaagcccgctcaagggagaacatgcccccgctcggaggctcacaggaaggaacaaacaccgatgaagcatgaaatcggattcaaggggcgaatgctcgcccgctccgaggacgacggtgacgggcgcaccatcgagggcgtggccgtgccgttcggcgacgtcatcgacgtgtggggcgaacgcgagaccttcgaccccgacaccgtcttcgaggggctcgactccgcgaagctctactaccagcacgacacccttatcggctccatcacatccggcgagaaccgcgaggacggcctgcacatcaccgcgcgcatcgcggacacccagcaggggcgcgacgccgtggccctgctggacgagggggcccttgattcgctcagtgtgggcttcgttcccatcgaggaccggaaggacaaggacggcgtgacccatcgcaggaaggtccggctcttggagaccagcctcgtgagctggccggcctatgaaaacgcgaaactcaccaaccatcgcaacaacaatcaggaggaaaccccaatgaccgaacaggccgagaaatggaccgaagccctggccaagctcaccaaccgccaggacgaacaggccgagattctgcgcggcatcgagaccacgctgaccagccgtctcaatcagcagcgcggcacgtcgccgctgggcgaataccacagccagggcgaactgctcaaggcgctggtgtccgacgacaccggcaaggccgaagcggctcgggaagcctacaatgcgctgttgtcccgtgactacaccggttccgtagtggcgggcgccgacccgcaacccacctggatcgccgaccgcatccgcattctggagcagaaacgcaagatcgccacgctgctcacccatcagcccctgccggcggagggaatgagcatgagctatctcgtgctcaaatccgacacgcacaccgtcgccaagcaggcgaaggaaggcgactcgctgcccttcggcaaggtcacgttcggcgacgaatccgccgtcatcgacacatacggcggctacggcgacctgagccgccagcgcatcgaacgcatgcccgtgggggacgtgagcttcgagatgcgttgcctgaccgcggcctacgcccgcgccaccgagaacgcggcccgaaccgcgctctacggttccatcgaagccattggcgacacggacaaactggccgtgggaaagaccgccgatgctctgaagcccaacgactggatcgatctcatcatcgacgcatcggccaagttcgacgacgtgaacgcaaccctggactacatcggcgtgagcccggacgtgttcaaggccatcgcgcacctgaccgacgagggcaaccgtttcctggacgtctccggccaaggctcggacacgctcggctcgctcgacccggcatcaatcagcggccgactgctccgccaggacgtgcgtatgctcgatggcgcgccgaacggcaccgtggtgttcatggacaagagcgccgtgaccatgtgggagtccaacggctccccgttccagctccaggccgacaacatcatcaacctgacccgccagttcagcgtctacggctacgccgcgttcggcaccacgttcaagcagggcatcctgcccgtcaagttcgccgccgcctgaccatgagcgacaccgaacaggacccgctcaccagcagactggcctatctcgccgggaccatggacgatgacgacaggcccacgctatcggacatgctgaagaccgcgcgcgcatacctcgccccacacatcgccggctacacactggcccaaccactgctcgatgacgtggtgcttggcatctccctcgatctatggcaggcgaaggacgcgcgcaacggcatcgtcggcctgaccgtggacggcgtggaaccgttcagaatcagcaccgacccgatgcgcagcgcatggccgaaactgcgcgccgccggcatacccgccggcatgggggtgtcatgagcgactacgacaacacggtcgccgaactgaccgaaaagctcacggggctcggcggcatcgtcacacaggtgaccgacgatcccacgctggtcaaaccctcaccgggcaaggccagcatctggatagaaccacctgatttcacatgggagggatggcacccctacccgccggaaatcaccatcaagctcatggtcacggccggcacccccaccacccagcagaaggccatccccctcatcatgcaggtgctcgaactcatgcaccaggagaacctgcccctgcgcagcgccaccgcctcaggcttcaacctcgccgacgcgggcacgctcgccgcatacgaagtcactttgaacgccatctaacacgaaaggaaacaaccatggcagacaagattcgcaccctgggaccgggaagcctggtcatcggtgccgccgacgaccagcgcaggctcgacgtggactgcacgagcgtggagctcgcccccgacaattccagcgaggaccccgacacctaccttgatgggcacgaggaaggcggggagctcacctccacctggaagctgtcgggcagcatcggcgaggactacagcatggagggcgcgcaggtgtggtgcctgaaccacgccggagagcggaagaccgccaagttcataccgaacaacaagggctccctccaactggacatgatcgtgaccatcgcgcccatcgcgttcggcggcgacgtgaagacccgcaacaagaaggacttcgagttctcggccaccaacgtgaaggccagcgcctacacggccacggacagcgcgtgatggccgacaaggcgttgtacgtggtcggccagaaacggttcgtggccacgatgcgcaaggccggcgccgacctcaaacagctcaaggaggtcaaccggcaggcggcgggcgtcgcactgccggcggtcaaggcactcgccccgcgcggcaggaccggccgactggccggcagcgtgcgaatcggcgcgacccagaaggccggcatcatccgcgccggccgcaaatcggtgccctacgcaggagtcatcaactacggctggccccgacgccgcatcgtcggacgccagttcgtcaacagtggtgtcgcctccaccgaaccacagtggacgcgcctctacaagcagtacgtcgacaagacattggaacagatcaagggagcataacccatgcgcaacatcgcgaaagtcacctacaccgacggccacaccagcgaggccccgctcaccccgcgcgtcatcacctcatgcgaggaacacgcgcagaaggaggggtgggccgccggcgacggcagccgaatccgccagtcctactacatggcgtacctcgcgatgaggttcgccggcaacacgtccaaaccatacgaccagtggctcgacgacgtggacgacatcgacgtggagaccccggaaaaccctaccgaataggcgagtggcccgacgactcgctcggcaagctcagcgtcatcctcgcccaccacttcggcggcacgccgtgggcatggcgcaacgaggccagcgaactggactggggcaccgcgataggactgctcgaacaggagatggaacgcatggaggaggcggaacatggcgcgtagcacgatcatgtcggtgagaatcaccggcaacagcgacgacgccgtgaaggcgttcagcaaggtcaccggcaaagccgccgccttcggcagcttcatgggcggcatggccgtcaagggcgtgaccgccctgtgggacaagctcaagggcttcagcgccgccgtcgtggacatgagcgacagcaccgacaagttcaagcagaccatgggcttcgccggactggacaccaccgccatagaccaggccaccaaggccacccgagattacgcggaccgcacggtctacgacctcacgaccgtgcagaacaccaccgcccagctcgccgccaacggcgtcaaggactacgtgggcctgaccgaggcggcaggcaacctgaacgccgtggcaggcggcaacgccgacacgttcaaaagcgtggccatggtcatgacccagaccgccggagccggcaagctcacgacggagaactggaaccagctgaccgacgccatccccggcgcggccggccggctccaggaatccatgctcaaggccggcgcgtacaccggcaatttcagggacgccatggagaagggcgagatcacggcggacgagttctccgccgcgatcatggacctcggcatgagcgacgtcgccaaagaggccgcgaccagcacctccaccatggagggagccatgggcaacctcgaggccgccgtggtcggcggcctgaccgatgcgttcaacctgttcaaaccgacggtcacctccgccatgagcgtcgccgccgacaaaatcagcgcgttcagcggcaaggcgaccaccggcctgcaaggcgtcatcaaactcgtgcgcgacggcgacttcagcgcggaactgcgcgacgcgttcaacgtagaggaggacagccccgtcgtggacttcctgctcaccatccgggataccgccgccagcacgttcgacaccgcgaaacagaaggtctccgatttcctcaccgcgttccagaacaccggccccgcacaggccgccagcgatatcttcgccgccgtctgggagtcatgcaaaagcctcgccggagccgccggcgacctcatcggccagttcacgcccctgctcgactcgatgggcggcgcggccggagcgggcaccgcgttgggcgacgccttcaacggcgccgccggcatcgtgggcgacgtggccgacaaactcaccgcgttcagcgactgggtgagcgcgaacgccgaacccatcagcgccgccctggtcggcatcggcaccggcttcgccgtgttcaaggcggccagcgtcatcagcgccgtggtcaccgcattgcagggcttcagtgtggccagcaccgccgcatccgtggcccagtgggcactcaacgtggcgatgaacgccaatcccatcgtgctcatcatcactctcatcgccgcattggtggccggtttaatctatttcttcacccagaccgaggccggccggaatatctggagcaaattcaccagcttcgtcggctcgtgcgcgagcaacatcatcggattcttccaatcattgcccggcaagataggcgcgttcttctccagcgccgcccagttcgcgcagaacacgtggaacaacgtggtcagctggttcagcggactgcccggccgcatcctgtccgccatcggcaacgtgggcagactgctgtacgacgcaggctccagcatcatcagcggcttcctcgacggcctgaaaagcatgtggaacaacgtgaccggctggataggcggcatcggcgactggatcaaggaacacaaggggccgcccgcctacgacgccatcatgctcgtcaacaacggccggctcatcatgaagggcttcgcacgaggcctgcgcaccggcttcgacaccgacgtgcgccgcaccatcggcagcatcaacggccgcctatccaacgtcgtgttcaacggcggcaccaccgccggcagtcaggcggccagtacgaccaccgttttcaacgtcacgttcaacgcgcccgtggaccgcgagggcgtggcacgcgaaatcaggaagattctccgcgactacgaccggaagcgaggcaactagtggcgcagcagtgtttcatgttcctcgactggggcgacggctgggttgccgtcaacgaccacgacaacgacgtggccgcgttggacggcttcagcatccagtggggcaccgacggcatcgaccagcagcccgacccgtccgtgatgacgttccggctacgcgactcgaccggctggctcaccggccgcgccctcaccctggccggcgcgcgcgtgctcgtgcagatctcggcgcaacccacatggggcatgctccgcgacgacatgggcgcatggtcggcgcagcgcatgcgtttggacgcgatgcaccaggcatacacgccctgcaacccgtccggcaagtcaagcgcggcgacgacgctgttcgatggactggtgcagaacggcggcgaagcccggccacgcggcgacggctggctgttggagctcagcgcctccagccgcatgatcctgtggaaaagactacagaaacaagggcccgtatcatccgatgcacgctacacgggcctgcattgggtcggcaccatggccgaacgattgacggagctcaaccgacgagccagggaagcggacgcgccacaggccaacgccaacggcctcgacgccaccgcatccgtggcaccctaccggaccgacgactacccatcgcagctcactttgctccaccgcctctacgcgcactcccgaatgtggccgatatggtatgaataccccgaccatgacgcgagccgactcgactacatgccgttcggcgcgcccgcaagcatcggcatcgacgacacggcgaggctcaccgtgaccgattggacgggggagacgctggacggcctcgacgccgccgacatcatcaccgacgacgaccagaccatcatcatccccgaacccgtcacccaaatcaccatccagggcaacaccgcgaaatccaaggacggcgccctggaattcgacgaccacgacaccgacttcaccggcctcggcaaactgccggccaacctgaccatcacgcaatccagcatcagcgcggaatcggacgtggtctccgccgacaactccgacggcgtatggggcagagccggcggcaccgtgtggacgccatcggacgacgaacgggaggcgttcgcgcaactgctcgtctcgatggaccggcgactgcgcccggacaccatcgtgttcgacagccggaaactcgaccccgccacgcacgcccgcctctacctcaccgccagcagcgggccgctcgtcatccagggttccatcgcctcacggctcgccggcgccgacgccaaaccagcatccggcggcgcatgggccagcaccggcggcaccctcacctaccaatggtcgaacggccggccccggctccgcaacgaggtcacactctggccactacccgtagccgccgagaccgcgattacctgggcgagcatgggagcatggccagccatatggaggcagtgcgcgctcaccctcgccgaactctctctcgtcacccgctaccagcaaccaaccaccatcacggaggaaccatgaaaaccacaccgatctacggcctgccctacatcgaggccgacgacctcgtgtcaagcgcgccagcacagttcaagaccatggccgagggcatcgaaaccgcattgaccgaggttgattcacgaaacacgcccgccggcgtgaaacccgtcatcgctaccacgctcgaggcattggcggcgcaaaccggcgtgacaggccagaccggctacgtgaccgccgacacgacgaccgcgaacaacggcccgtactactacaacggcaccgcgtggctcccttacgcgaccggcgccatgcttgacagtctgcggaaccaactgacacagggttatgagttcggtcactatgtgggttcgagcaataacaacggcgctatcgcgattccgtttgagcgcgcgcacgcgaccgctccgcgaacaattctgttgacgcaatcacgagtcgtggatgccgttgacctgaatttcacgccaatggtctggagtagaacaaaggataatttccaaattcgtctgaagaacaggaatgcaacatgggccggagtccagccgttcgagtgtagctggatggcaatttggccggtcggctaaatgtcaccatccggtgggcgcacatcccggacggcgtgacattcagctgacgcttttgccccacgcgacgatccagttcacgcgcacgttgcccgtgaacgcggtgggagacattacgtccagacgattctcggtatggcgcgtggtcagcccctcggagagtccggcggcggcatccccgttcgtgacgcccacgaacacttcgttgtcccatgcccgtccgaatcgttcctggaactgcgcgtcggtccacagcgtcgcatagacgacgccgtggccgcgcaggacagaggagccggtggaccaataaccctgtgatccatagcccaacgaaaggattatatgaacgaggacctgttgacagccatcgtcggcgtcgtcgcggccgtgctgggcgcgttcgcccagcagctcgtgaccgccgcacgcgaccgcatggaggcgtaccggctcgcccagcagatgcagacagacaacgccctgctgtggcagtggaaccgcgaactggtggacgccatctaccgccgctcgccgccaccgccgccggaaccaccagacggactgttcgaccatgattaaccaccaatgaaaggaaaaacaatgaaacagttgaccacggaacgaatcaagagcgtcggcgtgctggccgcgtcgttggtcaccaccaccaacgcggcactcgcactggccggcataaacccgctgccgttcacggacagccaggcgggtacagcggtgagcgccgtgctcgcgttcgctgtgacgctgtggacgtggtggcgtcataacgtcatcacgccgcaggccgccataggtcacgacgtgaccgtgcgggagaaggccgccgcgaaacagatcaccacggccgaccacagcgagaccgccgtggccgcgcagcggaacgccgaagcctccacgacaccggctaccgagggactgacggacggcgaactgaaggtgctcaccgccgcatggctcgccgacctgcacaaggaggaccagtgaccggatacgccggcgcgctatgggtgggctcgtcgaactacacggcgggccgcgcccaaagcgtgcaatacatcaccatgcatatcatggccggatacctggccggcaccgaccggatattccaacgccccgactatcaggcttcgagcacatacggcgtcgggccggccggcgaggttcaccagtacgtggacgagtcgaacaccgcgtggtgcgacggcaacggcagctacggcaacagcgccagcatcagcatcgagcacgagggcggctattccctcgcggccaacaccgacgcctgcgttgccgcatcggcccgcctgtgcgccgacatcgctcgacgatacggctggaaacggctcgtgcacggccagaacgtcagactgcaccgcgaaatctacccctacacgcacccggcctgcccggacaaatgcccgaaccccctgcgctggcaggaaatcatcgaccaggccaacaacattctggcgaccggctcgccggactacaccgaaggagacttagaaatggttgccgcaatcatccaaccaaacgacgaaaaccgactggtctactgggacggctcccacatccacaacctcagccaccccgacgaggtgaccgccatccagaacgcctacaagcaggccacaggcagcacgataccgtgcttcaagttcggcagcaagaccgcaccctgggccacccgcctcatcgaagccatgaaacgcatcgcctgaaatttaggcctgtttgagcagcgtggcggccacagccgcagacgcaaagctaggctcccaggataaccgcgtccagcgcctcacgcagtcgcgagtcaggcatggccacgtatatctgcgtggtctcgaccgacgcatgcccgagcagacgcgcgaccaggaacaggtcgtgcgtctgctcataggtcttcgtggcgtacctgtgtcgcaggctatggcacccccagccggccggcagcagcttcgagatatgacggttcacatagctctgttcgacatgcccgccccagcgtccgggaagcagccagccgccgcaatgctcgatgtaatcggccagatcgtccggcagcggcacgatacgctgcctgtcgcccttgccggtgattatcagcgatttgcctaaaaggtcgtccatcacgtcgcggctgtgcaccttcgctatctcgccgcgcctcaatccgcactccgccgccagtctgaccatgacccgctcacgctcggtggccttgtgcagagcggcgatgatgtacttgtctgggcacggcctcggctttggtttcggtcgtttgattttcggcagttcttcgctcggatcgtcgccacgccgtccggtggcgtgcatccacccgtagaagctgctcagcgtgtttctgtaccccttgcggctttccggtttccatttctgcgccgccatccaatgcaccatgtcttcggccgtgacttccaaaggcgtctttgccaggtcacgtgcggccttggtcatcttgcagcgccggcaacgcaccgtctcatcgctgagaccggccgccttcagagattcaagccaatcattgatgtcttccgcccatgacgccggcggtggcgttcgtttcatacccatggcgcaccatcacaccaccagcacgctacgccgctagaatataagccgataatcggccgtcatggatttgaaccatgttcctctggcacaccatgttgccagaggaacatggttcaaatccatgccccgctacgaacgtggttatatggccgctgatttcggtaccgaaatcagcggcctttccgtttaccgtggcgatatggatgaaaggcgatcaggcagctacggtgcccagggaagtcggcgatcataaacgtctcgtcattttcatcgcggatcttcagttgtctaatccacgggaggcgacaggcgtgaagtttctcaacgaagcggaagccgggcacaagtcgtatgttacgatcgacttcgtgcccagctcccgttcttctgctcagaagcggagtgtggttcaccatccagccgacatcatcggcatcatgccgcagcgggtcaacgtatcggccagcgcatcgtccagtgcttgaatcggtcatagcgacgacgccaccgaacgacgatggacagtatggcgcctatcgccagagctgacacggccagaaccgaggcaagcgacacatcgccacccgtgacgggcagtgacgggcgagggttgggcgtggttgcctccgccggcgccggcggcgtctcgggtttctccggttcgcacggtttctccgactcgcatgggggcaacacccgcacacgctcccaggcatcgtcataccggctggacgccggggaaacacggtcatccccctcgaaccgccagacgaacacgtaccacccaggccgttcggcggtcagatacataggagcgccatgcgcgtccaacgccccggcgccgattttgaacgtgccgttcatcgcgggaatctcccaggtggccagcaaccggtggttgtcgtcttccgtgggaacctctcccccggatggcttgtacgcctcatcgttggaggggttgtcgggatcgccggaccaccatacgctcaccgtcgcatacggccgatccgccgcgaactcatactcttcgttgccggcatactggccatgatccgcagggaatcccgatacggtaatggtgtcgctgagctcggcaccgatatccgccgaatgctcagtgaccgtcgacatgacttctagcttcctgcgacttgtattgctttccgtagcctccataaacggacttatccagtcgcctataaggtattcctgcgcctgtttgctctgctcggaccgccgaaacacccatacccatgtgccaaaaccgctattctgcttggtccggtaagcggcaccgtcatccggcttggtcatggcctgcacacgtgcctgctgccccaccccggtgaaagaggccttgccataggccaccggctcataacccaaagtcgccaatcgcgcaagaaaagcatcggcgctctcttgtgcattcggcgtaatgacattgcccacatcgcccgtatcaagaccatcgaaatagtatccgcgggcctgcaattccaaatcgggcacccaataactgtccgcatccgccacgccactggtcacgtcatcgaacaccggagaagccacatcaagcaccttctcggagaccttggtggataccgccggaacaaaatccttacgcacccgaaatgtcgtcgacgcgccgccagtggaagccatcgagtcaaaggccagcatgtcctgagtgctgtccatgacgtgcatccgcccatactcgtatgtggtgttcgccgtcacctcgccggcgccggtcgcctcccacgcgatcgaggacccggcgctcgtcgacacccccgagaacgtgttgccgccttggacgaaccgcgccgccccctgcaaggtgacggtgaacggcactcccgcgatcgcgtcaccggcgcggttcaccactttcaccgagatggaaccgctgcgcaaagcctcggcatcggtgcgttccaccgtcgtgcccgcaggcgtcttgccggccgattgatcccatatccgggccgccttcgccacgatctcggggtaccggccttgaatgaccgccatctgtctcgcccactcgtcccgatcgcgcccgaagtgatcctgcacgatgatgccgatcgccgcatgggtggcggcatccgtgtcgcggtaccggtcaaggatccatgccatacgccgggcgttctcatcggaggcaagcaccgtggtggggcctatcacatagtcgctcagtttccccgcttcgatgcagtagtacttgttgcccgaagcgtccagccccgcgacaccgacgtaatattccatatcgttgtatggaaacgccacgtgatatctttcgtcggcgggcgtcaacgtcgcggcatacgccgtattcgccgagccgaacaccactcccaccattattatcagaccggtcagcatcgctacgatggccatgccccgttgccgccatgtcgttatcatcattcgtcctttcctggtacgtttccccgcatactgcactgtgtgcgggtaggccacgatcatggcagattttcattcgctacagccggtttttcgacctatgtggtccgagcttgccgtttgccggcgagttgtggataactcttccgccgagttatccacctcatgcggttgaccgaacgtttacctgatagttatccacaatgcgcaacatatgttcaaaagcccttagaatagggccttatggcagcagtacaacatcgcgcgaccacgcgcactagtaataccgataacagcaccacgaaaacgaagtcaaaggcgacttctgcccgaaagagccccgcaaccaagcgcaagagagtcagcgccgaaacggcacgcgccgcagcagcgctgaaaggcctggctgtcgaagcccccgcaccgtccatcgaagcaaacgagcccggccagttcggccgcatcaatgtcatggacatcactcccgccgaggagcgcggcatcttccccgcccgtgtggaactcggcgaaccgtttgagatgaccgcccaggtgttcatcgaaggccgtaccaaggtgggtgccaccgccatcgtgcgcaacccgcgcggcaaggaaaccatgcgccgggccatgacctgcgtaaatcccggcctcgatcgttggaccgtgatggtcaagtgcggcgagcacagcgatctgaagccttgggaggatggctacgcggccgtcaagcgtcagctcggcgaatggaccgtgaccatcgaaggttgggaagacgcgtacgtctcctggctgcacgacgcccgcatcaaggtgcgtgtgatggacgacgtggacaacgcactcaattccggtgccgagttgctggcccgttgggccgaaaccccggacaccggcctgaccgcacgcgatcgcaagaccttggagaaggccgctgagaccatggccgatcagacgctgagcgccgaggatcgtctcgccgccggcgacaacccgaccatcgccgccctgcacgagactcacccgctgcgcgacggcatctcccccagccagccccagcgcttcaaggtggaacgcccgaagtccagcttcgcggcttggtaccagttcttcccgcgttccgaaggcgccaccatcgatccgaacaccggcaagatcattcagggtacgctgaagacttcgatggccggcctcgaacgcgccgctgccgagggcttcgacatcgtctacctgccgccggtcttcccgattggcgtgaccaaccgcaagggccgcaacaacacgctggtcgccggccccgatgacccgggctccccgttcggcatcggctccgagctaggtggccacgacaccgtggatccactgctcggcaccatggacgatttcaaggccctgtgccagcgtgcacatgaactgggtctggaaatcgcgcttgatttcgccctgcagtgctcgcccgatcacccgtgggtcaaggcccacccgaactggttccgccacaagccggacggctccatcgccttcgccgagaacccgccgaagaagtatcaggacatctacccgatcgacttcaacgccgacatgcccggcatcgaaaaagaagtcgaacgcatcatgaatctgtggatcgaggcgggcgtcaccatcttccgcatcgataacccgcacaccaagccggtgcgtttctggcaggacgtgattgccgccgtgaccaagaagcacccggagatcctgttcctggccgaggcattcacccgcccgggcatgatgcgcgccctgagctacgtgggcttcacccagtcccactgctacttcccgtggcgcaacaccaaggacgaactggaagagtatctgccggtcaccaatggcgacgacggctactaccagcacaacaccttctggcccaccacgccggatattctcaccgcttacgtgcgagacaacggcgtagccggccactgcgtgcgtgcggtgctggcagccatgggctcgccgtcctggggtatctacaacggttacgaactcatcgagaacaagcagcgccccggcttcgaagagcagatcgacaacgagaagtacgaggtcaaggttcgcgattggagcaaggccaagcagtacggcgtggccgagatgctcaccgcactcaacaagattcgtcgcgcccacccggccgcgttgagctaccacaacctcaccgtgctgcctacgtccgacccgaatattctggctttcgcacgccacacgccggccgaactgaccggtaccggccaagcggacacgctgattgtggtcgtgaacctcgatggacacaacgcacaccagtcgatgattcacctggaactcagcgagctgggtctgcccaccgaccgcccgctcaacgtgcgcgacgagctgaccggccgcgaattccagtggggttgggacaactacgtgtctctggctccttgggcggatgtggcccacatcctgtccgtgcagtgatgcggtactgcaacggtaatgcaacagtgatgccgttgacgtgcatgggtttatcgtgcgcgtaaaccgctagaaatcctcccctcaaggggaggatttcgtctgtttgggcatagtgtcggcataatctcagcacggtttcttgagttccgcacctgttttgcaggcgtaaacagggtattgtggtgagacgataacgtaactgtcgattttcaaggagaaatgacatggcagaaaccttcaacgtcgttgtggaaattccgcgcggctccaagaacaagtacgaagtcgatcacgagaccggtcgcgtcttcctggaccgtaccctgttcaccgcaatgggttacccggatgactacggctacatcgacggcaccctgggcgaggacggcgatccgctggacgctctcgtgatgattccgaactccgtgttcccgggctgcgtggtcgagtgccgcgccgtgggcctgtaccacatggtcgacgaggccggcggcgacgacaaggtgctgtgcgtgcccgccgacgttcgtttcgatgacatcaaggacatcgacgacgtcaacgagtaccacaaggccgaaatcaagcacttcttcgagcagtacaaggctctggagccgggcaaggaagtcctgccgggcgactactggactggtgctgacgccgccgaaaaggaaatcattgccgcgcgtcagcgtctcgccgattccgagaagtgattcgattctgaatcgttgacaggaggccccttcgggggccttttgttgtatttgtggcaaagccgctctactctccctcagtcgcagtttcactgcgccagctccccaacagagggagcttgtattttgtgatacagtaatgttttgtcttttcaactaggcgtaggcggcgtgtaggaacgctggtcgaggcccatcgcacggtaatccggcgatgaaccttctgtcacaccatgatttcgataatcattcaaatcctgcttatttctgtttccgtagctatggatgcattcgccgtatccattggcaaaggcctgaccgtatcccgcgtacgagtacaagacgccgtgaaaagcaccctctggttcggcggattccagatgctgttccctattctcggctatttcgcggcatctacattcagcaaatacgtaacccaattcgaccattggatcatcttcgccctgttggtgttcatcggcggcaacatggttcacgaagccttcgaagaagatgaggaaaactccaaggagaccgcccagttcgattggaagcatatgcttcccctggccgtggcctgcagcatcgatgcgttcgccgtgggcgtgagcctggccttcatgttcaccaaagcccatatggcattcgccatcctcagcatcggtgtggtcaccggactgttctccgctgcgggcctgcacattggccgcgcgttcggttcccgctggcagaagccggcgcagatcgccggcggcgtggtgctgattctactcggcatcaaagtgctattggagcatttgggcgttatcgcgttctgatttagtgccataagccccttcaccagaaggggctattttgtttgatttcaccgttccaatgcccgacgtaggattgggatagaaattcgattatctgagaggcgtatcatgaccgagatcacccaggagggttggaagaacaaagctctgagcatgttgttggcccaactgacgtcctatgtactgttcatcgcagccacggtcattccctcccctggcaccgtccccatcatccctttgattatcgccgctctgacgttggccgcatttgtcgtattctggccgttccgtggcagcatactggatcgtatcgtcactttggtgtttggcgcgatttctctgattttcgtcatcgtacctttcccgaccagcgaggttccgccggatcagaccgctgcggatggctcggtacttccttggtattcatgggcactggccatgggcctgctgctggtggtgctggtggtcttctccttcggacgccagatggctcgtgagaagcgcgaacatcttatccgcgcactctctcacgccgtgacttccggtgtggcagctctcgccgtggccggctggtgcttcctacctgatttgggcgcgatgctcgccaagggcaccgttgcgggaaccgttgccctgatcatcctcatcgttttgggactggctttggccgtggcttccacgttgtgggtgcgcgacgccgatccggacccggatatccgttatccgtggatcggtaccggcctgatgccggtaatgctgatgggcgtgaccatcgccgcaaccgcactggtgctcggccgtatcatcggttgatggacgtccaccgttccatattccgcaaacttgtaacctatgtgtccactacaagcgcgtagaataatgaaaaccgtgcgaaagcggcataacgccgctgacgactcgtacagccacaccgagcaattgcgtaacacattgcaggataagggggattagcgtgacggatcttacgttgatgactttcgccagcgaccccgccaccgttttgccatcactcgccctgctttctcatcgcgtccgcgtactgccgatggatgcagccagcttggtgaagatgccggagaacaccattctgtttctggatgcacgcgatgatctggcgaccgccaaaaccttgtgccgcctcatccacgcttccggcctgtccacgccaatcgtgctggtgctgaccgaaggcggcttcaccgtggtcaactcccagtggggcattgcggatgtggtggtcgccaccgcttccccggccgaagtcgagggccgattgcgattggtctccgagcgcggcaacgctcccgcagccgcagcagccggttctcccgccgaatccaccaccacggtggaagatggccagattcgctccggcgacctcattgtggacaccaacggctataccgcctccctgcatggacgccccatcgatctggcatacaaggagttcgaactcctcaagtacttggtccagcaccccggccgcgtgttcacgcgcgcccagttgctgcaggaagtatggggctacgactactacggtggcactcgtacggtcgacgtgcatatccgtcgtctgcgcgccaagctcggcggcgaatacgaacacctcatcggcaccgtgcgcaacgtgggctaccgattcgacccgccggagacggataaggaaactgccgccgcacagcaggccgccaaagcatcctctgccgccatcgacaccgatgacgatactcccgatctcaacaccgtcgcctgacagaccagcggcgctgcaaactatcaatcatcgatattacgccgcttaggtccatacgatgagagaaaccaaatccgcgcgtctcacgcgcatgcatgacgaatacgacattctgcgccaggtgattccggcacccgcttgcgcactgcatttctcgaatccgctcgaattgctgatcgccaccgtgctcagcgcccagaccaccgacaagcgtgtcaacacggtcaccccggaactgttcgccacctaccccaccgcccgtgacttggcggccgcaaacccggcccaagtcgaagacatcattcatccgctggggttctatcgttcgaaaacccagcatctcatcggactggccacggcactggacgaacgattcggcggcgtggtgccgcgcacgatggatgaactgaccagcttgccgggggtcggccgcaaaaccgcgaacgtcgtgctcggcaacgcgttcgatatccccggattcccggtcgatacgcatgtgatgcgcgtaaccggacgactgcgttggcggtcggattggcggtccgcacaccccgatcccgtgaaaatcgagaaggaaatcacctcctgttttccgcccgaagagtggacgaatctcagccaccgactgattctgttcggccgggccacctgccacgcacgtacccctgactgcgccaactgcccgctgtccgacacctgccctagctatgcgccgcccgccggcaagagcacgtccaagcgctaactcatgcctcatcatggtgaattgcggattctaggctgaatccaccgctagactgaaaaccatgcagcacagcaagcgggacaatacatggtccaagtgggggatttttctcggagtcgccgtggcactcggcgcactcgtggttgtgggatggacgttcatgcaaaaccggttccagccgggatcatccctcgatgccgatgtgaccattggcatcgacgatatgccgcaatccttggatattcggtccgattcctctgcggcagccgaacgcctgctcgtcgacaatgtgtatgagacattagtgaccgtcgatcaagacaacaagcttcagccgggactggcgacaagctggaagacttccgatgacggactgaccgtcaccctgacactgcaatcgggcgtcaccttctcgaacggccatacgttggacgcctcggacgccgtgtggtcgttgcaacagaacgtgaccaacaaggtggcggacgtcgacgaattgggcgatctggcgtcggtcgccaatccgaacgccaccacggtggtcattacgcttgccaagcccaatccgacgctgctgcgagcgctgtccggcagactcggcattgtctacgattccgagtcgtccagtgccgattatcaacgcaaggccataggttccggaccattcaccgtggccgatttccagcctggccattccctgaagctggcgcgcagcgatacctaccatggcaccaaagcggccagcaatgtcgttgaatttatgcaatactccgacgccgatgcgctcagcaaggccctgaccgacggcagtctcgatatggcggcaccggtttcggcttcgacggccaccggtttgaacggcaaggatggcctgaccgtcaaggagggggccactacggataaggtgctgctggcctacaacaacggcaccgattcgctgctctccgacgaacaggcgcgtaaagccttccgctatcaaatcgacgcagccggcatcgcctccgcccaacccgacgcagccggagcattgggcggccccatcagcctgctggaacccggatacgaagatttgaccggactgtacccgcatgacgaaaaccaagctgggcagatgttctcctactttggtgcgcaatacctgactacggtgaatctggtggttcccgaagaataccggtcgttggccgaaaccatcaagcagcagatcgagcggcagccgcgccccacggtgaaccttgaagtgctctccgatgaggattatgccaagcgaatcaaggacggcaaatgggaactgaccgtgatgagcatggacggcacggatgatgccggcatattcgccgaccccgattccatgttccattacgaccataccgaagcgcaacaggcctatgcggatgctcgcgccgccactaatgacgccgattatgaggcacgaatgaaggcgtacgcccggctgatcagcgaggatgcggccagtgattggctgtatacccgcaaatgcttcactgtggcgtccaccaaggtctccggctacccgacctcgatgatcaatcgccgcatgccgctggccgggttgacggtgaagtaggcaaccttcagtcacggacgggctacgcccgatagtccttggctcactatcgttcgatcgttcgtacctcgcctgcgaacagcctactgggctgtttactgtacagttcggcttgtcatgcaacgtgcataaactttggccttatgactgaaggcaaatccatcatcaacgccaacctcaccccgctgcccgacaaggtcggcgtggacggacttgaggacaagtggcgcaccgtctgggatgaagacggcacctacaaattccgcaacacccgcgaccgcaaggccgtctactccatcgacaccccgccgcccaccgtctccggttcgctgcacgtgggtcacgtgttctcttacacgcacaccgatgtgattgcgcgctacaagcgcatgcgcggctacgacgtgttctacccgatgggttgggatgacaacggcctgcctaccgagcgccgcgtgcagaactactatggcgtgcgcgtggacgtgtctctgccttacgacccggacttcaagccgccgtttgaaggcactgatggcaagaagattgacgccaaggatcaggtgccgatttcccgcaagaacttcatcgagctgtgcgagcgtctgactgctcaggatgagaagctgtttgaggccctgtggcgcaagctgggtctgtccatcgactggtcgcagacctaccacaccatcggtcagcacccgcagcgtgtggcccagaaggccttcctgcgcaacctcgcccgtggcgaggcctaccagcaggacgcccccggcctgtgggatgtgaccttccagaccgccgtggcccaggccgagctcgaatcgcgcgaataccccggcttctaccacaaggtggccttccgctttgaggacggcaccccgatctacatcgagaccacccgccccgaactgctggcggcctgcacctcgctgatcgccaacccgaacgacgaacgctacaagcagtacttcggccagtacgtctactcccctctgttcaaggtcaaggtgccgattctggcgcacccggccgccgaaatggacaagggtgccggtatcgccatgtgctgtacgttcggtgatgtaaccgacgtcgagtggtggcgcgacctgaagctgcccacccgcccgatcatccagcgcaacggccgtatcgtgatggataccccggactggatcgaggacccggccggccgcgaggtctttgccgaaaccgctggcaagaccacgttctccgcccgcaagatcatcgtcgacaagctgcgcgagtccggcgatctggacggcgagccgaccccgaccaagcgtatgacgaacttctacgagaagggcgacaagccgctcgagatcgtcacctcccgccagtggtatttgaagaacggcggtaccgacgccaagctgaacgccgagcttatcgagcgtggcaaggaactcgagttccaccccgacttcatgcgcgtgcgttatgagaactgggtgcacggcctgaacggcgactggctgatctcccgtcagcgcttcttcggcgtcccgttcccgctgtggtacccggtgaacgcttccggcgagccggattacgatcacccgatcactccgtccgaggatcgtctgccgatcgacccgaccatcgacgtgccggagggctacgacgagtcccagcgtgatgtgcccggtggtttcaccgccgaaaaggacatcatggacacctgggccacctcttcgctgaccccgcagatcgtgacccactgggccgagccggacgaggcctccaaggccctgttcgcttccaccttcccgatggacctgcgcccgcagggtcaggacatcatccgcacctggctgttctcgactgtggaccgcgcgcacttggagaacaagtgcctgccgtgggcccatgccacgctgtccggctggattctggaccccgaccacaagaagatgtcgaagtccaagggcaacgtcgtggtgccgaacgagccgatcgagaagttcggcgcggacgccgtgcgttactgggccgccgccgctcgcctaggcctcgatgccacgtacgacatcggccagatgaagattggccgtcgactggccatcaagctgctgaacgccaccaagttcgcgctggccatcggccgtgaggacgagaaccatcacgtgggcgctgccgccgaggccgcgtggaacccggccgatgtgaccgaaccgctggatcgcgccgctatggccaagctggctttggtggtgcgtcaggccaccgaggcgctggaatcctacgagcattccaaggcgctggaagtcatcgagtcctacttctggcagttctgcgacgactacatcgagctggtcaagaaccgcgcctatggcactccggacgagcacggcaatgtgccgtccgagaaggctgtgaagtccgcccgcaccgctctgggtctgggcctggacgccttcgcacgtctgctggccccgtacctgccgtacgccaccgaggaagtgtggagctggatgcacgccggttccggttccgtgcatcgcgccgcctggccggtcgtggacccgtatgtcgaggccgccaccggtgcttcccccgagctgctgacttgggccggcaaggccgtggagcagctgcgtaagatcaagtccgaggccaaggtctccatgaagaccccaatcctgtctgtggcactgtccgctgcttcggaaggtgtggaagcgattcacgccgccttgggcgatatcgcgcaggccggtcgcgtggtcggcaagttcgacttggtggccaagcacgccgaggaatccgccgccgaaggcacgcccgaaaccgaggtcgccgtcgaagccagcgagctcggtgagccgccagctaagaagccaaagcactgaacgttacgcacaacaacagtaggtctcacggcaatgccgctcgttccgagcctacgggaagcccaccgggcttcccgcttaacggctcggccagctaagaagccaaagcactgaacgttacgcacaacaacaaaagaggggaacctattgaggttcccctcttttgttttttgacgttcggatgacacgactgtgggacggcacgcaaatatcccgcatacaccatcacaccgtcggaatcacgatgagatatcgggtttcggcggttttttgttgcgtattggggctgtcgagctgcgcgacggcctgcgccaagagcgtgccagcatcactgattttcacggtctcattaatcagcgcgttcatatcgtgcttgaacagcgtgccgccagtgccaaagccgaacagtactggagcggtgtcaagattgtcgccggaatcgccagtgtcgctcgacttggctgagtcgttcgttcccgaaccagcgctcttagacgagtcggacttatcaccaccaccgatggccgaagtaagaccacccgcatagttcatcacatcgccagcagacatggacatggtgtcatcgaccagtgaggccttggaatgctgcgactgctgctgttgcgcggctttggcctgcttacgggcggcatcggccttacgcttggcttgggcgacccgggtcttgccgtagaacgattgcgattgcgaatcgaccaggccggtcagtgcctgagcctcggtcaccggatcggaagagacatcaccggacgaaccatcaccatcactgccggaagccgaggacgcgccgccttcgaactgatcggagaatcgcaatacaatctggcgcaaggccgtggctttgcccgtatgctcggaggcggtggcaagcgtgctcatcgcggcatcgaccttggattgagcgtcggcgagttcatcgctaccgttggtttcggcgatggcttggctctcgtaagcggtggcgcccgaggacgtgccgccggtcagggcgctcaaattggccgtgtaaacgtccgtgtatttcatcgaatacggaatcattgcggcggagagctggctctggccatcggcgtattgcttggagccttgagtggcttcctccgaagcctcggcgatcagatcatccaccagtccggtggtgccttgctgctggatgcggcgaatcacctcgtccaacgcatcgaccgcaccggcatgctgatgtgcggcactgacgttgttcaccgcgttggccaagtcgagtacggcttgagccaaaggcgtgtccccggacagttcgccggccgtgcccatcaacgccggcaactgggtggaggtgccaatcgatccagacaggtgcgtggtatatgagcccacatacgcggccatatagtcttcaaacgtccgcttatgggcggtttcgcgttcggccactacagacttgttcagcgcacgttcgttatcgcgcagggtttgaagctgctcgatgagctgttgctgttcaccagaaccggcgtcggtcagtgaatcgaccagtgtggcggcagaggcggtgagttgggcgacatccgtatcggcagcaggctgtgcggcagcattcgcagcattcgcggcatcgggattagcaccaactgccggactgctggaattggaaggcaatacggcgagcgccacggaactcatggagaagtctttggcgttcatatagcagctgaattccaagccggttgcggcttttccagctgcggcgactacggtattggaaccttgcgtggtcaccgtaatggagttgtcagcggaaacatcatcggctacctgcgtaggcacggtaaaggcgacaaccgggatcgtacggttggcttccttggtttgcggcttaatatcgatatacacgccgatcagtccagacgcgccggcaacctcgtttgcctcgacgttcggaccgtcaagcgagtaggtgacgctgactttccatggcagggtggcggcggaagcggggatacgagaaaccttggacgtgccggaattactattggcggaatcggtatcagtggaaccgctattgccggaatcggcactggcgccattgccggcgccgcccttccctaccacataccaacggaccggctccccttcggcatcggtgacggcgtacatatcacttgccgtagcgagcaccggaccgtaatcaaccggagtcggacgagacatccaagcaccgccgagaatcgaagccacgcacaatgcgcaactgaccagtgcggcaccacatctcatctacgtatcccattcatacagtcgaccactacgggcattccattcccgtattaatgtagtcgctgcaggcaacttgccctatagacgaatatccgaaaggtgcccattcgctgcgggcgaatcaggcgaatacgtcgagtacgcccggggcaccaccggcatcggctatgcgctggtggcgcttcttggcttcggtaaccacgaattcacggtacatttcggcaatttccggatcaagcccggcatcgatggcgatgcggtggaggcgttcgatctgatagtcctcacgcttggtgtcttcgggcgcgaatccggcgttggctttgagcacgccgacctgcgaggtggccttgaaccgctcggccagtaatgcgatgaccgccgaatcgatgttatcgatggtttggcgcagcgctttgatgcgcgccaccgcttgtgcggtttccgggtgggccgccgcctgggcggagtcgatggtggtcctttgccagtcgctgctcgtttcgctcatagattcgaggatactcccgattacggctttgcacgatgcgcaaagtcagatatctcagatgtcatagtcgccggtgaggatatggctggcatccgcatcgccgaacatggccgcaccactgcccactcccaaaacaatcgaacccagtgatgcctctttcatctcatatatcgtcagcgtgcatgtgaacgttgacggcaatactacaactgcaatgtgatagttgatgtatttgcatcagatacgacaagggctgcaccccgtatcaatcagggtgcagcccttacactattgttcagcggtctgatcagttgccgttgaccgcgttgccggtgttggcctgctgcacgatggcggcgaggaagtcgcggttggtggcggtcttcttgaggcgcggcaccagcgtctggtaggcctgctcgggctccatgccgcccagcagtcgacgcagacggtagataatcggcagttcctgcgggttggtgatgagctcctcgcggcgggtgccggaagcgttgatgtcgatggccgggaacagtcgcttgtccgccagctcgcgggacaggcgcagttccatgttgccggtgcccttgaactcctcgaaaatcacctcgtccatcttggagccggtttccaccagcgcagatgagatgatggtcagggagccgccgttttcgatgttgcgggccgcaccgaagaacttcttcggcgggtagagggcctgcgcgtccacaccaccggacaggatgcggccggaggcaggggctgcgatgttgtaagcgcgagccagtcgggtcatggaatcgagcagtacgaccacgtcctggccgagctccacaagacgcttggcgcgttcgacggccagttcggcaaccgtagtgtgatcggaggccggacggtcgaaggtggaggaaatgacctcgccctggaccgtgcgctccatatcggtgacctcttcgggtcgctcgtccacgagcaccaccataaggtggacctcggggttgttggcggcgatggagttggcgatgttctgcagggtgatggtcttaccggccttcggcggggagacaatcaggccacgctggcccttgccgattggggaaacgatgtccatgatacggccggtgagcttgttcggggcggtctcctgcttcaaacgctcctgcgggtacagcggcgtgagcttggagaactgcggacggttgagcgcttcttcaacgctttggccgttgatggaatcgatggcctgcagcggcacgaacttctggcgctggttgcggcggtcgccttcacgcggggcgcgaatcgaaccatgcacggcatcgcccttgcgcaggccgtacttcttgacctggcccatggaaacgtacacgtcgttcgggccgggcaggtagccggaagtgcgcacaaaagcgtaggagtcgagcacgtcgacgatgccggccaccggcaccagatcctcctgcggctcttcgcggcggctatcacggtcattgcgatcgctacgattatcgcgatcatcatagcgacgatcatcatcggcgttgtcgcgatcacggccacgcatgcgacggttacggcgatcgctgcgatcattacgggtatcgcgatcgttgcgatcgctacggtcgcggcggttacgacgcacgaactcgtgatcgtcgttctgctcgccgtcttcggacgtttcctcgtgcttctgcgtgggcagcgtggccaggatatcgtcgaggtcacgcacggtttcttcgctgttttccgcagtgcgacgacggcggcgaggctgctcgtcctcatcatcacggactcggcgaatcagcggaacttccacgtcctcgtgacgctcgcggcgacgctcggtaggcgctgcatctcccaaatcgagcgtggccagcagatcgccggcctcatcggccttcttgcgcggcttgcggcgagcgaaatcgggctggtcgtcatcgcgacgacggcgggccgcacgcggttcggatgcggcatcatcggcggccttacgacgggtgcgtcgcggttcggtctcgtccttcttggcatcgtcggccacgggaagcggcaaatcgagctgcggttccgtggcagccggagccggagccggcgactgggtggccacgtcagcattgtctgtggtgttggcctcagcggcatcggactgcggagccttgacgaccttggcggttttggcggccttgggggcgcgcacggtcacaccggccggcggctctccaccattgcgcgccgcctgcagggtggcgagcagctcgggcttgcgcatggtcgacgtgccgcgcaggcccatctgtttagcgagctctttgagctcaggcagcttcatatcctcaagattctggctatttgccactggttgccctttccataccgaacagacccatgcctatccaggcgttaagagtgattattgcggttgcaccgctcatgaatgttcgctgcgtctctgagtctctgcgaacttcgttcactgtacaacgccaactcgaccaacgcaaaacggcccgccgaaaaccaaaaaagctccctctgtgacgagggagctcaacaaggtttattcacttttcttcgtggtaggacttttcggtgttgacggaccacacgttcttcttggacgtcttgccggtcttgatgttgccgacggcctccatggcggtggccatggagtggtccatgttgttgtagcggtgctggccgttacggcccacgcagtacaggttgccgaagccgtcgaggtactcgatgagctcgtccatgtgctcataggtgtcgaagtaggcggggtacgccttcctgacgcgctcacgatgggagtcgatgacctcgtccggaccgttgatcacacgcatgcgggtgagctcggaaatcgcgaacttggtgacatcctcctcgctcatgttccagaacgagtcgccctcctcgcagaagtactcgagaccgatccacacggtgtcgtccacgtccttgaccaggtacgggctccagttgttgaagatctgcagacggccgaccttgtagcccgggtcctgcacgtagatccagcagtccggcacgatcggcggattgccgagggtggggatgctggtggtgttcttgagcttcaggtgcttgaccagcaggcccacggtcacgaaatcgcggtacggcaggccgttggccacctcggtcatatcggccggggcgggcttggaatcaacggcctcgggatcggcgccggccgcgtcgatggcgttgaccaggtccttgaccggcatcgaggagatgaactggtcgccggaaagctcggtgcggttgccctcggaatcctcgtacaccacggaagacacggcaccatcggtctggcggacctcgaccaccctggcgtcggtcagcaccttgacgccggcggcctcgcaattggactcgacggtctcccacagctggccgggaccgtacttcggataccagaactcctcgatcagcgaggtctcgacctccgcgttggagcgcttcttgggcagcagcttctggaaggcgttcttgagcacgcccatgatggacaggcccttgacgcgctgggcgccccagtcggcggagatctgggaggggtggcggccccacagcttctccgtgtagccctcgaagaacatcgaatacagcttgcggccgaaacggttgatgtagaagttctccagattgtcttccggcagcttgtggaacatggacttcaggtagctgaagccggccaccatggtgagcttgaagcccatggccttcaacgtgttggggctcagcgaaatcgggtaatcgaagaagtggcggttccagaagatacgggacactcggtggcgcttgagcatcaccttgtcctccgtctccggatcggggccgcccggctccatgtcgtggtcgcggccgagcttcttgtcatcataggagggtgcgccctgcaacggcagaacggtcttccaccaatccatgatgcgttcgtctttggagaagaaacggtggccgccgatatccatgcggttgccgttgtgcttcacggtgcgcgagataccgccgaattcgcgggtcccctccagcacggtcacgtcgtacttgtcggcaccgccgtccttgatgagttcccatgcggcggtaagtccagccggaccgccgccgataatcactacggattgcttgtcggtcattatgctccttataaacgcaaaatcagagacagtctactagaagccccggaatcgcacaccgaaagatgagcgaatgcttacagaattctcccgatatacgaccgatgcgccgtctttccatcagcagaaaggcgacgcatcgaatcgtgaggtaggggtattcggcaacgttgcgtcacacacagcgcggcgaatcggtttggtcttaggctaattcgtcagcgacgaactttccatagattcagcgagatgcctgcaagtgcaagcagcatcataatccccgcaacaccagtaacggcaacaccagtacgactcaactcgttttccgtaccattagcctgagtgttgctgggctgatgagttcccgcaccattgttattcggagtggtactcgttccttcaccagtgttaggtcctgtgcccggctgcgttgtggaatcatcagtcagatgcgcatcgtcgcctagggtttggtggtcggaggccaagcaacttttaagctcagtgagcttgtaccacgtggaaccatcggcaatcggcgtgcattcggagcggaaggcgatttcctgctcgttgtagagcatacgaacgagcggcgtgtaggcacggccggtcttcgggtcgttgccggatttgacggcaacatcccactgcacattagcggccatcggagtcaccgattcaccgcgccattcattgttggcgtaggtgtacacgtcggtggtgctggcggccgcctgctgggtggaaccgggaaggccaagcagcgcggcgaacggcatcatcgtttcggcatgggcaaagcggaaagtagcaacggtggatccgccgtttacgcgctcatcaatcgacgagaagaaatcgtcaagcagcggctgtgcgattgtgtaggtctcgtcttggccggcatagctcgggcccttctcatagtagtcctcggcgtcaagcgcccaggcgaacaacttggcgtcgtctgcctgctcaccttggaagtactggttgaagtcgaaggtatggctgccggtgttctcgttctccatatcagcggcgatgatgtacaggttgtacagatccatcgcggcatcgtattcggaggcgatcttcttcttggcttcgccgcaggcgtcggcatccttgctggggtcggctcccggcgcgcagttggcctcgccgcccttggtgccatcggcagtgttgtaccaagtgtatgtgccgtcggccagtttggcgaggaagtcgtcggtgaagatctgcgcaagcaggtcgtgcgaggccgttttcacgtcgccgttctcggcgatggtcttttccgcgcccgcgatggtctcgtcgttctcgacgaagttctggtagttgtcggcgagctgtttggcctcgccggttttctcggtgccgtccgggttctcggacttgtggaaatacagcgtattcggcgttttgtcgaaggccgccgcctcaccggtgccggcagggtcggcgggcgttacggtgctgttcgccagctcattgttcgaggccgcgttgaagccgcgtgcgaagttttcgccggactcggtggcgcgggcttcgccagaggactgataggcaatcttgccaccgtccttggctgcgttgtcgaacagcgtcttgttgcgctcgtaggcacgtgcgccaatgccctgatgttggtcagcaccctgaccggtgagcataccgtagccattctccacatttgcggcggtgatggctttgagattcttcatgaattcggacttgatggcatcagacttaaaaccgttatccgcttcggcggcttcggccatcttcacaagcaatgcgtcgtatttgtagctggacaggccgcgtgaaccgtggcgagccatcgactcggtgtataccgtttcgtagccttccggcgcctggctatagctggcagtggtcgcttcgctaggggccacatatggctgcttgctgctgtaatactggccatcggcctccaaagccatggcgtgcggaacggtcagaatgccaccggccagcaatgtggtggcaacaaccacgcccgcaatggagcccttaatgccctgctgcatatggtgtgtgttcatgcagcattttctatcagccgcaagcaaacaagacacacgatggcaaggttacgaatctgaacttttgctatgcgttgtatgaacaatgcgcgacgccccgccgtaagatgacggaatgccgcgcattgtcaatacaggctgtatcagacgattgcctgtcagtgaatatcgtcgggaatgtcgatatcggttttctggacttcttcgacgttcacgtccttgaaggtcacgatgcgcacggacttgacgaaacggctggaacggtagacatcccatacccatgcgtcagtcagctgcacatcgaaatacacgtcctgaccagcggaacgcacgttgaaatcgaccttattcgccaagtagaagcgacgctcagtctccaccacataggtgaacagcttgatgacgtcacgatattccctatacagcgcgagttcggcgtcggtttcgtaattgtcgagatcctcggcactcatgcttgtttactcactcactttccgtatcgcgtttgcggccgcggcccagcgtacgccaccatgcttcctttgagggcttgcgttccgcctggccgtacggccagttgctttcctcttcgagactgtggcgcgtgttcttctgcgtatcgtcgtggtgctcagcctgtggctcgactggctgtgcggccgccggcgtctgggcctgggactgcacgtcactcgtcgtgacggcggctgcctcaccacgctgtgccggctcgggttccggcttgttctgctggatggcgatggaatgctcacgcgcggacagcgcttccttgacacccgggttgtcctcaatcaagtgcataccaaaagcgtcaagcgaacgaatcggatcgtactcgtcgaccaacgtgtccatgacgataaggtcctggtatttgttgttttcgacatcccacaacgcgtcgcgcgaggtgccggacggcacgaagccgagcgactggtagaccgaaatcgaacggctgttcttttccggcacgctcacccagatgcggtgcatgcccaagccggccggttcgggcgcgaaaccgtaggtcatcacacgcggcatggcgtcacgggagtagccgcggccacggtattcacggcccaagatgatctggatgcgggcggacttggaccagccgtcgatgtcgataaggaaaatcatgccgatgacattatcggtactggccgcatcgagctgaccgtcatcgtcatggtcggcgtcagtcaatacggcccatgcgatggtgcggcgggattccggatcacccacaccggattcggcgggtgcctgaccggcttcccaagcctgggagcggcggacccacgtgtgtacgatggcgcgttcggtgaccgcatccttacctgtgatcttggatgcgccatagaaggcatcaagttcatccaaacgaggcaggtcctcgacggtggcggggcgcaggtgcaccatttcgccacggattggcggaatgacgatgctctgtggcagatcgcgcttcagttgcgcttcggtagccatgctcagcgtctcgttggttgcggtcatcggtatacgtcccccggttcggcttgtttcggctcacggtccagtgccgaacatatcttactcgactgggtgaacgctggaaatgctctgagtcgactttcttacagaatcaataaaggctcccgctggcgggagctgtccgcgaagcggactgagggtggtcatccgtacatggcgaccaccctcagtctcactccgttcgacagctcccaccagcgggagccagtgaatctaatcagcccttgatcttgcccatgacgaccttggtgacggccttggcgtcggcctgaccgcgcgtggccttcatcacggcaccgatgattacacccatcggcttcatgttgccgctcttgagcttctcgacaacgtccgggttggcttcgaacgccgcgtcgacggccgcctcgatggcaccgttgtcttcgacgatcttgtagtcgtgcttcttgacgacttcatccggagtgccttcgcccttaagcacgccttcgacggtctgcttggcgagcttgtcgttgagcttgccggaggcgatgagcttctcgacctcggccacatcggccggggtgatcggcagctcttcgagggacacacccttggcgttggcttcgcgggaaagctcgcccagccaccacttgcgggcaccggcagccttggcaccggccttgacggtttcctcaatcaggtcgagggcgtcggcgttgaggatgtcgcgcatctgcagatcactcaggccccactcggacttgaggcggttgcggcgctcgcgcggcatttccggcatctgggccttcatctcctcgatgtgctccttggtgatgtggagcatgacgaggtcggggtccgggaagtagcggtagtcgtcggcatcggacttcagacggccgccagcggtggtctgcgtagcctcatcccagtggcgggtctcctgcagaatctccttgccgtcgtccagacgagcggcctgacggcgaatctcgtactggatggtcttctcgatgccgcggaacgagttcacattcttggtctcggaacgggtgccgtacggagcgtccgggctcgggcgcaacgagacgttcacgtcagcgcgcatgttgccctgctccatacgagcgtgggagatgttcaacgcgcgcacgatgtcgcggatggcgcgcacataggcaccggcgatttcgggagcgcggtcgcccgccccctcgatcggcttggtgacgatctcaatcagcggcacaccggcacggttgtagtcgaccagcgagtggtcggcaccttcgatacggccgtcggcgccacccacgtgggtgttcttgccggcgtcgtcctcgatgtgcgcgcgctcgatcggcacgcggaacacggtgccgtcttccagctcgacgtccaggtagccgttgccgttggtgggcttgtcgtactgcgagatctggtagtcgcgcggcatgtccgggtagaagtagttcttacgggcgaactggctccactcggcgatttcgcagtgcagggccagacccagcttgatggcgtaatcgacggcggtcttgttgatcaccggcagagagcccggcaggccaaggctcaccggggtcagctcggtgttcggctcgccaccgaactcgatgtgggccgggcagaacagcttggtgttcgtggacagctccacgtgggtttccagaccgaagaccacatcgtacttcttggtggcatcggcgtacttcatcagtttttcagccatgatgttgtttctttccttccgatgctcacttgcccagaccgtcaagccacggggtcttgaggtcgttccagatcgggccgttccagctgtcttccagcgcggcttcgagggccgcggccggcttgtacatgacttcgtcgcgctgctgcggggcgatgaactggaagccgacgggcaggccgtcgtcggacaggccggccgggatggacatggcaggcacgccggcgaggttggccggaatggtggcgatgtcgttcatgtacatggccagcgggtcgtccatcttctcgccgaacttgaaggcggtggacgggctggtgggggccacgagcacgtcgacctgttcgaaagccttcttgaagtcttcgataatcagcgtgcggaccttctgggccgagccgtaccaggcgtcgtagtagccggcggacagggcgtaggtgccgaggatgatacggcgcttgacctcgtcgccgaagccggcttcacgggtgtaggccatcatgttggcggcggtctgcggcacgccggtcggcggcatcacgcgcaggccgtagcgcatgccatcgtaacgggccaggttggagctgacctcggacggcatgatgatgtagtaagcgcctagcgagtagccgatgtgcggaaccgagacctcaacgacctcggcacccatctccttgagcttgtcgacggcctcgttgaagcgggcctcgacgccgggctggaagccgtcgccgccgagttccttgatgaggccgaccttcatacccttcagatcgcgcttggcgccttcgcgggcggcggcgaccatcgggcgcgggccttcggggatggaggtggagtcacgcttgtcgtggccaccgatgatctcctgcagcagtgcggagtcgagcacggtgcgggagaccgggccgatctggtcgagcgaggaggccatggcgatggctccgaaacgggagacgccgccgtaggtgggtttgacgcccacggtgccggtcagggcgccgggctggcgaatcgagccaccagtgtcggtgccgagggcgatcggtgcctcgaatgcggcgactgcggaggcggagccaccaccggaaccgccgggcacgcgctcggtatcccacgggttgtgggtggtctggtaggcggagtgctcggtggaggacccctgggcgaattcgtcgaggttggtcttgccgagaatcggcatgccggcggccttgagcttttcgatgacggtggcgtcgtacggcggcacccagccctcgaggatcttggaggcggcggtggtttcgatgcccttggtgacgatcatgtccttgatggcaatcggcacaccagccagctcaggcagggcggccttgtcttcggcggacttggcgtcgaaggcgtcggcctgctcgagagccacatcgccggaaaccttcaggaaggccttgatggacggctcggcggcctcgatcaccttgaggtgggcttcgacgagctcgcgagaggtgacgtcgcccttcttgatggcagcggcctgctcggcagcagacagtttgacgagagttgcggtttcgttgctcatcgattactcctcgcttcccaggattcgcggtgccacgaacatgccggcctcggtcttcgggccaccggcgagcgcctcttcctgcgtgagcggggtttcggcgacgtccgggcgcaggtaggcttccagcggaaccgggttggcggtcggcggcacatcgtcggaggcgacttcctggaccttgttgatggagtctgcgatgacgttcagttcgccctgcagacgggtgatttcctcatcggtgagcgcgattcgggccagatcgcccaaatgcacgatttcttcgcgtgaaaatgttggcatggccataactatatgagccgtatgtgacacgcagttgtcgggaaaccgcattttcctaccctttgagaccatttcagcagggcaggcactcgggtcattatttgatatccgcttttctggtgacgatgagaccgccgatccatgcggcaggattgtcgacgcatggctacacgcctgatacggcgtgttgggcaatccatgcgtgcatggccacggccgccgcagcgcctgcattaatggagcgcacggaaccgaattgagagatgtagaccacatcgtcggccaatgcgagggccttctcgctcaatccggggccttctgcaccgaagagcagcaggcaccgcttggggaaggcataggcttccatcggcactgcgccgggaataatgtcgagggcgatgacgcgggcggcttgaagctccttgatgcgtgcatcacaagcatcgatttcggccagcagctcatgaaggtgcttgttgcctccatccacagccacatcatgcgcatggacggcggcggcaccggccttggctcgttcataggcgatttcaccggcgatgcgatgatgccagctttccaccagttcggcgatggaggggtggtgttcgacgtgctggtacagttcggtcatcaacgcgcccttgcgattccacttatgtggaccgacaatgtgtacgcgcttggcctggaaggcattagcggtgcggaccatggaaccgatgttaaaatcgtgggtccagttttccaccgcaacttcgaagtcgtgacgccctcgagcgtcaagatcggccttaatggcagcaacggtccagtagcggtaacggtccaatacgttgcggcggtctccgtcgttcaacagcaccgagtcgaaacgaccgtcataattcgaagaagtcggatcatcgggacgaggctcaccgggatgggtctcagaccacggcccaaggccgatttcacggaattccggttcacctgaagccttggcagccaaagaaatctggttgggtgcgtgcaatctttctcctcgataacgctattcaccggttcctcttagtcagcttcgctgctcagcccggctgactttatgcgagggacgtcaaaggtggatttaccgcagttcggattcgtcgaagacctggatgaaggggagcgtttgctcgtcgccggtggaggggttgaccacattgatgtctttggcaccgccaccgaccagcgaggcgatggccacgaccttggcacccagctgctccactatgccaaagtcgaggctcagctcattgccgttgcgcagggtgaccagcgagcttgtctgcacgtacgacttttcggacagccaagcatccaacagcaccacacggcggccttcgatggaggggcccttgatggacgggtagacgaagtccatcacgaatccatctaggtcctcgccacgagaggcggcggcctggatcatggcagacaccatgggcacagatgctgcggtcaaggcaccaacagcatcgaagtcatcaatcgaatagcccgcatcttccaaagcgtcaatcagtacatggcccatgacagtggcggcacggtggtcgaaagtcaccgcggcaagttcggagaacggacggcccaccacatgctccttcagcaaggtggctagctgttcacgcggctccagcatggcaaagtcattatggctcttcgcgacggcaaggtccggggtaccagtggggcggaatccagattcagtcatgactccagactatcgcctgaggcagtcagatgagtatcaccttcatcggccggcaccacttcaggggcggacagttcgctcacattgcctttatctgattcgatgatcggtacttcctcgatgatcttggtcggttcgattttttgcagcttgcgagcggtgggcaacacacggcgttccaaactggacgcgaacttgttgtaggcgctgaccgtcttagtaatctgggtgcccaatttgatggcataatcacccagcgtggagaaccgttcgtacagttctcgggacaaatcgaacagctgcttggcgtcatcggtgagcgactgctgctgccaggcataggccacggatttcagcacggcccagagcgtgaccggcgaggtgagcgccactttgcgagagaacgcatcatccatcagtgtgggatcggcttcgagcgcggcctgcagtagtgcctcattggggatgaaggccaccacaaaatcaggtgctacatcaaaggcattccaataggccttttcgccgagagcacgtacatgctcgcgcaacgccttggcatgggaccgcagcaaatcatcgcggcgggcaatatcctcggggctggcggtgtccgggatttcgcaggcacgctggtaatcggcataaggcactttggcatcaatcggaatggtcttgcctcccggcagatgcacgatcatatccgggcgcaacgtacgcccatcggcatccgtgaccaccacctgggtgtcgaaatcgacatgttccagcaatccggcggactcgacaatgttcttgagctgggcctcgccccacgcgccacgcaccttgttgttgcgcaacgcggcggacagggaactggtttccttgtccaaacgggcctgctgatcgttgagccccttgagttgggctcccaatgcgcccatttccctcttgcggccctcttcgatctgcgtgaccttgttctgcaaggtatcaagattcttggcaactggcgcaagcgcctcgagcaccttgctctgttctttcaaacgtgcttcctgttcagcacgcttggcctcggcggcctgagcatccgcctgacgcttccgttctgcctccgcagctgcacgctcacgttcccgctgaatgcgaatctgctcagcctgctgcgcctgggcaagttgtgacttggcgaaagccagttgttgattcacaccttcaatctgagcttgcgcggcagcattgcgagcactgagctcagcgttctcgaatcgcgcattctccagcgaggtcttggcctcctccagctcctcgcttttgacgcctcgagccatctcctgacccttatgacggcctagcacgaagccggcgacgaggccaagccctgcaccaaccactagcacgacgatgacgataatcacggttcctatttgctcaaacatggtacccagtatgtcatcgatggtgaatgacggtaaaactcgtcacgatttgacgagacgtgcgatggccgcggaagcctccgcaagtttttcatcggccacctcgccgccctgaatcgacgcctgccgcacgcaatggttgagatgatcgtccagcagcaataacgccacggatttcagcgccgaattcgacgccgaaatctgcgtcagaatatcgatgcagtatttgtcatcctccaccatctgcgtgatggcacgcacctgtccttcgatacggcgcaatcgtgcgatgaccttggccttgtcttcgtcataaccatgcatcgcaaaccccctgatacttatccgtcagctgaacacaccccattatataccctctaggggtatagagtatacactgttgttcagtacaacaaacaaggggaaggaacggttatggagttcagcatcttctcggccgccacggcgctgatagcggcggccgcattgacatggctggtactgcggttcttcttcggaacgcagaaagccacggccggggccatggacgcctctggcgaacgccaatccgcaacgatcaccgtcaagggcgggtactcccccgccgtgatcagcatgcgcacgggtacgccgatcacgctgactttcgatcgacaggagaccggcgaatgcacttcgcatgtggtgttcgcggatctggggcttgacgccatgctgccgggcaacgccaccaccgacgtggaactaccggcgttgccggcgggcgaatatccgtttgcatgcggcatgaatatggtgcatgggttgttgagggttgagggagaggagagtaaggacggtgcggataaggacgggcttcgcccgcgtgctgacggctcggccgaagccgagggggtctctccctcagacttgcgggttggagctccggttgtggatgcggcggaggccgagcggcgagaggcggctgaacgcgccaatgagatcaaggcgctgacgaagctggtgattgtgggcgcggtactgacgttgccggtattcgccgtcaccatgctgcatatggccaatcccgcgctggcgccgcattggatggtgaacccgtggctgcaggccattctcatcacgccggtgatgttctactgcgggcgtccgatccacacggtcggcttccccgcgctggcgcaccgctcccccgacatgaactcgctggtctcgctgggcacttcggctgcctacctgtattcgctggtgacctgcatcgccccgtgggtgttcccggagggctcgcgcgagccgtatttcgaatcggtgggcgtggtcatcaccctggtgctggtcggccgcctgctggagaccaaggcccgcgaaggcaccggcaaggcggtgcagtcgcttatcaaactgcgcccgcgcaccgcgcacaagctcaacgccacttccgcagacaatgtggacggcatcgaatggcgtaatccggcgcatttcacggacaccgacatcgacgccatcgccaccggcgacctgctggtcgtcaagaacggcgagcgcgtgcccacggacggcgtgatcgtggccggcgaggcgcgtatcgacgaatcgatgatcaccggcgaatccaagccggtctccaaaaccgcaggcgacccggtgaccggggccaccgtgctgctcaagggcgactgcgtgatgcgcgccacccaagtcggcgcggacacggtactctcgcagatcgcggcgatggtggcccgcgcccaggcgaccaaggcaccggtgcagcagctggccgataagatcgcccggtatttcgtgccggcggtgatgatcatcgccatctggacgttcgccatctggaggtcactgggcccggcgccgcaactggcgcacgcgctggtcaccgcggtcagtgtgctgatcatcgcctgcccgtgcgcgctgggactggccacgccgctgtcggtgacggtctcgctgggcttgggcgccaccaacggcgtgctggtcaccagtgccaaggcgctggaacaggcgcgtcgcatcggcaccgtggtgttcgacaagaccggcaccatcacgcgcggcgtggtggacgcggccgccgactgggacaagccgagctacgagcaggacacggtcaaggaaggctcgcgtgaggccatcgcggcgttgcgcgcacgcggcatccgcacggtgatgctgtcgggcgacaaggccgaggtagccgggcgcatcgcccgcgaagtcggcatcgatacggtgatctgcgaggtcaagccggacggcaaggcctactggatcgccaaactgcagcgcgaacgcgacgaggccaccgccaagtccgcgtacggcacctcccgcacggccgcacaatcccgcactctgattgcgatggtgggcgacggcatcaacgacgcccccgcgctggctcaggcggatctcggcatcgccatcggcaccggcacggacgtggcgatgcagtcggcggacgtgaccttgatgagcggcgacttgcgcggcgtcatcaagaccatcaacctgtccaatgccacgatgcgcaacatccgcgagaatctggggtgggcgttcggctacaacgtcatcggcattccggtggccgccggcgtactctacccgttcaccggctggctgttgagcccgatgatcgcgggtctggcgatggcgttgagctcagtgtgcctggtgctgaacgcgaaccggctgcatggagcgaacatcaacgtgggcgttgccgatggtcccgccggttcgggcagcagcatggcggatgtcgaatcagccggatcggccgaatcagccaacgccgccaacatcaccggctccgccacatccaacgcgcctcacgagccgaccgtcatcatcgatgatcgcaccacgctgaatcaaaccaatcacgtatctgaccaatccaataatccaaccaacaaggagaacactatggatacgggaatgcacatgcaccacaccgcccccgcggacggcgaaaccgccaccgacccggtgtgcggcatgaccgtggctgtgaacgccgacgcgatcacgcgcgagtatgagggcaagtcctattacttctgcggcgaacactgtgccacgaacttcatgaaggccccgcaggtgttcctggagcagtagtctctgcgtttacctgattcaacgacaatggcctccgcccaaaacgagcggaggccatttgcatatatgaatcaatcaacgaatcagctggcgaagaagaacacgaacagccaagcgccgataatggcgccgacaatcggggccacaaccgggatccaggcctcgccccagcgggaggagcccttgtgcgggatcggcaggatggcgtgcagcagacgcggcatgaggtcgcgggccgggttcaggccagggccggtcgggccacccatggaggtcacgaggccccacacaatgaagccgacgacgatggaggcggcggcgtaatcctgcttgccccaagccagggacaggcagcacagggcgccgaagacgagcaccagggtgccgaacatctcgttgaggaagtagttgaccttctggttgtccgcgtcagtggtgcagaaggtgcccagaatcgcctcggcgtcctcggtctccttgtagtgcgggtagtaagtgatgtagacgatgagctggccgagcagggcgccgagcagctgggcgacgatgtacggcagcacgtcgctccacgggaacaggccgttgacggcctgggcgatggtcatggccgggttgatgtgcgcgccggagacgctaccgaacatgagcaccgggaacatgacgccgaagccgtagcccatggcgatgttcagccagccggcgtggtggcccttggtgttcttgagctcaacgttggccacggagccgttgccgaagatcatcagaatggcggtgccgaagaactcggcggccagcttggtaaagagaggataatccactgcttcttcttttctcttcgccgcgcaacaggcatggctgactgttcacggcattctgtgtgactggaaatccgttcgcggagccggcgacgcgatttacgctgggcgcgaaagcaaacgtggtgattgtacactttgccccacgacgaaatgccggcaagatgcgatgtcgaatgtccagccgaatgcaatgcccaaaaagccatcggaatcagccgaagcgaccttgaatctcagtggttgcgaatgacgttgcgcaggggcaggacgctggtgggcgagacggacagttcgtcgattcctaggcgcaggaacgtatcggtcaggctcaagtctgcgccaagctcgccgcagatgccgcaccagatgccatgacgatgggcagcctcgatagtcatctggatcatgcgcagcacagctggtgaatgcgggtcggcaaagcgttcgagactcgggttctgacggtcacaggccagcgtgtactgggtcaggtcgttggtgccgatggagaagaaatcgacttcggcggccagctcgtcggccataatgaccgacgcaggcgtctcaatcataacgccgatctggatactctcgttgaagtcgatgcgctcgccgcgcagctcgcttttggcttcttcaagaatccgcttggcgtcgcgtacctcctgcacagaggtgatcatgggcagcataatggcgatgttgccgtatgctgaggcgcgcaataatgcgcgtaactggactttgaaaatctccgggcgggtcaggcagatgcggattgcccggtaaccaagcgcgggattatcctcgtggctcagattgaagtagtcgacctgtttgtccgcgccgatgtcgagcgtacggatgatgaccggacggtcgcccatctcctgtgcgacttgtccgtatgcatcgaactgaaattcctcggtcggccagtcctcgcgttccagatacaggaactcactgcggaacaagccgatgccctcagcatcgttggccagcacggcggctgcgtcagagggacggctgatgttggcgtacaggtggacccgctgaccggacttggtttcggtgggcttgcccttgagcttccgcaggaggcttaggtgctcctcagcctcggccttcctgcgccggtattcggtcagcgtggcctcgtccgggtcgacgaataccgcaccgctggtgccgtcgattacggcaacgtgaccatcatcggccgggtcaaaggcgtcgccgatacctgtgatggcgggcaggcccatcgtgcgcgccagaatcgcggtgtgcgagttcgctgagcccttggcggtcacgaggcccaaaaccttagcgcggtcgagctgcgcggtatcgctgggagcaagatcttcggcgaagatgatgtggctttcgccgttctgcgcgatcccgttctgcacaataccgttctgcacagcatcgccttgtacactgccatcctgcgccgtgctatcgcgtttgccttgcagcacgttcatcacgcggcgagaaacatccttgacatcagcggctcgagcctgcatggtcgagctatccatcgcagcgaacatggcggcgaactgttcggcggcgctcttcaccgcgaattcggcgttcaccttgtcttgcgcaatcaaaccttcgacgcattccgcatagtccgggtcctggagcataagccgatgggcgtcgaacagttcggccttgttttcgccgaactcagcggcgacgttgtcacgcagttgcttgagctgagcgacggccgtgtcacgggccgcgcggaatcgatccatctcggcctgcgggtcgtcgattaagcggcgttctacggcataatctacggcggcgagcacgcggaccgtgccgatagcaatgccagcggatacgctgacgccctgtatcgttctcattacaggtgctccttgaggaatcgctcgaactctgcagcagcgacagcttcatcgttgccctgcacccgaaccgtaacctcgtcaccttgttgaacatcaagtcccataacaccgaagatacgcttggcatccacggattttccaccgtaggcaacggtgatgctcgattcatattcctgcgctttggcaaccaaccggccagccgggcgggcgtgcatgccttcggggtcggatacggtgaacgtgaatatctgaggcatgacgttgctccttacacgtccggccgtcacgcgcgaagacggcctttccgcaccagctacggactgatactggaaaaaacaaaaaaccggaatctttcgattccggttgtctgtgcccccgcagggattcgaaccctggacacgctgattaagagtcagctgctctaaccaactgagctacaggggcttggttagatgttgaagtattccttgcaacaggtgataaatatactcagatttgaagcgaatgcaactctcggcgtgtcgcgcctatttccggcgtttttgctaatacaaaaatcccccatgcggcgcaaaccgcacgggggatgatgcttaagctcagactcttggtctgtgtgattccagcactaggccggaatgactcactcggccacgaccttcacgaagaaggaagcggtgatctccgggtggagggccaccttggcggggaaatcgccggtggtcttgatggtctcgacctcgatggccttcgggttcaccgcagccttgtcggacagagcgacggcgatggcctcgttggagataccaccgaacagcttgccggactcggacaccttggcggcgatctcgacggtagtgccctcgatggcggccttagcggcgacggcgtcctcgcgggtagcgacggccttggccagacgagcgcgcttcatagcgacgatctgagcctcagcgcccttggtccacgcgaaagcgaggccctgcgggaacaggtagttgcgggcgtagccggacttcacgtcgacaacgtcaccggaatggcccaggttggacacggtcttggtgagaataaccttggtttcagccattgttcaaagcctccctaactcagcgacccgaggtggcgtacggcagcagggccatctcgcgggcgttcttgatcgccttggacagctcacgctgctcctgcacggtcacgccggtgatacgacgggaacggatcttgccgcgatcggaaatgaacttacgcagcagcgcaacgtccttgtaatcgatctcggtgaccttggcggccttcagcgggttcggcttcttcttgaacggcttgaccggcggttgcggcctcttacgtgacatgatgttctccttataaatcttgatattgattgctgctggcagcggggaggcaagtactgatcagaactccgggtcggaatcgtcgccgccgaaatcggaggaagcgccgaacgtggagaagctaccggcatcagatgcaccggcattactccacgggtcgaccgcaggagcggacgggttggcgggagcggcagactgctgggagtatccagcgccaccaccctgatagccaccgttgtaaccgccctggccaccggcataaccaccttggccaccctggttgccatagccctgattggactgctgaccaccctggaaaccaccggaacgaccctggaagccgccctgaccggacgactggcgagtcacctgtgcggtggcgtagcgcagggagggcccgatctcatcgagctgcatctccacgacggttcgctgggaaccatcctgtgcctgataggaacgctgctggaggcgaccggtggcaatcacgcgcatgcccttcttcagggactgggcgcagtggtcggccagatcacgccaagcggagcacctcatgaacagcgcctgaccatcctcgaactggttggtctgacgattccaggttcgcggggtggaagcaatcgtgaagctcgccacggtcgcaccgctgccaatagtgcgcagctcggggtccgcagtgaggttgcccacgatggtgatgacggtttcacctgccataacggtccttcttacttaccttgaataccagctgttcagctgactaaacgcttgattcagcccttacgaagaatcttcgtacggatcacggattcgttgaggttcagaacacggtcaagctcatcgctggtagcgggctcggcggtgtacttcaccacgacgtagttgccttcggtcttaccggcaatctcataggcgagcttgcgacggccccagtaatcgggctcatcgaaagagccgccttccttggtgacgagttccagatactgctcggtcagcttcttcagaccgcgctcatccagctcaggatcggcgatgaacatcagttcgtacttgtgcgcagacatcacccacctccttcggactattcggccacggacgttccgtggcaggagtgtgtatgcgtgttagcccatgacgcagcaccaaaccggcaccgcctcttcgggcaacttggacagtctatatatgaggcgggacagggtatgcccatattcttgccggtttcgcgatgcccaccgttttggccaagcccacgcagcccgcggctcccatcactcccggagcggcaccggtagccgcacctggcgcgacctccaccaccatgaatgagcaacagaagaaaatcttcatcatcgttggtgccgtggccggcttcctcgtgctgttcggtatcgtgtatggcgtgctgtcttccgccgtgttcagcgcgaagagcgttgcgaacagctatgtggccgccatctcctccggcaactacgacaaggccaacaccatcgccgatcctcacgtgaatacgaaccagcgcgcactgctgaccagcaaggcatcctcgggcgagaacacgcgcatcaccaacgcgcgcatctcgcagacctccaataatgccgatggcaccgtgagcgcccagctgacgtacacgcttgaaggcaaggaggtcaacggcaacttcaccatcaaagacaataaggtcagtgtcgagttctccgagtgatttcggcaatctcaacactcttacgaaataagcaccccgccgtggcgttcgctgcggcggggtgcttgtacactggttaaggcgtaaatcacacagcgactcaaacaaaggatgcgaacgcatgtcggcgattcttgaaggcactccggataaacgactcgtattggtcacgggccgcgcctaccccgagctagctgagaaggtggccgaatgcttgggaaccgaaatcctcgaaaccacgtcctatgactttgccaatggcgagatgtacgtgcgtttcaccgaaccggtgcgcggtgcggacgtgttcgtgctgcagtgtcattcgggcgatatcaacaagtggatcatggaacagctcatcatgatcgacgctttgaagcgcgcctccgccaagtcgattaccgtggtggcgcccttcctcggctactcgcgccaggataagaagcaccgcggtcgtgagcccatcaccgcccgtctgattttcgatctgttccacgccgccggtgcagaccgcattatgacggtcgatctgcacgccgctcaggagcagggtttcttcgatggtccggtcgatcatctaaccgccatgccggtgctgctcgattacgtgcgttccacccttgatctgggcaacaccaccatcgtgtccccggatgccggccgtatcaaagtgtccgaacagtgggccgccaagctaggcaatctgccgctggcattcatccacaaacagcgtgatattactcgtccgaaccatgccgaggcacatggcattatcggcgatgtcgacggccgcgactgcgtggtcatcgacgacatggtcgataccgccggtactatctgcgaagccgtgcgcaccctgaacgaatccggcgccaagtcggtgacgctggtcgccacccatggcctgctctccggcccggccgtggagcgcttgtctcactgcggcgcgcatgaaatcgtgtttatggacaccgtgccgattcccgaagagaagcgcctgccgaatatgaccgtactgtcttgcgcaccgctgctggccgcgggtattcgctccgtgttcgaggaaggttccgtggcgattctgctcgacggcctgcccgaggacatgcgtccgcgcaatatctatgcgtgattgatacgccgaaaatccttacgaaaaaacgccgcttggctattgatcaagcggcgttttttcgtatagctccaatcagatgaaggcgcgctcgccgaagatggcggtgccgacgcgcacgatggtggagccttcttcgatggcgtaggccatgtcatgggtcatgcccattgacagttcggtgcagtcggccgtgccttcggcaccggaggcaagaatctggtcacgagtgcggcgcagatgcgcgaagcccgcacgaatcgtgcgctcatcatccacatgggcaccaatagtcatcaatccctgcaagcgcagtccgcccatcgcaccgatgcgctgggccaagtcgatggcgtggctgggtgcgcagccggacttcgattcctcgccggattcgttcacctccagcaacacgccgaccgtgatgccgcgcatggtggcacggcgggcgatcttttccgccagttcgatggaatccacggattcgatggtgtccactaccggcagcaccttgccgattttattggcttgcaattggccgatgagatggaaaggaatatgcgttgcagctgcggcattggccgtgtcagcctcagcggcatcaatcacgcctagcgaataaccacgctcccccagtcgttttgccagaccgtcagccttgacagtaatctcctgtggacgattctcaccaatcacgcgaataccagcatcgatagccgccagaatctcgccgacatcgcgcgtcttggtggcagccagcaattggaccgaaccggcagcacgcccggctgcggactccgctgaggcaatccggtcaagcacgcgatgcacaccatcagtaatctcttgtgcgcgcgcctgatcgataacttcgttggcgagatccttatggtccatgtatgccgtcattgctgcccctgttcgtagattccccaccatcgtagtctcatacgcgcacataatgcttgttattgaacaaaagtgaagcccccgctgttcatgcgcgggggcttggtgatgctaggccgagcgagtgggactagcaggtaccggacttgcggcgcttgaggatgattacacccgcaacagcaagtaccacggcgaggatgccaacaccaagcacggctgcaccggtgtcaggtatcttcttgtgcttgccggagtctgcatcacccttgttctggttggaatcgttgccttggttgggcttgtccgtgccggaaccgggcttatcgccaccctggccaggcttcgtggtgctcttctcaaccagacccgcgatggcatcgctgattgcctcagtcgcagcctgtacgtcagactgggcggcctgaccatcactcgtcagcgcattcgccgtagcgactgccgaatcaagcacggccagcgattcatcagtccactttgtgcgatccacggcagcagcggcatcgagctgagcgctcagcgcggcacgatcttgcaccgtagctacaagcaccagcttcttcgctgcctgcttcagctgggttgcggcatccaccaccgcagcttcggtggcatcctcagccttatacacctgctgcgccgaatccaataccgccgcgtactccgcccatgaagtctcggtgtacttggaggcatcgtcagccttaggcgagtcagcgagcgcctgcttgagctcggtcttgtcgatcggtgtgggctcaggcggctcaggcgtactgtcgtcaatggcatgaacctgccattcggcaacagccggagaagccgagccggacgtgataaccatacgcaacttggtagtcttgaccggagtgttccacgtgccatcagaccaccccttggcatcgccggtggcccagccagcagacggtgaattggcggtcacagtgtaggtggcgtcggaaatatccacgaagttgccggcaccgttgttcgccaaggcgtcccagtactgcaattcccacgatgccggaatacccaatccgccatcatccgaggtgaattgcacgcggctagagtcgatagtcacttcacggtcccactcgtagtcgaggcgcatctcaccggtgttgggccaagtgccccagacatcctcgttggcaatggtgatatcgggaatgatcttgccgtcgttcaacgcggcggcacccttgacccagccggatgccttgccgtccacatcggtggcggtggcatcgccctcaatgtagccggtcagcggcacggaagtgtcggatggaatgtcggttttcgccgaagcggacacgttgccggccttatcggtggcgcggtagtacacggtggcgcgcgacgcgctcggtgcagcaatcggcttgctgtacgtggcccattgaccgtctgtgccaatgcggtattcaattgatgcgacaccggaaccggtgccgtcatcagcggtcaaggtcagcgtgcgctcctccttatcggcggcggcggtcacggttggcgcggcggagtccaccttgccgccggccttggccacgtcggaaacgttgccggcctgatcggtggcgcgagcccacacttcgacatcgccctgctgggaaagcgtggcaatggccgcgtttgcattcgcggcgatggtggtccagctcttgccttgatcagcggaaatctccagcttggcgataggtgcggtgtcgtccgtggcctgcacggtggcgaacggagcggtggtgagccactcgctattgcctgcgttagcagtaacggcaacggttacagtcggcttcgtggtatcagcggcaggctggtagccgtcctgcacggtgacatttaccgacacattgccctgctcgcttgcctcaccgggcacgccggcgaccacgccgtaggccgtaaacgaaccgaccttggcatacgaggaagcatcaactggacgccaaattactggggaggcaacggttgggttcccgtacttcacatccactgtggccggcagagtaggcgcagtaccggtggcggtggtcacgctcttcggcgcggtgattgccggcgattcgctggagtcggagccgacttcccattcagcaacggccacggaggcatagccgccatccacagcttgaccggtcatgtcgagctttaaggcagtagtggtcaccgcatcgaaggtgacggcgttggggttggccttgcctgtggtcgttgtataggcactcgggttggtgacatccttccatgtgccgtccgcgtccaagtactgaatcttccacgaggcgggcgcgcgcagagcgttggaatccacgtcgaaccaaaccttagacgagttgacgcgcacagtgccatcccattggtagaccagagaatcgccggactgcgattgcgggatagaacggtagttggtccagtgattcggcgggaccacagcggtttgcaacacacggccgtcgttcaccgaacccttccaagcaggcgtttcagtgaacgtggcgctcacctttgcgtacggagccacgttggtggagggctgcgttttctcggccttggttggatgggcggtggaaaccatctggccgtcggcggtccaatcgacttcatcaatgcacacggcacggcggaaatcggtgccgccttccttgtcgccggtgtgataggtcacataccatttgtcgccgaactggagcaccgaggggtgcatcgtggtggccgagccagaaggcacgattacgccttggtacttccatgggccgagcgggctgtcggaagtggagtactggatgcaagcttgatagttcgattccacgcaggtggccgtgcccgaaccgggcttaccgccgtcgtacacgttgtaataggtatcgcccttacggaacacccacgccgcctcgaagaatcccttcgggccgttcgcgttgctgtccgcgtccttcatggtgtggaggttcggcgtggtgccatcagccttggtttccacctcggtgtatgaggtgcggccggttgtggcgtccttcttcatcttgatggcgagctgagtgccgaacgtaccaaagtgcaaatatccggtgccatcctcgtccacaaagaatgccggatcgatggtttcaatctgggtttgcgatgtggtgagcagcggcttgccgatggcatccttccacgggccgagcggactcttcgacttggccacgccgatggcgaacgggtcctgtccagccgcctcagaagccttgtccttcaccggcacgtagtagtagaaccaatcatcggaagtgtcgctcggggtgccgttatcgtcggctacgacttggccggcgtacgcgccatcgccggtggcccagctgaacaggtctgccttggcgatggtcttgtaatgtgtccatttgccttgattcaggccgtcttcatcggtgacgtatacgccccagtccttcatgttgaaggagccgtagtcgggcgaagcctcatcgtgaccggtgaagacgaagagtttgccgtcatagctcagcgcggatgcatctgcagagtagtagttctgcgaaagatcgttcggggtgtcaataccctcgttctgcccgatggggttgcgcatgtagctgggcagtgcgctattgtcgatttgggtgacggtgacatcaggattgttatacggcagttcgttatacgcgtgaccggcaacgctgggcgcgttgtcagcggtggctgaatcggcggccattgcggtcggcgcaagggcaaggcctgacagcaatgtcgctgcggcgacgagtccaccggccaccgcgcgaaccgattgcgcggatacatggaaactcatagtgctcctcattgagtgagtgaaaagagtaatgatgggtagaaggaaaaggctagagccccctctgtgagggggctcactcggcagaatgactccgttgcgggtcaggccgagtggcgagccgaaccgtggtcgccggactggcgacgcttcaggatggtcacgcctgcggcggtgagcagcacggcagccgcagcaactacggaaaccgcggcaccagtcggaggcacacgatcacccttgttgtccttatcatccttatcagtgtcggtcacaccaggctgctgggagccgggcttctgctcaaccttggtggcccaaaatgccttgtcaagggcatcctgtgcggcatcgacgtcggcctgcttggcgtccttgtcgtcgtacaccttctgagcggcggcaatctggctctgcagagcctgccatgccttctcggtgtacttcgacttgtcagccttcttggcctgctcgatggaagccttgagagactccttcttcaccgtttcgacggcgggcttctcttccaaggccttgacggccttgttcagcgaagcggacgcttcctggacggcggcctgagtgacctcaccgacctcaccgaccttgagcacaccttccgcagcctcgatggccttgttcaaggcctcgacactcttatccgtgtacttgccggaagcggcctcggccttggccgtgtcgatggccgcctgcaacgtggacttctccacgtcggtggcgagcgcaacgagcaccttctggccgtcctcgagcttggtcacctgctcggcgacctgttcttcggtggcattgacatcgtcgtacacagcctgggcagcgtcaatgatttgctggaactcagcccatgaagcggcggtgtagcggcgtgcatcgaggccgttggctgtgtcaagagccgacttgagcgcggtcttgtcgaccggggtaggttcaggctcggtgccgtcaataccatgcacgccccactcggccacggcggccccgaaggtgctgctgccggtgtacggagtgagcacgagtcgcagcgacttggtggtgaccggcttgaaggtcacagcgctccaacccttggcatcggtatccgcacgagaagccggcgaattacgcacgacggtgtaatcctcggtgggctcgacgtccttccaagaaccatcctcggcgaggtactgaatcttccaagcgtccgggacttccagaccacccttcgaatcgtcagtctcagcgaagttggcccagaactgggcgcggctctggtcaatggtcacggactgaccgaagtcgtactgggcgtacatgccgtcctttgccttgccccaagaaccccagaccttgtcgttgacgttctgatcatccgtggtcggccaagtatcatcgacgactacgccgtcgttgagcttgccttcggccggcgaccaggtcgcctcggaatcaggcgaaatggtggtcctggtcgccttgccttcaatccaaccgaccaacggctcaggctcaggctccggagtggaggaaccgttcgggtcggcaaccacgtggacagtgagcttggcagctgcggaagatgaaccgtcgtcgacggtaccagccacctcgtagtcaccaaccttggtcaggtcgatggccttgatgtcggcatccttccacgtgaccttgcggtcgtcgttgtatccgttcgggaacttcaccggaaccgtggcgggcaggtcgatggacttggcgttctggtagacggtctgctcaaccggctgcgcattacccacggtctgcgatgcggtatcggaacgagccgcgatgtgtgcaaccgtaccgttcagcgcaccggcgacggtgcccttgacatcgaatacggcatcggcggccagctgagcgtcggtcaccttaccccacgtgacggcgaggtcacggcgagaaccgtcggtgtatacggcgctcacggtggatggcagcttcagatcatcagccttggaaccggtctgcaccagtcggttgacttcgtccacgctcaccggctcgatggcgtacgcctcgaactcggaagcacccacgatggcgcccttcgggaagaccacgcgcagcttgtcggtttcgacggcgtcggcgaacttcacttcgttgccttcgttccggttgaccgtgtaggactggccgtcagccagtttcacatcctgccagttaccgtcagcgtcagcgtactggagcttccaagatgagaccatcggcacgccaccgccatcggtccagaagaagaccttggccttcttcagcggcaccttgccggcccacttcagttgcagccacggctccacaccagtggagtcgccccagttgttccaggtctcgttcggcgtgttggcgtataccacctgaccgtcgatgaccttcttggcgttgtccttcggctggtagccgttggtgtagctggcagaggcgctcgactgcggggctacgttcacggtaccgtcagaggggatgccgtgaacggtgatttccttggagccttccttctcgccatcggaagcggtgagcttcaggacgtagtcaccctccttgttgaaggtgacggtggtgctggcagcggaggcgtccacgaacttcgcagtaccgccttccggaccggagacctgggaccatgtggtggtgacgtcgccttctgcgggcagaccgtcatccttcaccgtaccgacgagcttggcaccagatgaggtgctggaagacacgtaagcatccacctgcggagtctggttctcggaagtgccgtcagccttgataccggtgttgtaggcttcgatctccttgacaccgacggccatgccggcctgcggcgtgaaggtgacgcggatggtcgtggtctccaccggagtgaactggatacggttgtagttcgcgcccgcgtagttcggggtgcgcacctgatccgcaatcggggcccatgtgccgtcatccttctggtactccaacttgtagttggcgggctcggcatagccggagatggtctggctggacgagctctggtagaagtacaagcggatgtcgtcgatcttctgcttgccgtccttgaacttgatattgagcgtgtcggtcttgttctcagagcccttggtaccccagaacgattccatcacggtcttgccgtccaccgcgttcttggccgggtagttggtgtccttctcggcgtaggtggtaccggtcacgtccgcgtccttggccacgttcgtggtggacttggaggcggagtcgacgttggtgccggacttggcgaacaggtcggtcacgcgctgatcggcattgaaggtaacctgattggcggccttcacgttcttgacggcttcggcgccgacggtaacctgggcactggaatcgtccttgacctcgaccgttcccgcagccgggtcatagatgaggtgcgccagcttgtcggaggtgaaggcgagcttgccgcccacgtacaggctgtagccagcaggaccaccgtagtggctgccgtccttgtcccatacgatggagacatcctgatcgtggtagcgcaggttgtttaccgtgaagtagttccaaccggggatttcgatcgggtttagctcaatcttgttgtcctcgcgcggcaccataccggctacgtcctcgaccatcgtccagttcgtggtgccgagctgggtgtggtggatccaggagcggtaggtgatcttgccgccgttctgtgcggcgtcaaggttcttgtcgaggttgttgatcacgccgtcaccgttcacatcgccgacgttgttgttgtcctcgttccagaactcgttctgatcagggtagttgttatcgccgccctggtagtgcgcgaacgccacccagtacagcagcttcttgaactgctcattggtgatgtagccattcttggctgcatcgtagttgcgaataccggccgagtagacctgcagcagcggctgcgcattaatgatggagaagttgttggaaccggggaagttcaacgcggccttgtccgcttggttggcggtgaagaacgggaagatcgggaactcgttggaatcctcgaacaggcgcagagccttgttgtaatcttcgttgccggtaggcatcaggccttcggagtacgggtagtagttattgatctccttgtacttggcgaaagcaccgtcgttcagccacctgtgcttgagcaggttgtcggacttgtcccacagttcagtggtgacttctttctggatcttgtcggcgatggcctgcatcttctcggcgttggcggtatcgccagcagccttgtatgcctgagcagccgcgttagcgttggcccacatattggcggaaccatcggcgcgatccatgcgctggccggagcgacccggctcagagaaggaaacggcgtcggcatcgttaccggtcatcgaccaccaggaccagtcaatcaagctgttgtcattgttgttctggttgtcgttgttgtccggctcgctcttggaagcgagtagaccttgcacgtcctcggcaccctggtcggccagcttctcggccacggtggacggaccgccgtgcaccttgtaggagtcccagccggcgcgcgtgatgtactgcgtgtagctatggttccagttggccgggtcgcccggattgtcgtggtagtagtaatagcccgccttgctcttcttggcggtatcgccggcggaaagccaggtgccgtaggagtactcggggttgcggaaccacttggtgtccatcatgaacatgccggaggtgagcacgatctggttgttgtagccgagcacaccctcgatggaggtcgggtactggaaggtgttgccaggtatgttggcgtcgagcatgttgaaacgactcagccaccagcggtagaccacggtcttatcgatgttgtcttccggagtgtccacatagggagcgttatcgacccaccacttgttgtaggtggtcacggaatccttgtaggaggcggcagcatccttaaagtcgccggtgtaacgggcctcatattccttggtggagtcaggcagttcgttggcgatcaggccgagctgaatcttgacggtctgcggttcgttggccttgaggctcaacgtgctggtgagtttgccaccgctgacgatccagttggaaccgtcctggttgttggcggagaagcgcggatagatggtcgtcaggttgttcttgacgttcacgcggccagtaagttcggtggcaccatcagcaccctcggcggcgaacggcgaggccgtggtcagtgtgacatcgcggtcctgcgtgctttccacggtgaggttcgcaaccatcacgttgttgtaggtgatgtacttaacttccttgatcttgaggctcttgccaccggtctggaacagggaggtgaagtagctcggtgtctgcttgcgctgggaggcgtcttcgttaagggtctggtttgcaccgtcagcgtttacggtaacggtaaagccatccctgttggtctcatcccagtaggcggtgttacccacaaaaccgagccgattaggcgtgtgcgtgtacatgtaggcggcgcgaccacgggtgaacaggtagttgttgccgtcggagccttcatacgagtaagaacccttgtcgttcgtgcctttaccagttggctgtgcaccagtacgggtgagaatcttatcgatccagaagtcatggtcggtgtcggtgccggccaggttcttcacgtcgttatcgaatgtctcctgcagatagctggcggcagggttatatgtggtgttgttcgccgccgtcttcatcggatcatcagatcccttgaacgacggatatgccacatccgcattcttgatgacgggcgtatcggctgcctgcgcggtgactgcaccgccggtggccagtgtggcgaccgctgcaaccgcgccgattgacgcaagccaccgctttcgtgttgattgatgcattcctgcttggacctctccgccccggtctttcgcgtcttcgctcaggctacgtcgcgtctatgcgaccaggacttcttctgtggatgctgggccgcagagcccgttctccatcagtttcctttattggttattgggttcaccggaatgagtgtcttcagtaaatctggtgtgatatccgccatggatatcccggttggagcaattcaccgaagctgattccacatcataaccgagcgaatacggtttcacaactttccctcagtgatatcaaccatcttatacaacaaaaacccggtaatttctcagctttcgcatttattttcgcattagagcattgctgcgtttcgccgtgtcgcagtacctacggcgcaacgattcagcctcgctgaatcaggaaccaacaggctcccgctggcgggagctggctcgcaaagcgagactgagggtggcttacacggtaccgcttatgaccgccctcagtcgactccgccgacagctctcacagcaggagcatataattaaaaaataatctcctgcacgggtattaccccgcacaggagacctcattccccggatgtgttttcggctccaatcgatactgacatccggcctatgccgtcatcgacttattacagacgatggcggcataagtatttttttgccggccagttgcgcgcaggccggcatatcgccgatatttatcgacgctggaagacacgcatctcgcctatctcgcggttggcccacgagtagtacggcaccaagcgcagcgtcgcgggttcgcccgcacgcggttcgtcggcatccacgtacagcggcgcgtcatcctcgtcggcgtgctcgcgcactgccggcaaatcaacggtatcgacgccacccagcaagtcggcctggaaagccacagcggcatccgcaccggtgacgccatcggccagacgatagttccacagatcaccggggttatcgacctgttcggcgcagtagaccagcggtccgcgcatcacggccacctgaccggcatcggagcgcacgcgggagttggcgcgcacgaacttcacggacatgtcgagctcgagcgcaatctccaacgtatcgccggcgttgaccacaaggtatacgaagccgtcttccagcgaacccactgcgggcttgccgttcacggtcagcgtgtaggagccccgcgaccagccggggatgcgcagtccgaaacggaccgagctgtcagtggcgctggcgggcaggctcaccgtgtattccacatggccatcccacgggaagttcgaacgctgctcgaccgtcaggccggaagcgaattcggctgtgttggcgatgaactggtggctcagcacggtcttgccgccgtcgcgctcggtgtagatgtagcggtccacggaggcgatgagtcgggcgatgttggccgggcagcaggcgcagccgaaccagtcgacgcggtgggagagcacgtggtgacggtccgggttatccagtccgtcaggcgtggtctccagtgcattgacgtagtagtactgcttgccgtcgagcgagatgccggcaatggaaccgttgaacagttccttctccagcacgtcggcgtattcgcccttgggctcgaggtcgagcatctgctgggcgaacatgctcatagccacggaagcacaggtctcaccgtacatcgtgtcgttcggcagatcatagtcgtaggtgaacgactcgcccacgtgggtggaaccaatcgcgccggtgacatacatacgacgggtgacgatgttcttccagaaacgcttggcggtgtcgatcagcccctgatcgccgagtagtcggcccacgtgagccacgccggtgcacaggtaaccgacgcgcacggcgtggccgtccgcggtctgctggtcgcgtacgggctcggcagcctggaagtaggtgggcttgtagaagccgagatcatggaagatgttgtcgccgttcatcgccttgagctgcttggcgtagaactgcggatcctgaccgcgcacgtcgatgagatactgggaaagcgtcagataacgcttctcaccggtctcttcatacagcttggcgagggcgagctcgatctcaggatgaccatcggcgccgtggatcttgccttcttcggggccgaagttggcatccaggcagtcggccatctttttggcgacttcaagggcctgctcgttgccggtcacctgatggtaggcgacggcggcctcgatgtagtgacccatcacgtacatctcgtggctctgctgaatcaggctgaagcgcgggcggtcggcccatacgccggacttgatctggtacggggtgtccaaatagccgtccgactgctgggcgcgggcgatgagatcgaccgtgcggtcgcacagcgccttgagctcgggatccgggtggtatgccaatgcgtaggcggcttcctcaagccacttgtagacgtcggagtcttggaagaccatgccatggaactcgtcgtccaattcgccggcggcaaccttcaggttggcaaccgcatggctcttgttgtcagccagctggttgccggctgggtcgtcgggcaccgtggtgtcgatctcgtcgttcatcacgccccactggtaggggatgacggattcgacgatctggtcgcgacgccgcttccagaacggggaagtgattgtaacgttcatgattgtccttttttaaggcccttgaccacaccgcctccggccctgcaattaaggaccggtttcagccgggctcagtattggcttcgacgctgtcgcgtctcagcacggagcttgctgggagcccaccgggctcccagccaagggccggcggcacgagccgtcagcccttgacagctccggccataaagcccttgacgtagtacttctggagtgcgaggaacaggatggcgcagggaatcagcaggatcacgacgccggcctcggtggcaccgtaatcgatgacgcccatggtctgctgacgcatgttcaccatcgccagcggcagcgtggacttggacgaagagctcaagtacagcggaatcatgaagttgttccatgcctcgaggaaggcgagcaggccaaccgtaaccatcgaaggcttgaccaccggcaccaggatcttgaacaaggcctggaggctgttgcagccgtcgaccatggcggcctcctccatgtccttggggatcgcgtcgaacgcgttgcgcatgatgaacgtgctcataggcagctggaacagggtgatgaccaggcccacgcccagcaggctgtcgttcaggccgatctgcttgtaccagaccatcagcgggatcagcagcgaggcgtacggtaccatcaggatcgacagggtgaccatgaagccgaggttgcggcccgggtagtcgaagcgggagaacgagtagccggccagcgtacagacgaccacggagaacacgaccgcgaccagagtcacgattaccgagttgaacaggtacttgggcagaccttcctgataaccgaacagggtcaggtagttggccacgccccagcccttggactgggccgaaccggcctgcgggctgaacgagcagatgatgacccagaccagcgggctgatgaagatgatggccagcagggcctcaaggatccgggcgatgatacgcttccacaatggggtagtcataatgtgttacctcccctttctcacttggtgttgtcgcgcatgccgcgcatctggatggagttgatgatgaccaaggccaccagcacgatcagcgagagcgccgcggccatacccagatccttcttggaatcgaaggcgaagttgtagatgagctgcaccacggtcatggtggagttgttcggaccacccttggtcagaatgaagaactgatcgaacgcgaggatcgagccggtcacgcagtagaccaggcacatcacgatggtcggcttcatcagcggcagggtgatggagcggaagatacgccaggaaccggcgccgtccatgcgggccgcctcgtacagatcaccggggatggcctgcagaccgatcatcatcagcagcatatagtagcccgagaatcgccagacaatcacgataatcgtggcccacagggccgactggccagtggccagcaccgaaccgccctcctgcatcaggcccaacgagctcagaatcttggtgacagggcccacctgcggggaatacagtgcgtagaacagcagggacgcggacgccaggcccgtcgcggacggcagcaggaagcaggtacgcagcacgttgttccacttcgagctctcctgcacgatcatggccatgcccaggcccaggaccagcaggaagaccgtgacgatcacggtgtactccaacgtgaaccagatcgagggccagaacaatttgttctcgaacaccttgacgaagttgtccgggaagttcacgccgcggttgccgcccagcaggctccaacgcgagcaggccatcaccaccagcagcacgatcggcacgaagaacaggacgacgatcatcagccagtccggcagcgagtacaacaggccgcgacgcgtctcggccgccttcgccttggacttatgcacgggcaccaccccggcgctcttggaaacactcgacatgtttctctctcctttggggaataactgtgaaatggtaatcacggaatccgaatgcaatccgatgtcagggcttcgaggaaggaggactccgaagccccgccaacacaccgcattcataaggtatgtagtgatgaaggaagagaaggaatgaagaagaagatagaagttcgattatgtggttgagccggctcctgccctcacaagggagggaccggctcaatctgttcagttattattcagttattgctgtgatttgatgagtgatggtgaggagcatcaccaccgaatcactgggcagacaggacgtcggtgacggccttgttgtcggccttgaggtcaccggaaccccacacggcgttctgcacgagcagctgccacggggagccagcggcgttgaaggcttcgttgaaggccggggacttcggggtctggccgttgccgtcgataatcacggagttgatggtctggatgcgtgggtcagcgtctttgtaagcggtcttcagggtctggatgttggaggcggtgtcgccttggtcagcgaagacttccttctgagcgtcagactgcatcagccagtagaggaagttccaggcctgagcaacgtgcttggagtccttggagatacccatggcatcgccgccgaggaacgtggaggtcttgccttccttggtgcccgggatcggagcaacgccgacctcgaagccgccgtccttctcagcatcgaacagagcagtggtggaggtgttcgggtaaggcataacgccaatcttgccgttcgcgaacggagcggtccaggtggcgccggtctcttccttggagcctgcacccaggccgttggtggtgttggccagctccttgtaagcgtccaagacgcccttcatggagtcgttgtccagggtggcctcggagccatccttgttcatgacggattcgccgtcagcccacacggacgggaagaggtcgaagaccagagcaccaccggactgaccggcgaggtaggagcctgcgacgccatccttgttgagggcggcgaccttcttggcctgctcgacgaactggtcgatgctcttcggaccctgctccgggtccagaccggcttccttgtacaggttcttgttccagaccatcacggaaacgtcagtgatgaacggcagggtgtactcggcgccgtcaacagtaccggcttcgatgtggccctgctgcaggtcggccttgttgtccaggccatcgatttgcttggtgatgtcggtgaagatgccctcggaagcccagtacggaatacggaccacgtcgccggcgaggatgtcaggcagggagtcggtctgcgaagcgccgccgaccttgccttccatatcgtcgttcgggatgatctcgagcttgacctggttcttgtggctcttgttgtaagcctcgaccacgttcttggcctgacgctccagaggggaacgggtccacagggtgatctcggtaccatcgtcggtgcccttggccgggataccttcggcggtggcagtgccaccattgccggagccaccacaggcggccagcggaacgatcaacgcggcggcagcgatgccagcaagagtacgggtcagtttattgaaagacaccatgttcgcttctttctctatatatccgctcaactatgagaggcggtggcggacggtccgcctccttggtttcgccctgctcgctcctttgcccggagcaggtaacactgcgaaagccttttctcaatataaacaaacatggaagtttttgcaaaagcgctttcgcattttcgcgttttttctcacatcaaacgggttcgagactgtgattcgactatgaataacgtgcttgaattggcttaatatcaatgattattccggcgtgtcgagcaaatcaaacaaaagcgaacatggaagtaacgctttctttcacttaccttgcacttgaacaatttccctgactacgccacgccgaaaaaaagatgtttgcgaaagttttcgcattgaagctacaattattcccagatgcaattgcgcaccacaccgtatgaggtatttcatcgcaaaacaatgcgctatatactgctgaagaaccaaggaatcgaggcatgatgacccagccagcaaccggacgggcagcgcgacttgaggatgtggcggcattggccggagtctcgacggccactgcatccaaggcactgcacaacaaaccccgtatcagcgaagaaaccaagcagcgtgtactggatgccgccaagcaactcaactactctcccaacaaactcgcccaatccctagcccgcggcaccaccggcactatcggcctggtcacctccgatctgcagggtcgtttctccacaccgattcttatcggcgcggagaacgagttgcgagcccaatcgacctcagtattgttggccaacgctcgtggcgacgccgccttggaacgtcagcatgtcgagaaactgctgtccctcaaggtcgacggactgctcatcgtgcagtgcgagaccaaccccaggcccacgcttggccatgactggggcgtgccactggtctacgtctacggcccctccaccgatcccaaagactgctcggtcacttgcgacaacgtggacgccggccgcatggccatcaaccatctcatctcgtgtggccgccggcacatcgccattatcggcggcgacgaaacctataccgctgccaccgaccgcaccaagggagctctcgaggcgctctccgaattaggtattgaacccgccggcccaattcgttacggcaaatgggacgaaggctggggccgtgcggccacccgtctgctgctcgaccaaggggtcaagttcgatgcagtggtctgccagaacgatcagttggcccgcggctgcattgacgtgctcaagcagcagggactgcgcatcccggatgacgtcgccgtcatcggccacgataactggtcggtactgacctccagctcgaggcccgcactgacgtcgatcgacaacgaaaccgaaaccatcggacggcgtgcggcacgatacttggtcgatgccatcgacggcaacccgcatcacggtgtcgactacgtaccctgccaccttatccagcgcgaatccaccctcccgctggactgataccaatcgataccctaccgcttcttggttttgcgcccctttaagtagatgtcgatgacgatccatacgccgagggcgaaggccacgacgtagcccatgaagccgatgaccggaatgccgaagataatcggcttcatgccggcgtagtagacaatcgacgagccaacgaacaaaccgaccacaatcagggccatcgtcagacgattcaccatatccgaaagcagctggaacggctcttcggagccgaccagttccatgttgacgcgcaactgaccacgggtcagcatacgggccacggtcttgagttcggtcatggtgccgagcgtggcatgcaaagcctgatgtccctcaacgcccagcgacttgatctcgtctttggtggcgttcttcagcgatttcgacgtggcgatatggtcggaaatgatttcgatcatattcacatcaggaatgaactcgtccagcaagccttcgagcgtaaccaacgcgcggccgacggtggtcaccgtactgggcacctcgatgttgtggcggccggccatctgcgtcagtgcggtcaggaaggcggcaatgtccagttcggccagatccacagtgccgaattccttgacgatcacgtccagatcagccagcagtgctgggtagtcctccggatcggcctcggtgccggcaaatcgcagcagcccctcggccagagcgggcgaatcctgtttggcgacggcgaaaatcatttctttgaggactgcacgggtgcgctggtcgagccgaccggtcataccgaggtcgataagtacgatctggccgccccggatgatgatattgccgggatgtgggtcagcgtggaagaagccgtcgtcgagaatctgcgtggcgtaattgtcgacgagcttggtgccgatctccttcaagtcataaccagcatcgacgagccggcccgggtgggagacggagatgccgtcgatgtactccatgaccaccacatgctcggtgcacagttcggtgtacgccgtcgggcagtccatgtatttgaatcgggcggcgaaacgcttgaattcggcgaggttgcgggcctcaatcagaaagtcagtctccgattcgaaggtgtcccacagctcctcgaccacgcccttcaggtccacgatctgtgaggtgcgaatcaccttagtggcggccttggctatggagcgcatgatggagacgtcctgagccatggtttcgcgcacacccgggcgctgcactttaatggccacatcttcgccggttttcagcgtggcgcgatgcacttgcgccagtgaagcagagcccaacggcttgggatcgatatgcgcgaacacctcgtcggcgggacgcccgtattcggcggcaagcacatccaacaccgtggaatacggcatcgggtcggcgtcggcgcgcagtttggcgagttcgtcgcagaagctttgcggcagaatctcggagcgcatcgacagaatctggcccactttgacgaacgtggggccgagcgcctcgaacatgaggcgcattttgaccggagtcaggccgtgcagcacgtcgaattgctcgacgattctggtgatctgccccagtcgtttgatcttgccacggcgcgtcagatggtagcgcgtggcgaaatcgttcctgcgtccgaacagtgccagcgtttcgtcggatacgctcggagtcgccttggtaacggtctgcttgagcgtgtccgacgtgtcgacggaccggttcgccgccgcctcacgttcggctttcgcaggcgtcagaatagggtcgaccctgctggaaagcggggtcgaccctgattccggcgtagcgcgtgtgggcttggtcactcggccttgccctcgtcagcgggcttgtcggcggcactggtgtcggctgcggcagcagctttgtcgccggcttcggcggcggccttcttggcgtcatccaccgtctcgctcaccttgcgcttgagctcggtgttcagcgccttgccctgctcgaccgtaatctcacccttcttgacgagttcgtcgacgagctcgctgctcttctcgtatccggtggcaagggctccgatgcccgccagcaggaccttgcgcaggccatcacccagaagatcaaaatcagccatgatacccctccttcgaggtccgacatggcctggtgccatgtctcgtaccaccaagcctagcgcaaacaacagggcaatgtactagaccctcagactgatttcgactgatttttcgctgattggtacttaccgaggactcaccgagaattcaccgaggacgttcggcggcagccttgcgcgcgttggtggctacttgatcgagccgggcgagctccttggcttgttcgggggtctgatcggacgtatcgaacgtaccgtaacgacgagtcacggcagtttcgataaggaaatcgctgatggcggggtttttaggcagcaacgagccgtgcatgtaggtgccgatcacgttgtgcacgcgcgcgccctcggtatggtcttcgccattgttgcctcggccgtcctgattgacggtgccgagtggctgaacgccttcgcgcaggaaggtctggccggagtggttctcgtagccaatcacatcgccgaactggtcggaatgctcaacaagattgccgatcatacgcacgttctggcccacggtataagcaccgataacgccgatgccgtccagacgggtgccgtccacggtttcaaagtactcgccgaacagctggtacaggccgcagatcatcagcatcggcgtaccgtctgcggcaagcgaacgcaacaggtcggcgcgatggtagaagtcgtcgatgattttcttctggccggtgtcttggccgccgcctcccagaataaggtccacctggtcgggccagtcgtcgccttgattgtactggtggacgaccggttcataaccgtacagttccagacggcggcggatagtcagcacgttgccggaatcgccgtagatgttcatgtctttgggatacagggacaccacatcaattgttctggccatgtcacgttctccttgtcgatgtcttcccgctgacgggaagcgtcttattcctcaccatgtcctcccgcaggcgggaggtggcgcgcgggcgctagaggatagttacttgcccacgcccgcgtcccatacttcggtgatgcggcccagtacggcgcgggttttgagcatggcggtgtaggtgcagtagatgtgcttgcgtgtgccgggattggcgttgacgaatgcggtgacggcctgttcgaggtcggtgttcgtatcggcgactggcacttggtcataccccaggcgcaatgccatgtcccaggcacgcacgccggagaccatggcgacaccggacgcgcgcagggaagtgaagtccacgtcccacagccagctcatgtcgcggccgtcggcatattcgtcgttgatggcgatcatggtgtccgcgttggccgggtcgaagctggcgagcgagaggcggaagcccatcgggttcttgaccagcagcagttcgaccggggaaccgttgacgtcgatgacctcgccacggccgaaagccggcgtgacgcgggaaacggcggcgataagctcgtcggcggacacggcgcaggcgttggctgcggcggtggccttggatgcggcggcattgtcttgcatcaccgcacgtaccacagcgagcgcggcggccgcgttgtacaggttgtagacgccttcaagcttgacgtcggtggcgtagccctgaccgtccatctggaaggtggccttgtggtcgcccacggcggtaagtgtcacgtcggcgggaagttctgccgtgcctgcggaagctcctctcagttcgcttcgcggactgagaggagttctggctgaggggagcggcccggccgcaccttccaccgacacggtcgtggccatgtcgtcatcggacgggaaatagtggcgcaaatcgtcggcgaggccgaagtatcgcacggtggtgccagccggggccttcgcggcgagcgcggcgatacgcgggtcctcgcggttcagtaccacagtgccggtagtcgccgcagccacatggctgagcagtttggccgtggtgtcgatttcaccgaatcggtcaagctgatcgcgcatcacgttcagcagcaatgcataacggggcttgacctgcttgacgaagtggacggcgtacgcctcatcgagctcgagcacggcgatgtccgcgtccaatttgccgccgagcgtgacttcggtaagcagtgcggagaccacgccgcgcacgaagttcgagccggtcggattggtgaacaccttcagccccagatcggagagcatcgaggcgaccatgcgggtggtggtggtcttgccgttcgtgccggacaccaataccacgccaagcggcaactgcccgagcgtacgggtcaggaagccggggtcaatcttttctacgactttgccgggcaaagccgaaccgccatgtttggtgacgcgggatgcaaaccgcacgaagcggcctgcggccacggtggcgaacgcataccacggtttgcaggtctgcaccacggacgattggtcttgcgaaacatcgcgtgaaacgttgcttgccatcatcacaccccctgattggcgttgtagtcctgcggcatgtctttgaatttggacgtggcaccgaggaaggcgaggtggaaggtttcggtcgggccgttacggtgcttggccatgatgatatcggcctcgccggggcggtcttccttgtcgtagaagtcagggcggtggaccaggaacaccacgtcggcgtcctgttcgattgagccggattcacgcaaatcggagagctgcggcttcttgtcgttacgcatttccgggccacggttcagctgggaaagggccacgaccggcacttcgagttccttggccaagagcttcagggcacgggagaattcggacacctcttgctggcgggattccacggccttgcccgaggtcatcagctgcaggtagtcgatgactacgagtttcagatcgttggtctgcttcagacgacggcatttcgcacggatctccatgaggctcatgttcgggctgtcgtcaatgaacagtggcgcgttctgcatcttggtccagaactggttcagggtgttccagcgttcgggggtgatgtcgtcggcgcggcgcagggcggccatcggaatattggtttcggcggagataatacgctgagcgagctccaccttgctcatctccaagctgaagaccacggaagtcatgttgtggtgcaacgcggcggcgcgggcgaagtcgatgccgagcgtggacttacccatggccggacgtcctgcgacgacgaccatctgtccgggctgcaggccctgggtcacgtcgtcgatgtcgcggaagccggtcggcacgcccttgttgacgaggccttgctgcagtttgtccagctggtcgagcgcgtcgtggaccaccgggccgatggcggcatagtcctgacgcaccttgcccatcgacatctcgtagatctcggactgggcgaggttaaccacatcctcagcctgcgatccctcggcggaataaccgagctgggcgattttggtgccggcggcgatcacattgcgcaaaatggcccgctgatggacgatctccgcgtagtacatggcattagcggcggtcggtacggatgcgacaaggctgtgcagatagtccgcgccgccgaccttgtcgaggttgccatccgccaacagctggttggccacgagcaccacgtccaccggctgactggcggaaaacagatcgatgatcgcgttatagatcgtctgatgcttgggctggtagaaatcggtgacgtcaatggtctgcgagacctcgccgatggcatccttactcatcagcatgccgccgagcacggccatttccgcgtcgtcatcatgcgggggcacgcggtcgaaaatcgggtcgccggccgccgccgacgtctgcgtgccgccccggcccgcgcggtcgccacgatcgccacgatccaggccaccgccgaacccattctgatacgagtgttcacttccttctggcatagcctccaagtataggatgtggcgtggcaggtgaacgatatcgtatggaaacgaaacggttgcccgcatcggttcattccttattcacctatgagtcagcgccacgacacgcagaaagcaaaatgtggatagaaaaataagttatccacattttggggataattctggggataatccactaagttatccacatactggggataacttggtggatagtctggggataacattccgcgcccacaacaggtgcttgcgcaacgcagtcaggcgtgatatgcgtgtgagcgtgcccatagactcttccgacgccaaagccaccagttccggcgatactacacgccgcgatggcttcggcaccccgcatgccggcgcaaacacaaacgtcagcaacggcccgaccgacgcccgctccaccaaccgccggatcatggcgctggccctgccgaccttcggccagctcatcgccgaaccgaccttcatccttatcgacacagccatcgtcggccatatcggggatgcggcgttggccggcctgtcaatcggctccaccatcatcctcacggcagtcggactatgcatattcctggcctactcggccactgcgcaggtggcacatctgctgggagcgggtcgtcgtcgcgagggactgcaggcaggcattgatggcctgtggctggccttgagcatcggcaccgtactgggattgggattgttcgcggctgccgagccattatgccgggcactgggcggtcagggcgaagtattggaacaagccgtgacctatacgcgcgcaatcgtgctgggtgcgccaggcatgctgatggtatatgcggcgaacggcattttccgaggattgcagaaggttcgtatcacgctgatcgctgcggtgggcggcgcggtggtgaacacggtgcttgatgtgttgttcgttattgtgctgaattggggcattgccggctccggagtggcgacgctggtagctcagtggttcatggggctgttcctggtaatccccgccattctgtggtcccgggcggatggtgcgagtctgcggcctcgtttggccggtattgcggcagccgggggcgacggactgccattgttcattcgcacattggcgattcgtgcggccatggtgactacggtcgcctgtgccgcgcgcatgggtactgccgtgttggccgggtttcaggccgtgaactcctcttggaattttgcgatgaacatgctggattccgtgggcatcgccggccagacgctggtggccacagcgctgggcgctggcagcgtgcagcaggcgcggcggctgacgcgggcgaccgggcgtgcgggactggtcaccggcgcggtaatcggcacggcttttgcggtagtcggcctgttcgccgggcacttcttctcccctacgccacatattcagacgctgatcgccgtgggcatggtgacgatgggcatcttcttcccactgcaaggctggatgatggcaatcgacggcattcttatcggcgcgcgcgactaccgctatctggccgtcacatgcacgctgaccgccgtggtgtatgtgacgctcatactcatactggccaatatggtgacgccggcgctgacgagcgacctgatgcgtaccgccgtactctgggccgcgttcaacgtggtgctcatgggtgggcgcggtctgtccaacggactacgcgtgcgctcggacgcatggatgaggtaggtatcggccgcgcgaagcgctgggcgattccgtttacatagcggcgcgggcggcggaatacatgccgcggacgatttgttcgcgccacttggaccagccgtattgcttggtgatggtctcaccggcggtggcaccgagcgaggagccgtcggcccgggtcaggtcgaacagcatatccagcagcatcttgtcgtggtgcaagcggtcggccaactcctccgccacggccggatcataggggtccttacccgtggcaaattcggatagcgtcaaatgctcacgcaccagcacggtagcccagtcgacgatgtccggcgcgtagcccatacgcttgagaatcaccggcacatggcgggcaccctcggcggcgtgatcggccacgaacgcgcgcttgccgatgtcgtgggtgataccggccaacagcaatgccttgaaatgatcgtcatcgtaccgtccaccggacggtgtctcacgacccagacgcgacgtgacctccaccatatgccgatcgatggtgtaccggtgggcggccgaggcggacggacggttgcggacgccgagccattccggcatccatcgacccggaatgtccacgaaatcgatgctctcccacacttccataagattcgatccgcacgcaagcagacggataaacagctcgcgcgattcgtcatcccactggttgtcgtgaatcgggcagcgcttcagattaaccaaggtagacgggttgatgggaagaccgaattcgccggccgccacggccatacgcaacgccagcttggcatccttggcaggctcggcaccgggcgccaacaccaattcgccttcgtgcttggccacgccgggagccaccacgtcgaattgcggggcttcgcgcttgccaccagagcgctgagagaacatctggaagaacgcgaatcgcggcttttcgtgggtcagcgaatgttcggcgcgggaagcggtggaatcaagcgagaaggagatgcgccgaccgatacgggcaagcagtgtctgcagatcgtcgatcgagtaggcggcacgctcgttttcgggccaagtcggatcggcaaggccaagcatggcagccactttggcctgatagggcgtcagcatcaggttggtatccttgccggccaccagatggatgcagtcgcgtacgtcgagcagacgttccacagcttcgtcgtagatgccgtgcgggcggtcggccagccatgaggcggcgagcgcggagacgagcaccgaatcgcgcaaccccccacgggcctctttgatgtcgggctgattgacgtattggagccggccgaattcgtcgagtcgggctttggcggagtcgagcagttcgggcaggcgcttgcgggcggccttgcgccagcgttcgaggatggacgtggcggtggtggtgatcagagcggtgtcgccggcgatgggtttcacgtccagccagcccatggcggcgggaaggtcatggtcggtgacttcctcgcattgggcgcgcgtgcggatggagtggtcgaggtccagaccgctgtcccatagcgggtaccagagtttgttggccaactcgttgagctgctggtcgctcaacgtgcgaggctcgtagatgatgaccaggtcgaggtcggagctggggcccagttggccacgtgccagcgagcctaccgcggcgaagccgatgccggagtcgggcacggggaaagagacatccttgcaggccgcattccacagctcagtgaggcattgcatggccagttctgtgcgggctttgcgcttggtcgcaccattccggtagacgccgtcgtcatccggctggctcatatccatgaatcgttgtttcaagccatctactgctgaagtcattgcttcatctttcattgctaaaaaaagtccccgcacggcgtcaattcgcggcgtgcggggacctttcctatgcagtccatccccttctaagcatggacgtctgtgttatcagatcgcggcggaaccggtctcaccggtacgcacgcgggccacggagtccagcggagcgacccacaccttgccgtcaccgatggtgccggtgccggcggacttgatgatcacaccaaccagcgtttcggcatccgcgtcatcggacagcacttcaacgcgaatcttcggaatcaggtccacagtgtattcagcgccacggtagacctcggtgtggccgcgctggcggccgtagccgttggcctcggacacggtcagaccgtgcacgccggcggccgcgagggcctccttgacatcgtcgagcttatggggctgaatgatagcggtgatcagcttcatttcacttcacctccttgagaacggagctggcagtaccagcaaaatcgtaagcacgttcgccctggtcggcaagatcgatgccgccgacttcctgggcctcggtgacgcgccaaccaatggtcttctccagagcgaaggcgatgatcgcggtgatcactgcggagtagaggatggcgacgagagcgatgaccagctgaacgacgagctgcttccagtcgccaccagccagcagaccggtgccttcaccgaagaagccgatgaggatggtgccggtgaaaccaccaacgccatgcacgccgacgacgtcgagggagtcatcgtagccgaacttgaacttgagaccgcaggccaggcaggtcaggacaccagcgatggcacccatcacgatggcccacagcggggagaccacatcggcggccggggtgatggcaaccaggccggcgaccatacccgaggcggcacccatggcggtgtagtgaccggagcgaatcttctcggtgaagccccaagagagcattgcggctgcggtggcggcggaggtggaaacccaagcgtagccagcagtaccgttggcggcgaaggcggaaccagcgttgaagccgaaccagccgaaccacagcaggaaggcgccgagcatcacgaacggcacgttgtgcgggcggaacggctgcgtgccgaagcccttacgcttgccgatgatgagcacgatgatcagggcggcgactgcggcgttgatgtggacgacagtaccacctgcgaaatcgtgggcggccgcgccgatggccttggagatggcgccgtcagcagacagcagaccaccgttccagaccatgtgggccataggagcgtagtcgaaggtgacccacagcgccacgaaaatcatccaggtgctgtacttcacacgctcggcaatggcgccgcagatcaggccgacggtaatcatcgcgaaagcgacctggaaggcaacgtccacggaaaccgggtagttgttgccgttcagaccggtggcggtgaacacgccgtcctgggcgaccatggagtccttcagcaggaagccgctggccgggtcgccgaagatgcctccgatgtcggaaccggcgtaagcaatcgaccaaccccacagggtccagataatcatggtgaccgacagggcggccgcctcaagcatcagcatgttcaggacggccttggcacgaaccataccgccgtagaagaacgccacaccaggcgtcatgaggaaaaccaaggacgcggatgtcaggatccatgcggtgttaccggaatcaatcgctcccatgtctacctccctctctttcgttcagggcaccgggggctttgcgcggccggcgtcgactttgtctctacaatgccgtcccccttgtgggggctaacagttcgtcagtaaaagccggtctcgttttggtttcgttacggcaagttacgcgattgttaagcgcacctgacagttaggttggcatcggatgggctgattccggcatgattccaacggatatgggaaagccccgaatcatgtttcgaatatgcttcggggctaggtttggtgcgttgcgggcgtttcccgcgcccacaacgtggacggacgcagggctcccctcgctgaggggagctgtcgagcaaagcgagactgagaagaactcgaccgtctacgcgagaatgccgtccacgaaaccttcgggatcgaaaggtgccaaatcgtccggaccttcaccaagaccgacgagcttgaccggcacgccgagctccttctgcacgctgaccacgatgccgcccttggcggaaccgtcaagcttggagagcaccacaccggtaatgccgatggcttcggcgaacaccttggcctgggccatgccgttttggccggtggtggcgtcgagcacaagcagcacttcatccaccggcaggttcttttcggtaacacggcgaatcttgccgagctcgtccatcaggttcgacttgttctgcagtcggccggcagtatcgatgatgagcacgtccgcgttcgcttccttggccttggcggatgcctcaaaggcgacggatgccgggtcggcaccgtccttgtcggagcggacgacgggcacattgacgcgtgcgccccaggtttcgagctggtcggcggcggccgcgcggaaggtgtcggccgcgcccatcatgacctgcttgttttcggccacgaacagtcgagccagtttgccggcagtggtggtcttgccggtgccgttgacgccgaccatgatgatgacgctgggcttggcggcacccggcttttcggcattgaggcggcggtccgtatctcgaccgaccagatcgagcagcttctccttgagcgtggcgcgtacttcggctgggtcggctttaccagtgatgcgggcgtcggttctcaggtcatcgaccagttgggcggaagcatccgcaccgacgtcggcaagcagcagtgtgtcttcgacgtcttcccaatcggcctcggagagattgtctttggcgaggatgtcgaacagggccttgccgaacgggttgccggacttggcaagttttgccttgagtcgggtcagtcgagagccgaccgattcgggggtttcaggtttggcgggagtgggcttggaggcaggttgggactcgggcttgggcgcagctgccggttcgggttcggcctgcgcggctggcgcaggctcggctttggccgattcggctgacttggccggctcggcggcagtcgcagccttagcttcctcggcttcggcggccagccgagcgtcggcggcggccttggcgtcgcgggtcttcttgttgtcgggggcaaccttgcccatcgcacgatccaaatcgcgcttgcgggacttgcccaaccagatgctcagggcgattacgataaccgccgccacaatcacgccaagaacggcgagcacagtattcatatccatacctgtcaagtctagcccgcagatggaatcccctacgaattcggcagtctcaggccgacaattccacccggcgacttaagctgaaccgcatggcacattcttcacgtatgacgtcgctgcagcgccgcgagcagctgattgaagtcggacgctcgctattcgccgccaaaggcttcgaagcggtaagcgtggaggaaatcgccgcgcacgccaaagtctccaagccgattgtgtatgagcatttcggcggcaaagagggcctgtatgccgtcattgtggatcgtgagatgcgcgcgctgaccggtacgctgaccgccgcgctcgacgatccgaccgtgcacccgcgccagattgtggaacgcacggcgcttgcgctcctcacctatatcgaagagaatgccgaggggttccaggtactggtacgcgactcgccgagcaccgacccgtccggctcattcagctcgctgatgggagacatcgccgtacgcgttgaagacattctttccgaaacattcaaacggcagaagctgtctgccaagggcgtgccgtactacgcgcagatgctggtgggcatgaccgtattcaccgggcagtactgggccgaccggccaaaggtgagcaaggagcagctggctgcatacattgtggatttggcctggcatggcctgagccggcttgactccaagccccagttgttctttgagggcgccaaggcgcggaaggaggccgagcgccgagccaagcgcgagtccgattccggcagcccggattcagaccagacgagttctgcccaatcggatcccgagcacgccaccggggaagattcagggttgcagaacatgagttcaggggcacaggttacgcaacactctgccgagtcgggagacgaagtgctacggtttgaacaggaaactgaacataacgactaaatatgtgaggacgtaagactttcatggccagcacggcaaagacgctcacctttgtgatccccgcatacaatatggagtcctaccttgaccgttgcgtgaactcgctgctttcggcaagcgacatcagcgacctcgaggtgctgattgtggacgacggttcgaaagacggcacgctggagtacgcgcgcaagctggaacgcaccaatccgggcgccgtgcgcgcgattcatcaggagaacaagggccacggcggcgcggtgaacaccggtatcgcggcggcgaccggcatgtacgtcaaagtggtggatgcggatgattgggtcgacccgcaggccatcgacacggttctggccacgttgcgtgcacagcatgacaccgacgaaccgattgacatgctggtgaccaattacgtgtatgacaaggtggccaagcgtcacaagaccgtagtgaacttccgccgtgtaatggaggccggccgcgtgctcggctgggatgacctgggcaggttcggtctggcgcagtacatcatcatgcatgcgctcaccttccgcacgcaggtggtgcgcgattccgggctgaagctgccggagcacacgttctacgtcgatttctattactcgtaccagccgttcccgtgggtgaagcgcatccagtacctcgatgtgccgttctaccactacttcatcgggcgcgagggtcagagcgtgcagaccgacgtgatgattaagcgtgtggaccagttgcggctcgtcaatcggctgatgaccgaggccacgcccgaacgcggtacggtgccggaggggctgtaccggtacatgattcacttcctggcgatcgaatcgtgcgttacctcgacgttcctgattctctcgcgcgatccggccaactacgttaagaaaaccgagctgtgggatgcgattgacgcctattcgccggccatcggcaaggatgtgcgctcgcagctgatgtcccgcgcgctcaatctgcccggcaaaaccggccgctggatcgtgcgcaacggctatctcatcgccaaacgcatcgtcggctttaactgattcggattgtggttttgccctgctgacgcgttatcagcagggcatccctattacctccccagtcgaggttttgctactcggcccaacggtcggacatcgcgaagctgttgtgcatcaggttgctggaggtgtatagcacgtcgttcagcagcttggttgtgtgctcgcgcaggtagtcggccatctcgtcgttggccgcttcgagcacatccgccacgccctgcacatccttctcatcgccgtggccgccatcgagcggccatgcattcgtatccgtcgattcggcatcgcttcgagcaagcaactgctcatccgtgcgctcgatgagccggtgtccgaacgcgcgcacgccctcggcatacccttcgatgaaccggttcgtctcataccagtgtgcgtcggccacgacggcgatcaggcggttcgtccaatacaggttgccggtggagacttcgggcgtggtgtcgcgcaggtaggcaggcgtgtcgttgacgttcgcgtagaacggcgcggcggcggtgaacggaccagagccgaacgatacccacatcaccgtgcgattggccgccggcacatacggacggacctgaatcgccaccatatggccggtgcggttcacgccgatcggacggtaacggtggcgcgattccgccgtgccggtcgtgccgtacgggtcgtacggcgtgccttcgaagtgcgaggacagcaggaaatcaacgtcttcgaggctcaccttgtcttccggcacgcggcaccacgggatgtcgtcggattcgggcgtgtagcgggcggccggcgaatcccagtcctcgctggggttgaggcggcgttgcatgtaccaggcacgcggcgtgttgtagatatggtccttcggcgtcgcggtgccgaaggccttgcgcgggttgaaacgggtgggaagggcaacggttgttccgaatccggcgctatgcgcgtgacggccgttggaagagaccggcgttcccattgtgcggtcgaggtgatgcgtggccatgaactcgcgcaggtcggcgctgcataggtattcgcgctgctcgccgaacgcatcggcgaggtcgaagtcgtcgatgccgagctggttggggatcgtggcatagcagtcatcgggcactcggcgggcgatccaatggtggccgccgatggtctcgacgtaccagatctcgtccacatccgaaataatcacgccgttcgattcgtaggtgccgtaggtttcgagcagttcgcccaaccgcgcgacgccctcgcgcgcggtggtgacatacggcagcacaagggtgatgatgtcttcctcaccgataccgccgggctgctcggcctgataatcggtgctgtccggttcgccgacagccggccgcaactcgaccatcgggtccgcaccgagcacgcgctcgttgacagcgatggtttcggtggcgctcatcgccacgttgtgttcgttggcaccggcttcggccagaatgccacgattattcagcacgttcggtgcgatggtgtaccggcaaggattgtccggtagttcgatttcgacatggctcagcacgctgcggtagtggcgcggctggtcgtcgggggcgacagcgacgaagcgcttgggatcgtaacggcccgagcccgaatcgtcatcgcgggcgatgatggtggaaccgtcgtaactggcatttttgccgacaagaatcgtggtgcatgacatgggacaccactctaggagccaggctggtcgaaacaaaaaaatccttggaaccattgcgattccgaggatttgttgtgccccctgtgggattcgaacccacaacccacgacttaaaaggacgctgctctaaccgttgagctaaaggggcaactcttctaaaatacacaccgttttgggatatttcaactacggcgttgcgtacacgtttgcgtacgcgattggcccaacgcacggcacagcacacgcaatgtggcccaaatcgcagcccaaatcgcatatcgcctctagcgatagatagccgccggcgactacccttgtacattatgagtgaatcccccaattggagcaatcccctgcgcgactcgcgcgacctcagactgccccgtatcgccggcccatgcagcctcgtcattttcggtgtcacgggcgatctggcacaaaagaaactactgccagccgtctacgacctggcgaaccgtggcctactgccgccgagcttcggtctgaccggtttcgcccgccgcgactggacacaggaacggttcatcgaattcgtcaaggccgccgtccaggcgcattgccgtacgccgttcaaggagtcgacttggcgcaatctggccgccggcatccgcttcgtgcagggtacgttcgacgacccggaggccttcgagcgtctgagcgccaccgtgcaggagcttgaccgcgaccgcggcacgcagggtaaccatgccttctacatgtcggtgccgccgcgcgcattcccacaggtcgccaagcagctggccgcctccggcctgtcgcgctcgtccgagggcgcatggcgccgcgtgatcatcgagaagccgttcggccatgatctggccagcgccaaggaactcgacagcgtggtatccgaagtgttcgacccgagctccgtgttccgcatcgaccactacctcggcaaggaaaccgtgcagaacctgctggccctgcgtttcgccaacgccatgtacgagccgatctggaacgccaactatgtggaccacgtgcagatcacgatggccgaggacatcggcatcggcggccgcgccggctattacgacggcatcggcgccgcacgcgacgtcatccagaaccacctgcttcagctcatggctctgaccgccatggaggagccggtgagcttcaccgccaaggacctgaccgccgaaaagaccaaggtgctttccgccgtgcgcctgcccaaggacctcgccgccaacaccgcgcgcggccagtacgccaagggctggcagggctcgcacgaagtggtcggctacttggaggaaaaaggcatcgaccccaagagcaccactgaaacgtacgccgccatccgcctcgatatcgacacccgccgctgggctggcgtgccgttctacctgcgttgcggcaagcgcctcggcaagcgtgtaaccgaaatcgccgtggtgttcaagcgcgccccgcatctgccgttcgagcagaccgccgtgcgcgaactcggcaagaacgccatcgtgattcgcgtgcagcccgacgagggcgtcaccatgtgcttcggagccaaggtgccgggcggctccaccatggaggtccgtgacgtgaacatggacttcagctacggccgctccttcaccgagaactcgccggaagcctatgagcgactgattctggacgtgctgctcggtgatccgccgttgttcccgaccaccgaagaggtgaacctcagctgggagatcctcgatccgattgaacaattctggtccacgcttggccagccgcaggcctaccgcgccggtacgtggggtccggcacaggccgacgaaatgctggcgcgcgacggccgccactggaggatgccatgatcatcgatatgccgaacacccgcacccgcgagattgcgcacaaaatcgaacagctgcacgaggagcgcggcgaatcggcgaccggccgcgtgctgacgctgctcatcgccaccgaggacgcggacctagagcatgcgctggaaatcgcgaactcggccagccgtgagcacccgtgccgcgtgattgccgtagtaccggataccaatcctgccgatcagtccggcgaaggcgaaccgaacgcggccgaagtggccgccgaggtgagcgcgagtcgcgataatccggccgtcgatttgaccgacggcccgaacgatccgaacgattccaacctgaacgcccaagtgcgattcggcgcggacgccggtgccggtgagatcatcgtcttgcgtccgcgcggtggccttatcaaccacccggatacgctggttatcccgctgcttgtgccggatgcgcctgtagtggcgtggtggccgaccacaccgccgtcgaacccggccaaggatctgatgggtgcgatggcccgcagtcgcatcaccgacgcgttgcactccaataatccggaggccacgattgagcgtttgcgccgcaattggacaccggaagatatcgacttgtcctggacacgactgaccgtctggcgcgcaatgctcgcctcgatgctcgatcagccgccgcacctgcccatcaccgccgcgaaggtgaccggcaaggccgacttcctgcctatggaaatgctgtgcgcatggctgcgtctgaaactcggcgtaccagtcgaaactgagttcgtgcccgacgcgcaggccgtgaccggcgtgtgcctgacccgtgaggacggtgtgatctcgctggaacgcccgtatgaggaccaagcgctgatctcgctgcccggccagactccgcaggaagtgtccgtgccgatgcgcaccatcgaggactgcctgaccgaggaactgcgtcgcatcgatcccgatgagatctacgccgaggtcatcaacgaaggctgggatctgattcgtcactgaagtcggtagaacccgttgccacagcggcgttggaatgagttcggcaattgtggccgagccatgccaacgccgttgctcatcgtttcctacctcatgcgatgccgaagctcatgcccgcggagtaataaagtgacatatgcgatgtcgcacaatgtggattgtgttgtcaactgacaacacaatccacattgcaaagtacgacacataccccatacaaggaccatacatggcaactcgaaaactcattgtgtatccgaataaagatctgatgattcaggctggcgcgcaacgttttgtcttggcgctactcgatttgctcgccgaacgattgcctgatggcacgcatcgcacgcgtgtggatgtggcgctgtctggcggttcggccgcgcagccgctgggcttggtgctgaacgatccgctggctgacgcgattgattggtcgcgcgtgcatttctggtggagcgacgaacgttttgtgccggcttacgacaccgatcgcaatgctttggaggcccgtcgcctgctgcttgaccagctggtggcagatggcaagctgcctgagtcgaatattcatgagatggcggccgatacccgttcagccgatgacatcgccgatgtgatggatcaggccgacagcgatgatgcttccgttcgcgccgccgccgatgccgcgaatgatgcgttgctggacgatgtcgcgagcgactatgagcgcgagttggtgaatgaattggggccggaaccggtaatcgatctgatgattctcggcatgggaccggacggtcactatgcgtcgctgttccctggtcatgatgaggtcaaggttactgataggctcaccgtgggtgtgaaccactcccccaagatgccgccgctgcgtgtttcattgaccgcgccgctcatcgcgcgttcacgccatacgtggttcttcgccgccggtgccggcaaagccgaatcgctggcccatgtcttcgagcagcccaacaaaccggattacccgtcctcctacgccaacggagtggacgagttcatctggttctccaccgaagaaaccgtcaccgagttgtgagtgaattaagccccctctgatgagggggcttaattcgtctatggctacgcctcaatctcggacttgccctcttcgccgccggcccctgcaattagggactcgcctgcggcgaggctcagtgttggctcggcggcatagccgcctcgctccgaagagggccggggagcccaccgggctcccctaagcccgagatcgcgaggctacgcctcgatctcgggcttgctgttttctcagctcggctatcgccgagcctgaagaaggccggacagcccacagggctgtcctaaacctgaaatcacgaggctacgcctcgatttcaggcttgccttcttcagcccacagcgtgtggaacacgccgggcttgtctacgcggccgtaggtgtgggcaccgaagaagtcacgctgggactgggtcagagcggtaggcaggcgcttggagcgcagaccatcgtagtacgccagggagctggagaacaccggggtcgggatgccggcctccaccgcgcgaacgatcacgcgacgccatgcatcctgcgattcgccgatgatcttctcgaagtacggatcgaacagcagggaagccggcgggttatcgcccctgaaggcctcggtgatgcggtcgagcaggaactgggcgcgaataatgcagccgccacgccaaatgcgggccacttcggacaggttgatatcccagccgtattccttggcaccgtcctgaatctcgttcaggccctgagcataggccacgaccttggaagcgaacagagccttgcgcacgtcctcgacgaacgcggccttgtcttctccggccagatcgatggtcttgttcggtccagccagaccttccttctgagcgtcttcacgcagctcaccgtgcgaagacagtgcacgagcgaacacggcttcaccgatggcagccacaggagaaccacattccagaccagtctgcacggtccacgtaccagtacccttcatgccggcatgatccacgaccacgtccacgaacggcttgccggtctcggcatccttgtggtgcagaatctcagcggtgatctcgatcaggtaggagtcaaggtcgcccttgttccattcagcgaacacgtcgccgatctcctcggcatccatgccgagtccacggcgcagaatgtcatacgcctcaccaatcacctgcatatcggcatactcgatgccgttgtgcaccatcttgacaaagtggccggcaccatcggtgccgatgtgggtcacgcacggttcgccgttcaccttggcggcgatggactgaagaatcgggcccaaggtcttccaggattccgcagtgccgccgggcatcagagacgggccgttgagcgcgccttcctcaccaccggacacgccgcaacccacgaagtggaagcccttggcacgtacttccttctcacgcttgatggtgtccttgaagaaggagttgccaccgtcgacgatgatgtcgcccggttcgaacacctcttccagctgcgcgatggtcgcgtcggtcggagcaccggccttgaccatgatgatggcggtacgcggacgcttcagggacgcggcgaattcctcgagcgtttcggccggcacgaagttgccttcggtgccatgctcgttcatgagcttctcggtacgcgagtagtggcggttgaacaacgccaccgtgttgccatggtgcgccagattacgcgccagattggagcccatcgtggccagtccaatcacaccaatgtttgctgtagcttcggccatgtgccttgcctttcgtttgattgtcccatcgtcatcacgcgcgtcacaaaacagcgcatcagcggagggaatcattccttcaacgcttgaaagtgtatcccgcttaccacccacacgcgagggctgtcttaggttctacgcaccttctgcccgcgaagcgtaattacttgccggccattcacatacgcccggccttggaagggtcgatatgcatggtctggaagcgattggccatgtaagcgtcgctgtagcgttcgctgaaccacatcgcgaccggtgaatcctgcggctggccggccatgcgcccataccagcaatccaaggccatcagcgtgaaggcaatgtcgatcaccatcagcaccgtgcataccgcagtcagcgaataccgcactttccatggaatgcgattaatcagagccagcagtcgcggtaacagccacttgacccacaccacaccaatcagtccccagaagaacatgaattggcccgaagtacgtccgtcgatggacagccaacggccggtgtaatcccacgcggtaataccaaacgccgcttccatgaaccagctggtgcaatattcgaacgcgccgccgatcaccgccgaagcgcagaaaatcaagaacggattcgccttccacagacgattcaggcacatggttaccaataccgcaccacagccgtaaatcggcgagaacgggccccacagcaaaccagcgcggtcctgaagttcaccgttatacagcgccatatggtagatcgtctccacaatcaggccacccaccgaagcgatggtaaacagccagaagatattgaaaaagtccagcgcaatatagcccttgccggactggtcgcggcctagcatgccggccgccacagccgattcataatcatcgcgatcgtccatacgcctgagcgcgcgctgcagacggcgttcctcgctcagggagggatcggcggtcaccgaaatcacgacgagaataatcatctgaatcagcggcagcagcaggttgaagccaaggccggtcagggccagcgacagcatgccgtcggccaacgtcaacggcatcagcacgtaggtccagcgcgcggcataccggcgatgattgcgcagcagcatcacgccgagcacaatcaggcatgcggcactgactaccagcaccaccgcatgaatcgcggacaggatgaaggtcaggctcatcgcatcgacgtgcacatgaccatccagaatctcgcgcacggcatagaggatggaaatcaccataatcggcaatgtggcgagtccgtccagcagcacgaccgcgccatagatgcgcgccagaatcggtaatcgcttggcgttcaggttcaagccggcgtcgtccagttcgacggccaccagatcggccacgactgcggactcggcgtcacggttctcccgcggcttgccgggggtagtggccgtgccatcgtccttgaattcaaccatggtttcctccccacatagcgtcccctcaccctatcacccgattgcggttttgctgaacttgatgggcggtcggtacatgtctgtctacattgccgagcaccgagcctatccatcgcgttcaggaaacgtccaaaaaccatccagaaatcttgtcaataagttccagaacgcctttcgctctgcccagcgacacacgataagccgctgggcagcggtgttattccgccaaaaacatcatcaatcaccccattaatctccggcagccgtattacgctactacaaacgtagcgctacgattaacgtatcgctacggaaaacgtagcaaccaagcaacaccaagctccggaggtatcagtgggcaatatcttcaaggtcctcagacgcgacttcctgcgcctgttcaaggtgccggccgcatgggtgatcctgttcggcatggtgttcatcccgccactgtattcgtggtacaacatcgtcggcttctgggacccgtacggcaataccaaaggcatcaccgtcgccatcgccaacaatgacgacggcaccgacaacgcgctcatcggcaagcagaacctcggcgatcaaatcgtcaagcagatgagaagcaacgaccagctcggctggaccttcgtcaccgaagccgaggccatggaccaagtggaatccggcaaggcatacgcagccatcatcattcccaaagacttttccgacgatctcgccggcgtggtgaccggcggcaagagtcggcccactctggagtattacgtcaacgaaaaagccagcgccatcgcccccaaagtcaccgacgtcggcgcgtccactgtggaccgcacggtcaattccacattcgtctccaccgtatccgaagtacttaccgaagtcatcaatacggttgacggcaaagccatcagtaccgaagacaccaccaaagccaaggccctcacggcccttgccaaggcctccgacgatgtgcagcacacacgcagcaccatcgccaagctcaccaccaaactcaccgacaccccagagcagacacgcaccgcacgtcaggcgctggacgacgcgcgcacacttggcatcgacactgcagaaggtctggccggcgtctccaccctgatcggcactacccagaccagtctgaacggcttcgtcacctccacgtccgaagcgcttgaccaaggctcaagcctgctgagccaagccgcagcacaggccaaccaaagcgtgggcacggtaaccggaaccatcagcgccgccaatcagcaggtaggcggactgatcaatacggcggaagacatcaaccaagcgaacgccgacatcatcgaccaactcaaagggctgccgaacgccaatcgagaaccgctgcaatccgccattgccacactggaaagccgcaatagcgagcttgccggcgcactgggcaacctcgatagcctgaacaccactatcggcaatgcctccacagacaccgccggattggcgcagcatctcaataccgccacccaaaccacggtgcgcgaggccaataccgctcgcggcaccatcacctccggcgccattcctcagctcaacaccggtctcaacgccctcagctcgaccgccagcactctgtcgaccggcatcacgtcgcaaggctcactcatcgatcagtcgaagcataccctcgaccaactcgacaaagcagcctccaccacggtgaccgcgctgcgcgacaccgataaggcgctggccggcgtacaaaccaagctcgatacgctggtcaccgacatcaaagccctgagcatctccagttcactcagttccctgatcggcaccgacggcaaactggatgccgccacaatcgccgacttcatgctctcccccactgttatcagcgaacaggccgtctatccggtcgcctcctatggttccggcatggcaccgctgttcaccaccctgtctttgtgggtgggcgcgttcgtgctcgtggtcattcccaaactcgaaaccgatgatgagggcatcgacgatctcacaccaacccaaggctatctcggtcgcttcctgctactggccacgctggctgccgtccaaggcctggtcacggccatcggcgatcttgtcatcggcattcaatgcgcgagcgccccagtgtttctgctcacctgcgtcatcacctcactggtgtatatgtcggtgattttcgccctctccaccacgttcatgcacgtgggcaaaggcgtatgcgtggcgctggtcattctgcaggtgccgggcgcctccggcctgtacccgattgaaatgatgcccgcgttcttccgcgccatctacccgctgctgccgttcacctattcgattgacgcgatgcgtgaaaccatcggcggcttctacgacggcctctggttcgcctatatcggcaaattgctggttttcgtggttctggcctttgcgcttggcctcggcgcccggccgaaactggccaatctcaaccgcctgttcgcgcgggaaatcaaggaaagcgacatgattatcggcgagccggtgcatctgcccggcagtgaataccgtgtcactcaggccattgcagcactggccgaccacgacgaataccgtcatgccatcgaacgtcgggccgccaaattcgcctaccgttatccccggctgctgctgggtgcgcttattgccggattcgtggtgccggccgcgctcattatcgtgtttgcgctgaccaccagcgagaaaatcgtagtcatgggcacatggctggcatgggtgctcatcatcatgggcttcctgatggtcgtggaattcatgcgcgattccatccgccgccaaaccgagctcggcagcctctccgacgagtcgatccgcgccatgctgtacgggcataaggccaagcgtcgcgacacctccgccgaacgccacgaagaagcggacccgagcgccgctgttaccgcaatcatccccactattccgccgaccaaggaaggcaggcacgcacgatgaacaccatgtggaaactgtttaccggcgacatcaaacgcctgaccagcaacgtggtctccatcatcatcgtgatcggcttggtgatgattcccggcctgttcacctggttcaacgtggccgcatgctgggacccgttctcgaatatgaagaacctgaaattcgcggtggcgaatgtggatgaggggtatcgttccgacctgatcccggtgaaagtcacggtcggcgatcaggtggtgaacgcgctgcgcgccaacagtcagctcgattggacgatcacgtccaaagccgatgccgtcgagggcgcacgatccggcaaatactacgcggccatcgtaattccgaagtcgttcagcaaagacatgatgaccttcttctccgacgacgtgcagcatgccgaactgacctattaccgcaacgagaagaagaacgcgctggcaccgaatctgctcaacgagggcacggatgaggttgcggcggaaatcaacaccacgttcgctaagaccatcacttcggccgggctggaaatcgcgtcttcgctggccgatcagctgtccaagcccgaggccaaagagcaactgaataccttcaacgccaacatcgccaatttcgccacacagcttgacgatactgcggatctgcttggcacatacagcgcattgaccgatacggccggcgccttgctcggcacctcgaactcactgatcactcaggtttcctctgccgccaaacaaggcggcaaggatcttgccagcgccaaacaggaagtcaccgacgtggccggagccctgggcaccaccgctgacgcgatgagcagcgcactggacgcgagcgcctccagtttcggcgcggtgtccgattccatagacaagctgtattccgacgcgaatgatggtgccaccacggtcgccgacgaattggaccgtcaagccacggccattggcaagcagacggagaaatacactgaaattcgcaacacgttggccggcatactgggcaacgactcatccatcatcacggcgattgaccgttcaatcgcacgacaaaacaggctgcggcaagcgctgaatacggcggcgaccgatattcgccaaggcaatcaggacgcgcaggatcagcatgcgcaggtcaagaatctggctgatcaagcgcagaacagtattgccaatatcaagtcagatttctcggccacggtgaaaccgcaaatcgactccctgtcgtccaccgtcgctgacgcctccggcatactgagttccggcgccacccagttggactccacgctcggcgacctgaaagggacttccgacgacgccagcgatatgctcagcgacgctcgcactaccttggacaaggtgtccggcaaactgcgttccgccggcgccgaactggcttcgttcaacagcacactgagcgacgcactaaacagtggcgatatgggcatggtcaaagaggtgctgggcaatgatcccgaaacgctggccagtacgttggccgcaccggtgcagctcaggcgcaaggccgtattcccggtggcgaatttcggttcgtcgatggcaccgttctacacgctgctgccgctgtgggtgggcgcgctgctgatggtggtgacgctgaaaaccaccgtgtctcgccggacgcgcaaagcattgggcgatccgcggccgcatcggctcttccttgggcattacggggtgttcgcgctgattgcgctgctgcaatccacggtgtcgctcggtggcgatttgctgttcctgcgcgtgcaggccgtgcatccgctgctgtttatgttgtctggatggctggcctcgctggtgttctcgttcttcacctatacgatggtggtgagtttcggcaatgtgggtaaggcaatcggcgtgcttatgctcatcgtgcagatttcgggtgcgaacgctgcctacccggtgcagatgttgcccgacttcatcgccaaagtcagtccgctcttgccgctcacccatgcggtgacgatgatgcgtgcggccatcgccggcatctacgacatggattactggcgggccgccggaatgctgctggcattcgtgccgccgctactgttgcttgggctgttgctcaggaagccactggtgcggttcaaccagtggtatgtagcccaagtcgagagcactaaagtgctgagctagtaggtattatccgggagttgcctacaaacggcatggacttaccaccctcagtctggctttgccagccagctctcgccagcgggagcgtacgggagcatatttcgaagagaagagatgacggagatgacagacacgacggcgacaccgcgcggtgagcgcacgcgcgaggcgacggatcgcaagctcatgcgagccacgctgcagattgcggtggaccgcggcatcagcggcgtgaccatcgaggaggtggcccggcgctccggtgtggccaaaaccacgatttaccgccgatatcataatgccgacgagctgctgcacgagatcagcgcgatgtatctggccatcccggattccgacccagtgcccagccccacgcgtgagcatttcacgcaactattgcagcgattggtcgattgggtgcgcgacaacgacatcgacgtcaagcgcgtgggcattgtattgtccagcgaggccgagttcttccagcacatcgtcgaccaagtggtgaccccgtggctggagcgtgtgggggcgttcctcaagcagggagtcgcgcagggcgtgtttcgcgaggacgttgacgagaagttgctgttgtccacgattatcggatctttggtggcgtatgaggccatcgagggcaaagcaatggacgacgacaccgcctgggcctcgcgcatggccgatctgctgtggccagcattgctgaagtagcggtcttactcctgaatcgaagcctcctggcgggcgacttcgagggctttgttgaaggcgtcggaggtccagctggcgccggcgaccttgtccactttgagacccttcagaggtttgccgtccaccacgccgttaatggctttggcgaagtcgtcctgatggttcttggaaatcgtggtgaacgggtgcccaatgatattgacggtctcgacgttgccgtccttgatggtcagatggacgtcgatggaatcctcgcctaccgggccgtactggccgttgatcgagtagttgccgtccttgtagttgccggtgtccttcttgtcggacgtggtggtggacgggtcgttgtgcgacgagctggaatcggagccgtcggagctatcggagccgttcgactgggattgcgactgctcttcctgcgacttctcggtctcgcccgagttgccggcgtacgcatcgtccatcggcgcggccttggattcgccgcatccggccagcagcgcgccagccacgaccagtccggccgccgccaatgtcgcggatttcttcaacgtactcttttcggtcatattcacgctccttaagccccccctctgacgaggggggctgtcagcgaagctgactgggggagagaccatcagcttgccatgtattcctcacatactgctcgatgcccctgacggccctactcctcgccgccggttttcgcggccttggtggggtcagtgaaaccaatggcggtctcgccgttctgcgcgccctcgacctgtgcacccgtggaggcgggcttgccgccggccgcctcgtaggccttgcgcgcatcctcgtcattccacttctcaccgacgagcacgccatggttgagcatgatctcgcgctgcgcgcagctggcgaccagcgcatcgtgggtgaccacgataatcgtggtgccctgctcgtgcagcttgcggaacaggtcgagcacgattttctcgttcttctcgtcgaggttgccggtgggctcatcggccagaatcagcttcgggtcgttgatcagcgcgcgggccacgcacacgcgctgctgctcgccgccggagagctggccgggcaggtggtgggcgcggtccttcaggccgaccttttccagcgcctccatggcctgcttctcatcgaccaccgaatggtagtactgggccaccatcacgttttccacggcggtcaggtgcggcaccagatagaacttctggaacaccagtccgatgaggttcttgcgcacgtcggccagctgcgtggcgttcaggtcctccagcttgcggccttccagcttcacggagcccttggagggcgtgtccatgcagccaatcatgttcatcagcgtggtcttgcctgagccggaggagccgacgatggcgagccattcgccttccggcacggtcagattgaggtcgtccacggcacgcaggtcgccgtagatcttcgagatgtggtcgagttcaagtagcatgacgtttctctttctttattcttcgcgaagcacgacggcggggtcgatgcgggtggcgcggtggacgggcgggatggaggcgacgatggcgaccagcgcgctgaacagcacggaaatcagggccagccaccagttgaatacgatggagcgttcgaacaccgccacgcacagccaactggcgagtccgtagccgattgcggtgccgatgaggccgccaatcaggccgtagagcgacgattcgatgtagaactcggtgccgatggcacgcgagctagcaccgagggccttgcgcaggccaatctcgttgcgtcgctgcgagacgatcgagctgattgtggtgccgacgccgacgagcgtcagcaccagcaccaccagcgagacgatccagaacagcgtctgcagcatggtgatgatgcgggtgtcggaggcggtgatcttggtgacctgctgtgccttgacgtgcatggaggtcatgtcgttgatgctggacaccaggcctgcgaggtcgctggcgccggccgaatactcgatgacgtccacgccgcgcgtgatgccggtgagcttgttgacgtcggcgttggtggcgtagatgatcgagtcttcgctgccgccggtgtccacgatgccggccacgcggaattcggtaccggaggtgtccatgatgtcactggagacacggccgtctttggtttgctggtcgatcgaggagttcgacgaagtgccgttggtgctggcgttatcggatgcacggtagccgatggtgatggcggagccgattctcaggccgatggcgtcggcgatgtcgcgtccgaccagcaccttgccgtcggtcggccacgagccgtcgaccacccagtgatggttgaggttcttgacctgcgccgcattcacgccggccatcacgtacggcgaggcgttgacgcgcacgttctcgtagcggtaggtggcgtatttcgcggaacccttggccttgaccatttcagtggtgtgctgcaccatcgccttgtcgatgccggccttgccgtcagcattggtcgattcggtgggcgtgacaatcaggttcgcgccgtacgcacgcatctcctcgttcatctgctgcggcacggcgaggcagatcatcgccagacagaacagtgtggctgcgccgaccagcgacgccaccacagccatcaccgcgcgcgaacgccgacggaacacggcgctgaacagcattctgaagaacataccggtgttggtcatcggttccctccttccacacctacgtagataaactcagcgaccatggagcacctccgcgggcttgagattcagaatcgaacgaatcgatgaggcggacgccagcagcacggtgacagccagcagcacgaacaccagcacgaacaccatcggccgcatcgtaatgccggaaccgaacaccacccggcctatcagctgggccacgccggaaccgagcagcgcgcccacaatcgcgcccagcagcgagattgccgccgtttcggccagcatcaggcgggataccgcggcatcggtggcaccgagcgccttgagcaacgccagctcgcccgaccgttcgccgatcgaggcgaccatcaggttggccacggccacggctgcggcgatcaggctcagcacggtcatcagaatcatcacggcctgcgtcttttgcagcacattgccctgcaacgcggccacctgacgcacctgcttggccaccgcgcccggaatcacctcttcgatctgataggcgatcgagctcgggtaggcggtgcagtaccaggtctcccattcctcctggctcagcgcggccgggttcgcggcggccttacgggccaggtcgttctccggcgtggtcagggccttgacctcgattttgtcgaccgaatcgggcaggtcggcgagtacctgggccgtggaggaggcgatgtagagcgagccgttgtcctcgtcgccggaatcgtagacaccggtgagcttgattttctgctcgttcttcttgcctgaggcggtggttttgttgagggtgatggtgtcgccggtggtcacgccgagttcggaggccagcgtcttgccgatcacgccctggtcggaatcgtctttgggccacttgccgtccagctgccaccacgagcgcatgccttccacgcccacgacggtagtctcgccggtggagatcttgaggttcttgttgaaccacgtgccgacgaccggcacgttggtaccgttcaccgtggcgtggatgttgagctgcggcgcgaagctggtgatgttgaacgaccagaagatcgtcttgatcttggccgcgtccgactccttcagaaaagcggtcgggtcgctggtggacgtcgcgccgcccgactcggtgttgtacaggtcggaaacgaccgcatccgccttgggctgcacggtgatgttcgaaccgtaggtggacagctcggcgttgagcttgtcgcccacgtcgaacacgacgcccagcatcgatacggacacggtcgccgacaggcatacggtcagcgcgataagcaggcgccggcgcagctgtcgggtgaacgagcgagtaatcatgcgcagaaagaacatgattcttgtctcctgcctgactcaccggaagtgggcgctcagcgcgtccagatccgtagtttgaatggtgatcttgccgtggccggtcttgtacgggaatggtatcgggttgcagccacccttgaagccgatggtcgccaggttgatggccacctcgcacttcttgcagatgatcttgccgtccttctcgtagtagccagcgtcgccgcagttctcgcaggcgtccaggccgatgccgtacgcgccaccgttctttcggatgatgatgaagcgcatgacggtgccgtccttggccttgtattcgaagcggtgcaggtggccgtcctcgacctggctgaaggggatggtggccacgccgtccttgagcgagtaggcttccggcggcgaaagggtgatggtctgatgggtcgcggcaacgcccacggtcagggttgctgtgacgccgatggctgcgataaggctccacacggcagcggcgatggcgtggcggcggaataccttatgccggcgcaacgtggcctcgttggctcccggcacatcatgggttttcatacggaaaccggccacgatggaggccacggcgggaatcaggaacaccagcgcctgcgccataatcatcgtggagttctggttgatggaccaagccagcgccacgaacatcgtatggttcatcgggaagcctcgcgcctgcagaatctgggcaagaccagtgaagtgttgaatcagcagaatcaccatcatggccgcgacggccacggtgaacgcccagcgcacggcagtggtgcgcatcgtgcggaagatggcggccacaataatggacatgaccacgccaagcaggaaaccaagagcgcgcagcagcatggccgaagtgaatgcggtctcccctggttccacccagatggtgagctgcagaatcacgtccggcagcgcgtagaacagggtgagtgcgatgtcgatggcggccacggcgttagcgatgtgcatgaacaccttgtgctgctgccaattggtggtgatgcggcgtgcgaacaccaccacgacgatggtcaggatgtcggcaatgatcgcgcaccacaacaccgggtagttgacgaacgtgcgctgattgatcacggccgaggcgcgcaggccggcgaatacgatggcggcgatcagaccgacgatcaggccgatgagacgccaatgcgagcttatcggcttatctcgcccctcgccgaccgtgagcatcacgctcaggctcatcaccagcaatgcgggggccaaagtgcccggcatcactgccacgaattgttcaagcattcgcgtcctttctctgttcaccttaggctcccctctctgaggggagctgtccgcgaagcggactgaggggagttttagaccgtcctaagaattatctccctaaagcggcgtaaagccccctctgacgagggggctttctgcttagtcaatcaccactggcgaggagtgtaatcccagttgtcgaaggtgacctcgatcggctcggtccagaagtggcccttgacgccggtctccgggtcaacgtgcagcatccaacccttggaggccggggattcgatggagagcttcagctggtaggtgccagccttgtcgagcttgacgttggcgccgtagtgcgggccatcggaagcgttcatctgcatgaaggtaccggaggtggcggtgccgccctcgacttccttgccggtggacttatcgatgatggtgtagttcacggtcagatccggcacgaagtcgcccttgccgtagccgagctcggtgcccttctggttggcatggatgtcggcctcgaggtggaaggaagcgtcagcagccttcaggcccatggaagacggctccatatcgatcggctggaagtacacagcgcccacggtcagcgggccggcgtcctgatcctgctcttcagcagtaccggacgggccaaccggaacctcttcgaaaccggcgccggaatcggaggaagaatcggaggaagaggagtcggaagactgggaggaggagtcagccttagtgtcggatgcggagttggtggaaccgcaggcagccatggacacggtcatggaaccggcgagcagcaggccgagcagagcggccagtttcttgttcttcatcattgttattccttttctctatctctggtgaattaggattcacgcttagataattgcaattattcagttatgagataagtgcggcgtgggctggaggaattggcatcgatccgaggccgtgccgcaagtctgtcagttgtctgcagttatgggaggaaacggacgagctagacgggctacgccttcacggccgggacctcgacagtagcctgcgccttcagcttgcgctgcttgatgaagccgaccacgaacagcgcgataaccgcaacggctgcgatggcctgcgccactaggcattcgacgtacgggtagaggccaagccaatcgttcgtcggcacaccgttcaggtagaaggcgggcagcaagtcgccctcgatcagcgagtggacgccgccgccggcgaacaccaccaccagcacagacatcagaatcgaagtgaccaggaagaacggaccaatcggaatcttcacggaggtgaagcggaagagcaggaagatgccgacaagcaccaccgcggcggtcagaccaccgatccacataccgcgagtatcgcggctcatcgtgtagatggactcgtagaagatcacggtttcagcgccttcacggaacacggcgaggaagctcagcatagccagcgagaccacggttttcaacgtcacgttgtcggcacttgcggcggcttcggcatcagccacagcagcctcggtcttcttgcgaatgtaacggttccacgcttccacgctggacttgttcagcatccagttactcgtccacagcagcatgcccatggcgatcagtgcgcaggtgccttccatgatctcctgaatcgggccggagccgccgaaggcgaacacgaagatcacagccaccaagccggcgccgagcagaccgacgagcacacccaagtaaatccacttgacgaagcgcttgttatcggacttgaccaagtaggcgacgatggctgcaaccaccagcagagcttcaagaccctcacggataagcacgaggaacgcctggccggaggagctggtgaccagcttggtgaaaccgtcttccttatcggcggcaccaccgtcaagaatgccggcgtccttgatcagcatggccttgaggtcgtcgatcagcttcttggtgtctttcagggatgcgccggcgttcatggacttgcggcacatcttgaactggtattccacctgcgagacgcggttgccgctgatggcgttcatcacgttcttttcgaagccgagcttctcgtaatactggtagtacgcgttgttcacgagcgtggcgcccttggcaccatcacccttttcgtaagctttgtatgcattgtcgagaatcggggtcatttcgttggccacgtcggtccatgaacgattgcccttgcccgggttcttctttttcttggcgtcgagctccttgcgctctttggccagctgcgcctgcagcgcttcggcgtacgccttcggcttggcgagatcggcgttggtgtcgagctgctgggccgtggcgtcaagatcggcggtcaacgcatcaatctgctgagccagttgatcgtcgttgccaggcgtgtaggaaagattctgaacgctttggaatgcctgctgttgggcgagctgcttgtccgcgccaatggtgtcgtgcacgaccgcggtgaagttggaggccacgtaaatcttgttgtacgcgcccatgaaatcggaggtggcgccagcggtgttgccatccttgtacgtcttaagaccgctgttcagctgcttgtccatcgccttggagacttcggcccaggtggcgtagtcaacgctggacgagcttgatgaactggacgagctggtgctgctgtcggcgaaggccatcggagccgtgactgcaggagccacagtggcgatgaccatggcgaacagaaatacaatcgcagccagaactcgcagctgcctcacgctggtgtgttcaacggaccgaagagcagcctgggcgcgacgaaccatgcctatccctctctctgcgcggctaagtaatcaaaaaccaactactcaatataaagaaaaacttttttgaggaacagtcttgattttttaggatttaagaggtattaggcactgtttttcgatcaattattaccgcagattgtctcaatattcgatattgtcccgctcacagatgggagacttcccgaattatgaactccccgcgactggccactccccatccctcatattgcatgaccaactgtttcaccaaggttcatagcctaaaatcactatgttgcatcacggcaagaggctggcaataattcacgcgatggcatgcgcatgttcattctggtttgcctcgggtttgctgacttgccttgagtcgctttgatttgcactggttcatcccccggtgagatcacctgttgcacacgccgtacgaacgacctgcacatcagcgcaggcactcattggtggtccttgtccacaaagcgacacgccgcagccggcactgaatgtgcatttatccgaaagctgtggtaacttattcgagttgcctacggagcttacttctagcaagcactgcagtgcatggaggattcgcctagtggtctatggcgcacgcttggaaagcgtgttggtgtaacagcctcacgagttcgaatctcgtatcctccgccatcagggttttggcttttgtcaaaacccttttgttatccgcacccacatgcatatacgcagcggtccaaatatgtgcacaatcgtgcacattcactgtttttgcagtggcgtggcatggcacatattccgagacgaccgaattcccacaattttcgtgccacaacagcgcataaaaacacgaaaatgcgattacgtggcacatccgaatgccacatgagcgcaaaatagccaatattgcgctcatgtgtacaacttagagcacccgaatacttcctcgcacacccgtcgatttgcgtaatacgcgattgcgtgtattgttgtgcaagccgttcaacggccctaagccgtgcgcacattatcgccccgatagctcagtggtagagcacttccttggtaaggaagaggtcgtgagtccaattctcactcggggctctcaatcaccactcgatgccgtactcggcatacatatacatatcgtactggtactcactgctgtagttcaggtcgttctgatgtgcttcatgatggctgttatctgactgcataatcattccttttcctagcctcatcggtattacgaccagatatagcgaaatcgcgttaccgaactatgcgcgttcagcgaatcgcaggtgaactcatagcgaactgttgcacgcactccgcatgcgagcgcagactcattgacatataccgtccggcacacacttcataatgtgcaaggccgcgcgccagctattgaataccgccaaacagcaaaggaaagcctctcccaccatgacctcacaccttgccgaagcaggacgcacactgattccccgcaaggatgatcggtacggtctgctttccccagctctggttattctcacgtttgtcgccggactggtggatgcgttaagttacttggcactcggtcatgtatttgtggccaatgtgaccggcaacattgtgttccttggttttgcattcgcccacgcgcagggcttcgtctggtggacttcggcgctcacgctggccacgttcatgattggtgcgttcatcggcggacgcattattcattactttggcgccaaccgcgcgcgccatctgctggtgtccacgtcaatccagctggcttttgtggcagctgcgctcgtcggcatttatctgctcaatcagtttgcgcctgaaccgtcgatgggtggcactgatgcttcagccatcgcccgcacggcacagcccagtctgaacttcccaactgctcggcatattgatttgcatattattctgctgattgtgctgctcgcaccggctatgggcattcagaattccactgctcgtaagctttcggtgccagatttgcccacgactgtgttgacgatgacgttaactgggattatcgctgacacttcggcgcatggtcatgggcagtccaaacttggccggcgcgcgattgtaatgctggctttggcgctcggtgctttgactggagccacgctgcagacgcgcggtcatgaggacgttattttgatggtgatgatcgtctgtctgattgcggtcattgtgatgatgatcccccatgtgcattccgatgcccgctgggtgaccggaaaacactgattcatacaaaaacggccggcgctgggcattgctgaccggcaccggccgagataataaggagtgctccttatgtggtcgcgaaccttacggtttcatgatcacatctgctcgcgattgcggcggtaggcgattgcggcgccggcaccggccagcagcaatccggccacagcaatcgtgacgacattggcacccgtgttggagacgacattgccatcacccttggcagcggtacgcttcaccaagccggcaattgccttctcgagagcctcgcgagctgcgtcgacctgcttctgcgtggcgttgctgttgtcggagacctcacgggccttcttcagcgcggcgcgcagagcgttggcggagtcgtcggtgtagagacccaggttgatggcggcggccttgttgatggtcgcgttcagagcagccttgtccaccacgcccggttccggattcggcttcggctcggtggcagcttccagcttggagatggcgtcctgaagagcgctcagtgcggtatccacatcctgctgggtggcgttcttgttgtcgagcacctgctgtgcagccttcagtgcctcggcgaaagcttcccacgagttggtcgtgtaatcggccttctcgagcttgcttgccttgttcactgcagtctgcaggtcggtcttgttcacctcaaccgggcctgggccaggctcctcaccggtcttctcgagaccagcgatagcggattcgaggttcgtcagcgccagagccacatcgtaagcggtggccttatcgttatccgccacggcctgtgcagcttcgcgggccttgaccagagcagtccagctttcagccgtgtagtcggattccttaagaccgttagccttggcgatggtgtcgttgaggtcggtcttgtccggagcgacagtctcttcctcaacctcgcggtccgtggtcaaacgcagttcggcagcggatgcgaacttgttggcctgggagtcgctctggcctgcggaagacaggacggtcaagcgtacggcggtcacattctcgacggcgtcgaagctggccttctgccacatggtggtggtggagaactcagcatcggtgacgacatccttggtggtgccatccgccagagtgagcgtgatcttgtagcccttgatcttgccgttggcgttcatacctccggagcgcggcaggtagcgcaggccgttgatggtggtcggttcgttgaggttgaactgataccatgcggtgccgttgccgactgcgttctcgctccagctggtgtgccagtgggtgctgtcgttgccatcctgtgccagatcggccgggccttcgctcggcaggcctgcggtaggctcttcgctgcccgtggccacggtgtagccacccagctcatcggagccgtcagctgccacgtcgtacttgtcgctgctctcgttgccgggagcggtcttcatgtactcgtcgagggccacgagaatgtcgtatgccttggtgaagtcctcagcggttgcgccattcttgttgatgagcacgcgagccttgaccaaggtgtcctgatactgctgccatgcggcatcggagagctcagcacgcttggaatcgtacttgccgcggatttccttgaccttgtcctgcgcttcggccttggtgcgggtctgggactcgatgcgctcgatcttcaggttgtcgagcacgaagtccttgtatccgccgaagtcctgtgcattgccggtggaaccctgcagatcaggtgcggttgcggtcgagtaaataccgaaccaggaatcgccgttgacgccaccggtcagctcgaactcggccttgccggtctcacccagagccttcttcaggttggtcagcttcacgctgccggcagagtattcaccctggcccacagcgatggcgtagatgtcatcggaaccggactggtagtcgaagctcaccttgtacttggcacccgcctcgaacttcacgttctgcgggatcgtctggtagaccagcgtgcccttctgggtcaggccgttaaccttcacagaccaagtgccatcgagcacatcgtccatcttcttgacatcccaaccggcctgcgtgaacggagcatgcagctcggagaggtggatgcggttgtcctcaacgccttcggaaccggagaccacgaacggccagatgccctgggcgttgttttcgaatccgttggtgagggacttcagcgtgccgtccttctcataggtgatgccggagtactggttctccacgatgcgcacatcgtcgaagtaggtgtgtgctccgtcggtgctcttgtgagacagggttaccgtggcatcgccgttctcaggcgcggtgaagaacacgtacatgttctggaagtagctggagccattttccgtattgctgttcgtgttgtggccgtatgccttgatgtagttcttggcgatggacttgccggtggagttggtggccagcaccttgccgccgctggttacggtgacggatgcatcgccggtggagcggttgtcgacgccaacatacagcgcgtacttctggccagccttgagatcggtcagacgctgggagacatcgaccttgccggtcaggcgcagcatggcgttgttgtcgccttcaacttcggccttgccggagccgctgacggtccagttgtcggtgagggtgttggagccgccgttgaagccggcgtctaccacatgcatgccttcgctccagttgacctggatctgcttggcttcgcccttgtacaccacgtacggggtttcggcatcagcggtaagcgtcaccttgccgccggagacggcaacggtctgctcgttggtcttgccctgatcggtgagctggtacacctttacgctggagaggttcttccagctgtccggcagggtccaagtggtggtgccacccttggtattccagtggtagagcttctgttcggaatccttgaccagcttgccggtggaggaatcccacagccacggcagcaggtaggactcgtcaccagtggaggaaccatcgcctgcggagacagcaccggaagccaccatcacgccgttgaaggtgatggtgcgctggcggtaggctgcgctagaggtgtcgttggaaccacgggagactactacaacgttgccgttggaatccttcagggtaatctgctcgttgccgttgttcgtgttcgggtcggacacggcagcggcattgccattgtcggcggtcagcagcgggttgttgacccagcgggtcaccttgaagtgctggatgaacttagtggacacatcatgggtgtacaggttcttgatgtaggcggcatagtcgttgcggccctgccagccttcgaagtccttcatgttgtagccgccgagcagcggggcgttggcagcgccgccgtattgcgggtagtcgccaacccagctgtccttctggtggttgcgcaggaagcgcatcacttcggagttctcgcccttggaggtgtagccgccgtaggtcagatcagctgcccagtgctggaaggtggagtcgtactcgttgccggaaccccattcggtggtcatacgccagccgttgtcgttgatcatcttgctcatcttgcgggtttcccaagaatcttccgaaccggaagaagtcaggttgccccacacatcgaggtagatgaagtccatgttgtcgccgacttccttgctgaggtcagcgaaacggcttacacgagaaccggatgccagatcgtagatgccgtcgatgccgacaccctgatcaagccagttccagccgtagctcaggccgcctgcagagttgcggcgcaccatgtcctcgctgaaggccttggcttccggatacatttcggaggcgttgacgtgcacaccgaagcgagcgccatacttggagccctcttccatcatggtgttcatgtcgtcggcgccgccgagacgctggccgatatcgccgtagtccgggtggccggagtcgtggccttcattgccgtagcccttgagcagcacggactggccgaggccgtcggtgttcaaggccaccttcttgacgttgtcaagcgtggtgaggaacgggttctgcgcctgggagccgaagttcatggcgatacgccatgccaccagttcgggaacttcctcggacttgtacgggttgttcatgatgtcgcggtaggcgattgcgccatcctgccagttgacggcaccgtcttcgttctcgtcgccggcgatggccacggccatctgcggcagagcggtttcggccacggtgtacttcttgcccttggaatcggtgaccgtgcggtggtagtaccacggagcgctggccaggcccagggaggtggcgtcaccagtctgctgggtggtggcgtagacacgcgtgttctggctgccgccgcgcacaggagccgccacataggtgccatcgtgctcggagttgctccacaggccggcactcaggccagcaccggagatgaagccgtaggtgtagtcgctatcggtgacgttagtatcttcggtcactgcgaagttggtatcgccaggcttctgcgtgttggaagacatacgagcaccagtgaattgggcattttcctggctggaacgcacggaaacgagactctggttcgggaaggacagcgtctggatggcgttctcctccacaccgttgccctcaggaatgccttcggacaggttgttcttgatcttggtgacgttgaggtgcagctggttggccttgaccgtgatctgaacggtgatcaccgcgtcaatcttcttggcctcatccttgaccttcagcgtgtaggtggcctcggtgtcggaaaccttcttgaaggtcacgtcgtcatcgcccagttcgatgttggtgccgttgatttcaacggtgcgcacatccttggactggccgtacatcaccttgccgtcggtcatcgtgtactgcagcacagaggggaagttcttcttaatctgaacttccatcttcttggtcttcagcgtttcggaggcgacctgaacggttttgttcagggtgatgggatcgatggcaagatccgcgccggagaccgtcacctgctgggagacgtcctcatagccttccttggcaatcgaaagcgtgtgttcgccttcttcaatgtcggcgaaggagaaggtgccatctgcaccggtcttcaccttggtcttatccaaacgcactgttgcgccttcaatggcagcgcctccagcgtccacaaccttgccggaaaccgcgtgcttggcggcttcgacaacctccgggaagtccttgatgtacacgtcggtgacctcgttcagctccttccaggagccggccttgatggcaagcttgttggagaggttcgtcattgcggagtaatcgacatcgaatgccttctggccatccacggtcagtgtggcgaccttggcgtcggtccaggagacctgaatgtcgtgctcttcgttggcgctcggagcagcgatacgagcaccgctgtaccagctgccgctaccgccaccggtgtaggtctgccagaaccagccgcccgaatcgtagccgatgaacaggccgctgcccgggtcgttgtagcccaggtagaagccgaagcggttggcggagccttcctgcggggatttgatggtggcgtggaaggagccggccttggagaagtcgtaatctgtgccccatacggctactgccggccagttgttgctggagctggggttcgctgccgcattaccgttagaggcagtggacttgaggtgcagccaaccgtttgccatctccaggatttcgccgccctgagcgatgttggaatcaatagtccagccttcaaccgcatcggcttgtgcggaaggagtctcggaagcagttgcagaatcagaagtatcgttgatttgctgaatctgacttgccaaagtctgcaagtcagcatcagacaggggcactgcgaacgcagtacctcccccgctgcccatgcaggttaaggctaacgctgttgccagcgcagccgatatagtcttcttctttttcattaactatattttccttaatctcttcttcgaggtgaagcagatgccttcttcattgaagaatacgcattcgcaattacgataagacactttacaagaagctattcttaatagcaatctcagcaaatacggagaatcgccacatatttgacattgaattacaacgtgagtgaaatcacaaaacccaataaacgactacgttgttaaccttcacatctatattcgcatcatcgcgacacgcgcagggaaaaactgcgcaaaaaaagtaagacgaatttacctgcattcgacgcaatcaatgcagcagcattacagcagcaagccgattgagcaaaatagcaaaagccgccttgcgcaaccgcaagacggctttgacgacaatggtgaggctgtgctcgcttacttcttggaagcgttcacggcatccacagccttctgcagcgattgagtataagccttgtaccaatcagcctgctcgttgagcttcgcagtagcggacttgaagccggcagtgtcgtcagctacgcagccttcgtataccggcagttccacgctcagttccttgttgagggcgtccagcgtggaggcatcctttacatccttcttggtgagcgcagcagcttcggaagcatcgccattgaccaagttgttgtagtcattagtggcgttgcgcacattttcggaagcggcggcgcaagcggcgactgcattgttgtactgagcatcggagtaggcgcggaagccgaacacaccggccacgacgataatggccacgaccaccacggcgataatggcgacggccgccttagacatgtgcttcttctgagcgccttcattgcttgcattgttggcgttgtttgccggtacagcctgctgcccagcggacatacttcgatctccttcgttctcgtactttcatacacacgtatgcgctcttagcgctcttatgcgcactcatatgcagggaagtcgcttttcaagcggctacttccctgaaaacaaaaaaccctcgcattccgcgagggtcattggctgggatgcctggactcgaaccaagaatggctgaaccagaatcagctgtgttgccaattacaccacatcccaatttggcttggcgtagcaactccaaggagttgttcgtcgtacccccaaccggatttgaaccggtgttggcgccgtgagagggcgtagtcctagaccgctagacgatgggggcatattcagtttttcaaccggctgctcggtgaaccgcgcaacgagtgataaatatacgcaagtattcacccttacgcaacttacggcgtgtcgcgcggaatttcaacgatttcaagtgctacgctgccactactgatgaatttgcatgaactctactgacggattatcagtaagcactactgatgaaataccatctaatgcactgatgaaattgcagatgaggcaatgatctttgccttgcacattcatagccggcaaatcagccttcaagaaccaaatgaggcgcttatgttcccttgcgacagcgagcgcgtcgcgatgcttgtaatgcaatgtcacgtcaaagaccgccgcccggttacctatcaaccgtttcatggacgcatgaaggcgaaaccacctacaaggcacgtttcgtgacctcactgcacaaaccagccatgttcaacctcgtacatattctcactggcatgcggcgcagcggtaagactttccagctgttccagctcatcactgaatacaagaaaaggtgggcatctgcacatgcagacgcccaccttgagtgtccttacagctcagccgagcacggaaggaaccttagctcacaggtgctcgcgcaggcccttcaggcgagcgagggaaaccggcttgccgacgatctccatggactcgaacagcggcgggctcacgcgacgaccagacatggccacacgcaccggaccgaaagcgaggcgcggcttgtagccgccctcctcaaccagagccttgttcagggtctcatgcaggttgtcggtcttccagtcagcctcatccacagcctcgagtgcggcgatggccttgtccagcacctcgccggcagaatccttcagctgcttcttggcgtcgtcagccggctccaagtagccctcggtggagagcagggagccgaccatgccggcaacctcacccagcaggcgcacgcgcggctgaaccagcggagcggcggcggtcagcacctcacgctcacggtcggtcagggcatcccagttgtcggcggaaaccacaccgtcgcggtgcaggtacggcaccgagcggcgcaggaagtcctcgggctcaagcatacggatgtgctcggcgttgatggagatggccttgtcgatgtcgaagcgggccgggttggccttgacgtcgcgcacgtcgaacttctcggtcatctcgtccatggagaacacgtcgcggtccggtgcaatggaccagccgagcagggccaggtagttgagcaggccctcgcggatgaagccattgtcgcggtggttgaacaggttggactctgggtcgcgcttggagagcttcttgttgccctgacccatcacgtacggcatgtggccgaacagcggcatctccttggcgatgccgagttccataaggtaacggtaaagcacgatctggcgcggggtggagctcaggaggtcctcgccgcgcagcacgacgttgacttccatcatcgcgtcgtcgaccgggttggtcagcgtgtacagtgggtcgccgttcgggcgcacgatcacgtagtccggcacggagccggccttgaactcgatggtgccacgaatcagatcgtcaaaggcgatgtcttcatcaggcatcttgatacgtagcgcaggcttgcggccctcggcgcggaaggcggccttctgttcatcggtcaggttgcggtcgtagccatcgtagccgaactcggccggacggccggcggcaaggttgcgctccttgatttcctcaggagtggagaaggactcgtaggcgtagccggcttcgagcagcttggcggcaacatccttgtagatggcggtacgctcggactggcggtacgggccgtgagggccacccacatcgatgccctcgtcccagtcgatacccagccaacgcagggattcgaggatctggttgtagctttcttcggagtcgcgcacggcgtcggtgtcttcgatacggaagatcagcgtgccgccggtggcgcgagcttccgcccagttgaacagggcggtacgaatcatgccgacatgcggggttccggtcggcgacgggcagaagcgaacacgaacgttcttgggcagttcgggtttggtgttttcagcatcagtcatagtcccctattgtgccgcgcgcgccggacgcggagagcagcgctcctcgctcttttgcttcgttattgacgtttcgggccaacaccatcccaaaacggccattttccaacgaaatctcttttgcctgccattttcttttcttttgcttttaaaatcaaaagaaaagaaaacagcaaacgagaatcagcaggccaggcccacgaacagcagatcctagtcttgagattcgtcttcatgcgattcgcgctgctcaacggcggcatccgtgtattcgtggttcatggcattccctacatctctgtatgttgctttatgcgtagcgccaaaagcttcgtctgctttccagttccacccccgcaactgtgcgcaatattcatgtaacaggttacacaaccgatcgacaacgttcaccctcaactgatatcgatttgataaccatcgattctttccagtgcattcaccacaactttggacattatttggcgcaattgttgagttttccactcatgcaatggaagaatatgatgtgacacataggtcttatgaaaggggaatcaatgtctgatcccaacaatgtgcctttgcctcagcagcctgaggccaacggtacgcccgcacctaatcccgtaccgcagtatggcgcaccggccccggcgcagccctcacagccggcgcagcccgcttacggccagccggcatacggccagcctgctccgaccgcgaactcttatggccaggccgcaccaacctacggtcagcccgcgcccgacgccaacacctacggtcaatccgcaccggcgtacggcacaccgacccccgatggcaatccttacggcccggttccgccgtcttacggccaatacgccgcgcccactgccactgtgccgctggataagccttactacggatgctccttccaagaagccttcctgcgcttctggaagaagtacgtggtgttcaggggccgcgcgtcccgcagtgaattctggtggtgggtgctggccgctttcggcatcaatatcgtgctggacatcctcaacaccgccacagatgaaaagcttggcttcctcgccaccatttggggtctggcgaccctaatccccaccctggcactttccgtccgccgtctgcatgacacgaacaagcctggctggtgggttgccattttctatatcgcgatggttatcggccttatcatcatgattatcggcggtggtgcggcactgtacggcgggttcaggagccttggcagttatgactatggttatggcagcatggccgccggcggtcttggcgcggcggtcattggtgcgttgattacgctggccggctgcgttgtctatatcgtgttcatggctcttcccagcaagccggagggcgcacgttttgacgatggcgcggcggcaacccccatgcctcagggtgcttacggcgcaccatacagcacgcctgtacccccgaatttcgccgctccgaacgcgcccgcacccggcttcaaccagccggccccggcttacggccagccgcccatgccaacccccgactatggccagccggctgcacccgcacctgattacggtcaggtgccggccccgcagtacggccaaccggaggccccggccccacagtacggccaggttccgccgatgcctcaaaacgccggcgacgaatccgcaacaccttctgagcacacggctcccgccggcgacaatgcccagaaaccctggcaaggccagtaaccgatatcggtgaacttccgttgaagaagttccccgcaaccaatgatgaagccctactcaacgcgagtagggcttcatcattctcggcactgtattatcggcactgtattcagccaactaccccaacggcatcacggcaatggactgcgaaagcatatacgattcacccggactaagggcaacgatacggtctcggcacgccgctgcctccacggccacaaagccacgccattcacccgtcttggcatgggcaatggcgttgccgccctgctctccgggattccacaccaccgtctgcggcgagccggtcttgccgatgcgaatcacacgacccagcacatggtcctgcaattccagtgcagcatcggaataatacacacggtccaccggctgatcgccgaacatcaccgatggctgttcttgtagttttggcgggaatccggcttccgtggcatccagatatgttgcaccccgcaaaccgaccagccgcgcgccgagcacatcgccgacatgcagatacgagtgcagcgccgcctcatacgacatcggctcacctcccgtgttggtaacggtcagcgtcatcgtcagcgtatcgctggcacacacctcgtatgcggcatggaaacgcacgttgggttcatcctcgatccatggcacttcgccagtcgtcagtcgttcggaatccagcacataccgcacacgggcaccggtaaacgccccttcgtccagcgcccactggcgcaatcgtgcgaacccatgaatcggtcgcttcgcagtctgcccgccatgcacaaaccccggcccgaaccaggggaagcacaccggcactcccccgccaaccggctgaccagcttcgaaatgccatgtgcggggcgtccagattacatccggctgccccgccggggcccaacgcagcagatgcgccccgtaatcgctgattaccgcgctaccgccgtcattggtgagcgtgcgcagattgacgccattgcccataagtgtttcttcttccgttgcgtaagcgatgttcttcaccacatagacgatttccttggcacggaggaatcgcgagcaggggtaagagaaccgatcaggcgggctaagctgccttgattctcacaactccacggtttctttgccagggtcatctttaatgtgcgcaaacttggcggccaaggcctccttgttgcgcttttcgtcttcttccttggccttcttcttggcttcgtccgggttccagagcacatcgtcgcggtgcttggtccattcggcaccggccagcggggcaatgtattcggcggtggcggtcagggtgtcaccggcattggcacgcgtatcaatcagatcaagaatctgctggtcggtcaggcagatgcgcggaatcgagcactgctcacgtaattcgttgacgtacagcagaatcggcaacgttacgatggcggtggcccgggcctcgtcagcaacatcagcggcatcagcaacagccggaccaaccaagccaaccgtctcggcatgcccgctcaccacgttcagcagcgcatcgcatacggcgagcgcggtggcgaaacggacggccacatcagccggctcgccggaagccgccaaacgtccgccagcctcggcatcggcctcaacctgagcctccacggagacaaccgtctcacggactgcggcctcgacatgcgaatcccagtcaacacctaaagcttcggcggcatcgaaaatcagctgcacatcgccggattccgagtaaccggccatcgtatcgtaggcgtcattggcagcaagcagcgtgtctacgatgctttgcggacggccaggaatctcatcggccccctcgtagacgaattcggcgtcaggcatcgtaacatcctgaccggtgagaatgcgtgcgaacgcgtgcgtgacacgcacctgcaggttctccgcatacttggcgtcattgtccatctgcatggcttcggtcagcggccacaggctaattagcgccgagccggcttcagcggcctcagctacccccggcaatgccgcgatccgtgcgattgcctcacgattgagttcaatggtcattcatgctcctctgcgttcaccacttgattgtagtgcgtcccattggctccctctgaggggagcccagattgtagctcagctattcaccagtgtgccgttacttgacgttggctgctgggtcgacatacgtgattgacatcacacggccggtttcgttgtcgtacgtcaccgaggtcacggaggcgagcgccgtgtgccgcaggaacatccagtgctcggggtggccggtctccagataatggcgataactgaaaatcggcgattcgtggctgaccaccacaatctgttcgccggggtgttgggcgaccttctcgcgtgcgaaatcatccatgcgctgcgcaatgtgctgataggattcgccccaactcggcttgtacaggttggtgaccagtttccaattgccgttcttccacagcgcgccttcgccatggccgatacgcttgccgcggaactcgttgccggcctcaatcactcgctcatcggcggtgagcatgagcggggcttcgcctcgggcctcgcgcacgggattcaacgcgtcaagaatcgcgtcggcggtctcgcgcgtgcggtccaggggagacgaatacaccgcggaaatcgtattggtctgagggctattggccagataggcggcggtggcctgtgccatacgccggccaagatcggagagatggaagtcgggcagccgctcgtagagcagatggtcagggttgtagaccttgccgtggcgaacgaagtggatggtggttgcgctcatgagccgcctttctttttattcctacgggcatcttgcgatgttcgccgaagaacatgagaacgttgtcttaatatctccaatctaccgcgtgtcgcgccctaaccaacgattagagtatccgtgacgcaaatatgcgaatagggaaatccaacgcaaactttgcgcgaccatggacaacacatcattcgatgagggcttcgccggcaacgccacgtcagcggggaacatccaatcgggagcggaaaggagcgtagtgctgttatgtccaacaacctgtccaactcgaacaccattatggctggcatcaaggaagtgggtcacaaagtttttggtgggtatgcggagttgctgcgcatacctcataccgctcgttattccatcggttcggtgattgcctgcatgccgttcccgatggtgggcatgaccatcaccatttccgtgcagcattactacggcaactactcgctggcaggtatgctcaccgccattcaggcgattgcactggccgtggccacgccgctgctcggcaagctgaccgacaagttcggccagcggcaggtttcgattccaacgattctggtgtggattgtcgccgccgtcgcgctgaccacatccatcaccaatcgtgcgccggaatgggtgctgtactgtttgacgccgttcctggcagctattccgccgtggggcgcgatgagccgcgcgcgctggaccaaaatcctgaagggcgatcaggagcgtaccaaccgtgcgctctccctgtgcggcgtgctggacgaatgcatgtgggtaatcggcaatccactggcttccacactggccgtgatctccggtctgctggcattctcgttcaccggcatgtgcgtggtggtgggcgcgctgatgttcttgaccgagctgaccactgagccaccgtcacagactcagctggcccgcgctgagggcatttcccgcaaggaataccgtgagcgcgaggcggctcgagccgaagcgttgaaggtggagaccgcagccgaggagactcgccgccgtcttgagcgcgaaggcgtgaccgatgaggccacgattaacgccgccattgagcaggcggtcgccgatgcgcgttccggcaagaaggcgtccatctggggaccgggtctgattgcggtatgcgtcacctggttcggcttgggcgcgttccagtcggctacaggcatctcgatcatcgcattcgccaccgagtcgaatatgaagcagtacacgggctttgtattcgcctgcttctccatcagctcgttgatgggcgccttggtgtacggcgcgaagaactggtcgattgccctgtggaagcgcttctacttctgcctggccgtggtgaacatcggcatcagcacgttcctgttcgccaagcatctgtgggtgattatgatcatctacctgatcatcggcgtgtgccaggctccgacgtggattaacggcaaccagctcatgctgcacttggtgccgccttcccgcctgaccgaaggcatggcgtggatgggtgcgatgaattctatcggctcctccgccggttcggcgattgccggccagttcatcgaccgcatgggctcgcatggcggcttcatggtggtgaccactttggcactggtctcgctggtgattgcgctgattggcttcaagcagatcaagggctccaccgagcagccgaccttgactgaagtgagtgtgtgagacaaaagctaagccccctctgacgagggggcttatacgtcaaaacgctacttcggccagcctttgggcgtgtgttccagggaccagatgccgagcttgtgggagaagctgttctgccacttggcttcaagctcctcggcattcagtcgattttcagcggacttcagacggttcatcgcattggtgtgcgtatcgtcgagcagccacttgcgaatcaagaagttccagatcattaccacggcagtggccaccaacttgccgatattggtgcgcaacagatattcggcatgctgcgatacataggcatcatggttcatgccataagtggaaatccagataatcgcgtcattcatgaacagaccgactacagcgcccgccacgaagataagaatctccatccagcgcgccatgtcatcacgatgcttgaatacgaatttcatgctcgccagatagttgaaaatcagcgagatgatgaaagagacggtggcagccagcacgttgtgcatgtggaatatgccaaccaataggttgagaataccccagtcgataacaaaggcgatgacgcccacaatgccgaacttcatcagttgttcaatcagttttctcacaagggtattcaacactattgggctgactgcggaacatatattggctggaaaggccaataatctccccaaattggccttgccccggtccgttctgcaagcagcttcctacatccgcatgccatgttcaacagcaaccgctgaggctagactggaagcgaaccgaatcaaggaggaattatgcccgttattcacactcatgtgtccgtgcccaccacccctgagcagcgcgaggcgttgaaggctgcctatggcaaggcgattaccgccgtgccgggcaagtccgagggctggctgatgtgcccgttcgaagacaatatgccgatttacttcggcggtagcgatgaccagcccgccgcctatgtggaggtcaacgtgttcggccgctccgtgccgggctctgcttgggaaaagctgaccgagagcattatggccgcgctgaactccacgctcggcattcccgaggaccgcacctacatccgttacaccgccaccaccgactggggctggaatggtagcaacttctagtttgcgtatgctggctcccctcagtcagcttcgctggcagctcccctcaaagagggaagctcagatgtagaaagcccgccggtggcgggctttctacgtttcaaggggctgatttccaacattcagaagctctactagcgtttcaaggggcttttaaaacaagaaaaccggagtataaacattgcaatttcaatggtcatactccgggtttcgcaatcgaagagcccctcgaaacgcagatagacctccggaaaaccggaaatccgcccctcgaaagcgagttacctcaccttgtgcctgtcatcacacgatcttgggcatgggggtggtgaggctggtggtcaggttgacgtggaccagaccggcaccggcatgcacctcgaccttcttcagggtcacggtgcgctcttcttcgggggcacggtcgttgtcggtcatggtcgccggggacttgaccgccacgaacgccagatcgtccagcgagatgcctgcgctctggcacagttccatggcctcggacacggactcggtgaagcccggcttgtaaatcacgcgctcggccggtacgccgtaggcgttctcggccacccacttggcgttctcggtcagggccatgcccttgtgcgagtgcggttcggccggcatggagccgttctgcaacgcgtcgacgaaaccgtcaagctgcggggccagcgcctcgccgccgtcgcggaacaggttgccgatgatcggcgtgcggaagcccagctcgtcggcggtggccttcagggacggaacctgatcgtcctcgccttcccacaggttgatgagcgggaaggtcggaatgtccaggttctccaggcgctgcacgtggaacgggtagcgccaggccagctcgggatcgtcgcgccaggtggaggcacgggtcaccacgatggcggcggacggccactgcgcgccgtattcgcggcaggcgatgtccagccacttctgggcgccggcgtcggtgccgtagccggcctcgacgatgaccacgtcatgcagggcgcaggccatttccacggagaccaacgtcggaatgccgatggacacgttggcgaacgggccaccgtgcacgtagaccggggagccgtttacggtttcggtcttggccggcttgaccgcgtcggccaaaatgccagtgatacgccacaggtccacgaattcgccgaaggtcacggccttgccgtccttggtgccggcgatcatcttggacacgcgctcggaaatctcgtccatcgagcgggagagcaccacaatctgcatgagctcgcaggtcggcgtgagcacgaccttctccggcacgttgcccttgccgtagtccacggcggtggagcgcagggagcggctcggaacctcggagacacgcggcacgagaatcgtgtcgagcttgccgtcatcgatggccttctcggcgaaggagacgagcaggttctgggccgcctcgatggcgcccatttcgccgcacagaccccagtcgatgagctcggggtgggtcagggaagccttgccgccgccggaggcaccgcccttggaaccggctgcggtgatgcccatgctcggctgacgcagcacggcggtcgcatcaatgccgcgcttgttcagggcgtcgatcagggcgatggtcgtggtggtcttgccttctccgcgcgatgccttgagcggcgtatcggcggtgacgagcaccaccttgccgtgcttgcgcggggcgtcagggttctcggccaggtacttcatgtagccgaatgcgtcgatcttctggaccagaccgtactggctggtgaagtcttcgatggtggtcatataaagcctttctgtgtttgtgtgatggggcggggtggtggggcggcagtcgccgcctcttcgcctaaaaacagcccactgggctgttttcttaacggctcagcccctcagggaggggagctcaatacggactaaaagtcggacatgtggaagccgttcttcatttccatgctgcgagtgtacagcacggagtcaagcagcttttcggtttcctccttgagctggtcggccatggtctggttggcggcggcgagaatctcgcgcacctcggggttacgcagcgcggcgatggtctcgtccggggtcatcggctgcacatcgccatccacgttgtcggcctcaaattcctcttcagcggcggactgcgcggcttcctcggcggccgtcaagcccagacgggcgatctgctcgtcggtggcggcgaccaagcggtggcccatcgcaccggtcttctcctggtagcgctcaacggcgttggacgtggagcggaaggcgccatcgcacagggcggcgatgatgcggttggcccagtagaagttctcggacgtcacgcgggtggtggtgtcctcaaggtaggcgggcgtggtgtccacgttcgggaagaacggtaccagcgtgttgaacgggttggagccgtatgccatccactggatggcgcgggaggcctgcgggcggtacgggcggatctgcatcaccgcgagctggctctggcggttgatgccgatcgtgcggtacatgtggcgggtgcgctcatcgcccagctggccgtacggatcgaacggggtgccctggtagtgggagctcagcacgtacttgatatcctcgatggtcaccttgcgctcaggctgacgggcccacgggatgtcgtcggaggtgggcttgtggtcggcgtccgggccgtcccacacctcgtcgtacgggttgaggaagcgctgcatgtaccaggcgcgcggggtgttgtacacgtggtcggagtcggagtgggagccgaaggcatcgcgcgggttgaacggggtagtgttctccaccgcgaggtccaaatggttggtttcgatgaattcggcaaggtcttcggaacacatgtgcgcttcctggtcacccagggcgtcctcaaggtcgaattcgtcgataccgagctggttcggcatggtcacgtaggcctcgtccggcacgcgcttggcaatccagtgatggccgcccacagtttccagccaccagatttcgttggagtcggagaaggcgacgccgttcatctcgtaggtgccgaattcctcaagcagcgcgccgaggcgctggacgccctcgcgtgcggtcttgacatacggcagcacgatggtcaggaagtcctcttcgccgatgccgccgggcacctcgggctcatcgcccttggccggcgtgtattccacgaacgggtcggcgccgagcacgcgctcgttggtggtcagggtttcggtggcgctcatcgccacgttcgcctcgttgacgccggcctcgccccaaataccttccttgaggtccgcgttcggcacggcggtgtactgcagcgggtcgtccggcagggtgatggttaggtgggagatcaccgacttgtattcgcgcggctgttcctccggcttcacgacgatgaagcgcttcgggttgaactcgccgttcgcggaatcctcgttgcgggcgatgatggtcgagccgtcatagctcgcgtctttgcctaccagaatcgtggtgcaggccatagtgtgatggtgtcctttctttgttgtagtcacgctcccactggcgggagctggacgacgaagtcggactgaaggtggttttgtactgacccacccccagtcagtgatgctgacagcccccgcctgcgggggctcatgtggctcacgccttgccggtcaggaagatgccgtcggtgtcgggcacttcaccgctgttgcgcagcgcgtgcaacagctcgttgagccagaagccctgattcaagccgggcaacggcttcttggtggcccacacctgcaggtagtactcatgatccttgtccggcggctgcggaccgttgtaccgcatgatcaccgccgggtcagtgctgcggcccaagaacttggaggccgaggagttgcgcccctgcacggtctcgggaatcatggccggcagctgacgggagaagtccggcgggatggccaacgcatgcgaatcattgaagtcgtacatcagcgcatcaatcggcagattggccacggaccagtgaatccactcgaagccgcagaccggaatcgaatccgggtccacgaactcccagtgcaggtagcgggcctcgggatccacatcatcgatgtagaacgggaaggagacgaccggcacgccgccgttgaaatattcaggggccgcagccttggcgaaatcgtccgggatgacggtgaaatcggcggaaatcttcatacgtcccagtatcgctcatatgtgtgacgtactgggagctgtgcgttacggggtctctcccccagtctcgctgcgctcgacagcccccactcatcagaggggggctagttgcgtcgggttatgagatcagggcgcagaagagggactcgaataccagtagcgggttgccgttgccggctaggcgcttgcgggcgtgggccacttcgtccagacgggtcacggcaccggcccggttcaatcgcaccgacaattcggtgatcgacgagcggttctccaggttgatgaggcccaccgaatcctccgcattgttctgcagcaccgccacatctcggtagatggaagcgatggagttcagcgcacgatccaatacgtcgcgcgtacggcgggtgaccaaacgcttcacatcgtctttcttggcaatctggttgaatgcgccacgcagtttcggcgggatgcggtcgctcggtgccagtccgttgatgcggcggaattccgcttcctggccggcggtgatgcggttcgcgtccgcctcggcctgggccttggcattgtcgataagattgccggccaacaacactgcatccgaggcacgggccagattcagcacaccgaccacaagttcatcgcggtcggacataacccgttcgtcggtggcgtacaacttggcgatgccgatatggccttcggcgagtcgggccgcacgctgcgccacttttggctcgacattggtggtggaggtcaggaatccggccaccgcctgggtggagggcacggcgaggttcacgatgcgtgtgcgcgagcggatggtgggcagcacgtcctgggcgctgggcgcgcacagtagccagatgcaatgctcggccggctcctcaatctctttcaagagcacgttggtggtgcgctcaagcatgcgatccacgtcttcgatgatgatgatgcgccacggcgcggtggcgggcatctgctcggaggtagtgatgatctcacgcacctgatcgataccaatagtcaccttgttcgtggtcagcaccgtgacatccggatgcgtgccggcaagcacctgctgggtgacgcgcgtgggctcagcgctcatgccgtgatccgggctttccagcgccgccgcgaatgctcgggccatgttggaacggcccgatccgggaggtccacagatcagccacgactgggtgatctggctcgggtcgccctgcgcgatacgactgagcatgtcgattaccggcttttggccgactagtgaatcccatacgctcatgcgagctccttgatgtcggattcgatggcagcccataccgcttcaatgctctggctcgcatcgataacgcggaaacgattcggctcggcggcggccaagtccaagaaggcctggcgggtgcgggactggaagtcatcaccggccgattccatacggtcttccgcgtgttcgaggcgatggtgggacagggctgggtccatatccagcaaatacgtgcggtcgggcagcaggttgttggtggcccacatgcttaaggatcgaatctcttctggcgtgagttcgcggccaccggcctgataggccaaggaagagtctaaatagcggtcggtgatcaccacttcaccgtgctccaatgccgggcggatggtttcggcaacgtgctgggctcggtctgcagcgaatagcagcgcctcggcgcgcggtgcgatgtcgactgcgcccccatccacaccgtgcaacagcagttggcgaatggccttgcctaacgcagtgcctcccggctcacgggtaacgaccacggtacgcccctgagcctcaagatacgcatgcagccgctcgacttgcgtggtcttgcccacgccatcgacaccttcaaacgaaacaaacagaccgctcatgctattgaccttagcgttaggcgcagagttgcgcccaacaggcagttaaaccagctctacctccgtttcaaggggctgatttggtcttttctgaaggtctacttccgtttcgaggggctgttgcccaagtagacaacgttccaaaacggcggaatgacgttggcgcggagccgttcatactcgtggttcagcagatgaccagccccttgaagcggaagtagatattctcaaaacgagaaatcagccccttgaaacgcaagtagagcaataattccgctcagccacgcttgggaattacggcggggcgctcgtagtcctcgttggcggtcagccagtcgacgtcctttttcacagtggcgggggtggaaccgagtttttcggcgatgcgctggttggaccagcccttgttcgccaacttcttgacttcggcacggcgttcggcgcgcttggcctcctgcgccgaaaccgcagccgaggtaccgcccttcttgcccttgccggcaacggccttggcgccaccagcacgcccagcaccgcgacggccacgggtggagggaccagccgcacgcttttcggcgagcagtcggaaggcgtcatcaggggtgatggattcaggcgtgtactgacgcggcaccgtacggttggtctcgccatcggtgatgtacgcgccgaaacggccgtccttgatggtcacgttcttgccggtgttcgggtccttgcccaaatcacgcagcggcggcttggcggcaccacggccacgcccgcggccgtacttgggctgcgagaacagttctttggccttgtcgatatcgaccgtgaagatctcgtcttccgaggccagcgagcgggtctccgacttgccgtcggcacccgtcttggtcaggtaggggccgtagcgaccgttgttggcggccaccgtgcattcggatacctcgccggtttcggcgttggtttcctcgtatgtgcccacttcgcgcggcaggctcagcagctttagcgcgtcttccagcgacagcgattcagggctcatcgtcttgaacaacgaggccatcttcgggcgcgacgcggcggcggccgcggccttcttcgaacccttcttggccgcagaagcaccagcagtatcgccagcagcgccagccgaagcctcagccggcggcaccaacgccacatacgggccgaaacgcccattgcgcacctcgacggtaccgccggataccggatcaacgcccagctcgcgcggtccaccggagtggttgtcgatcaaatcgcgggccacggccaccgtcagctcatccggcgcgatggtgtccggcagagacgcgcgcttcgggttgccttcggcgtccagatgctccatgtcttccagatacgggccgtaacggccgacgcgcacgtgcaggccgtcgccgatgtcgatggtgttgatggcgcgcgcgtcgatctcgccgagctgcgcgacctgctgttgcaggccttcgtgcgcctcgtcggcgttgcgggcggcgccctcgccggaaccgaagtagaagtgggtgagccagtcgcggccggattcctcgccgtgggcgatgcggtcaaggccgttttccatctcggcggtgaactggtagtcgaccagcttggggaagttcgtctcgagcaacttggtcacggagaaggcgagccagctggggatcagcgcacggccacgctcgtatacgtaaccgcgatccatgattgtggaaataatgctcgcgtaagtggacgggcgaccgatctccttggcttccagcgtcttgaccagcgtggcctcggtgtagcgggccggcggctgggtttcatggccgtccggttcgatgtcgcttgcctcgacctgctggccgacgctcatcggcggcagggaggtgttggattcggaggcgtcacccctgacggccttggcgtccgtcttgccggcggcagcagcctggtccgagccagccccagcgccgggagcggcggccttgggcttgcgcccctcccccgtggccttcataaagccggggaattcgatgacggtgccggacgcctggaacacggcctcgccctcggtggggccggccggcgcagacaggcgcacggtggcggtggaaccggtggcgtcagccatctggcaggcaagcgtgcgctgccagatcagcgtgtataggcgcagctggtcgccgggaagtttggaagccagctcgtccgggtcgtggaagcgcgagcccgccgggcgaatacactcgtgggcttcctgcgcgccagcggttttggtggcgtactgcttgggctcggcggagaggaacttgtcgccgaaatggtaggagacggcgttgcgggcggcggtgatgccctcctgcgacagcgtcaccgaatcggttcgcatataggtgatgtagccgttctcgtacaggctttgggccgcgcgcatcacggcgcgagcacccatgccgaggcgattgccggcggtctgctgcagggtcgaggtggtgaacggcggctgcgggcggcggcggtacggcttggtttccatcgacatcacagtgaaatcggcggtcttcagcgccgaagccacggcggtggcaccagcctcatcaagctggcgaacgttcgccgcgaacccgtccggggtcagctggccgtcggcaccgaaatccttggagccggcgagtcgcttgccgccgagcgcgatcatgcgggcggagaattcggcacgctcccccagcgcgtcaggcgcggacagcgtggcgacgatatcccagtacggcgcgcgcttgaacgccatgcgttcgcgctcgcgttccacgatcaggcgggtggccacggactgcacgcggccggcggacaggcccgggcccaccttgcgccacagcaccggcgacagctcatagccgtacagacggtcgaggatgcggcgggtctcctgtgcgtcgaccatattgccatccacatcgcgcgtgttgttcagggaggcgttgatggcgttcttggtgatctcgtggaacaccatgcgcttgaccggcacctcgggtttcaaggtctgcaccaagtgccacgcgatggcctcgccctcgcgatcctcatcagtcgccagatagagttcatcggcgttcttcagggccgatttgagttcgctgaccgtacgcttcttgtcgccgtcgacaatgtaatacggcttgaacccgtcgttgacgtccacgccgaacttgccgaacttggccttgtctgccgcgggcacctggctgggctgcgcgaggtctcggatatggccgaccgacgccatgacggtgtaccccttgcccaggtagtcaccgatcttgtgggccttggtcggagactccacaatcaccagtttggtagccatacccactccttatgtattgcgcgaaacacacgacgtttctggcgtcataatactcatgaatcatgtccaactgccaaattccgccgttgtgccgggcaaattcggccgttcgcaccccatgttttaccgtttgggcggtgccggcggagcgccgatcagacccagccggcttaagggcgctgcagtgatctgacgcagggccagcaacagtccgaatgcgagcatggccacacccgcaatgcccacaacagcgctgacattcgccccctgaaccgcccagctggcgctgacattgagccccggcaccacctgccagatcacataaccgctgtaggcgagcaacagcaggcccccggtaatcagcacgctgccgacgatttgcacgctcactgaggagacgcggcgacccggctcgtccatgccggacttgcgcgtaactgccagagcgagcagggccaatcccgccaccagcaggatggacatcgccacatccgaagggcgatgccattgtccgtatatcacggagacaccgacggtcaccgcccaaaccacgccgatgacgcccgccaaagctcgaaccgcacgaggcacggtaagcagcagaatcaccgcacaggctgcggccagcatcgtgtgaccggaaggcgcggaattagcggcaggcgattcagtgttgatgatgaacggacgcggcaacagacccttgatacgggtgacggccaagcagaccacggcgaacacggcgatttgcccggccaaccaccagcggcgtcgaatcagcgccgtaataatgccgattgcgtgtttgtgttcaattagttgttgcgggtttagtcacgatgatttttcgggtttagaactgttagaattacaggaccaacaagggtgttgcacttctaaatagacatcggggacaaggtattaggcgcggtatcaggtgagacttctgaagatgccatcgtattgcacttcgacatccgttatgcggtaggccaggcacacgaacaaatcatcgagcgtattcaagcacaagccgaagcggcgggcggccgcattgtcgacatccttaacgatgacccatactacgtgcaggctgacgacccgcgtgtccagttgctcaccgcaacctacaacgacgtgctcggttgcgaggctcgacccgtggctgtcggcgacggcacccacgcccgctttatcccgcgcgcactcaacttcggtcccgaattccatgccgaccatgtgccggcggtcgacggcatcgacctggagaccccgccattcatcgcaccaggtgccggcaacgcgcacggtgccgatgaatgggcctcgctgaaaaacctgaaaacagcgtttgtcctatatgcgttaggcctagtgcgtctcgaccaatacctgcaatagctggcggataagacgtttgacgtgattatgaccttgcgtatgctttttgacgagcctactattcgtattgttcaagtacgccatgtcggggccgacgcgtctggtgaacacgccgggtcatacacggatgatagagtgaaattccatggttagaagaacacatggtaattctcaagaacacgtcaccaagcatattttcgtcactggcggcgttgtctcctctctcggcaagggcctgaccgcatcttcgctcggtcgtttgctgcgcagccgcggtatccatgttctgcagcaaaagctcgatccgtacatcaacgtcgacccgggcaccatgaacccgttccagcatggtgaggtctacgtgaccgaagacggtgccgaaaccgatctcgacatcggccactacgagcgtttcctcgacgtcttcctgagccagaaggccaacgtcaccaccggtcagatctatcaggaagtgctgcgcaaggagcgcgccggcgaatacctcggccagtgcgtgcaggttatcccgcacatcaccaacgaaatcaagtctcgtatgcgcgcccaggcttccgatgacgtggatgtgatcatcaccgaaatcggtggtaccgtcggcgacatcgagtcccagcccttccttgaggccgcccgcgaagtgcgccgcgatctcggcccggacaactgcatgttcgtgcacgtttccctggtgccgtacatttccgccgcccacgagctcaagaccaagcccacccagcactccgtgatgatgctgcgccagctcggcatttccccggacgcccttgtgctgcgctccgaccgcccgctcaatcagtccatcaaggacaagatctccctgatgtgcgatgtcgatgccgaaggcgtggtcaactgcgtggatgcgccgagcatctacgatgtgccgaagatcctgttcgaggagggcctcgacgcctatgtggtgcgtgagctcggcctgccgttccatgacgtcgattgggacgaatgggccgacctgctggagcgtgtgcaccaccccaagcacgaggtcaacatcgccatcgtcggcaagtacatcgatctgccggacgcctacctgtctgtcaccgaggccatcaaggccggcggctttgccaactgggccaaggtcaacgtcaagtgggttgcggccgatcgttgcgaaaccaccgaaggtgcggccgccgctctcgacaacgtcgacggcatcgtgatccccggcggcttcggcatccgcggcatcgacggcaagatcggcgctctgaagttcgcccgtgaaaccaagctgcctgccctcggcctgtgcctgggcctgcagtccatggtcatcgaatactcccgccacgtgctgggcattgaagacgcgaactcttccgagttcgagcccgattgcgccaacccggtgatcgccaccatggaagagcagaaggacatcgtggccggcaagggcgacatgggccacaccatgcgtcttggctcctacccggctgagctggaggaaggctcgctggtcgccgaactgtacggcaccacgcatgtcaccgagcgccaccgccaccgttacgaagtcaacgtggcctacaaggatcgtctgcgcgaaggcggcctgcgcatctccggccagagcccggacggcgagctcaccgagttcgtggaactgccgcaggacgtgcacccgttctatgtggccacccaggctcacccggagttcaagtctcgcccgaccaagccgcacccgctgttcgccggcctggtcaaggccgcgctcgaccatcaggcggcacgctgactcacttttgtgccgtgcataatatcgcggcatgatgtgctggctgccgtcatcggcgtagcgcaagacatacggtaaagacgtggtggcgaaacatctaatgatgtttcgccaccacgtctttttttgttgtatgagcatcatgcagcatgatgtattggaaggcgacggtaaaaaattaccgtttctatggtgtgttggtagtatgcagataacgcttagtaggccatcgcagaaagaccgaccatgaccgaacaccttgatgactcgacccagcagtttgcgcctctgtttggtgcgaataatgccgtcagcggcactgtggcagacagtgtggatgctgctgcatcagattccattcagggcgatgagatgaggaggcgccgcatctggccgtgggtggtgattgcttgtctgctggttgccttgggggctgcctgtggcggcggtgtttggttcttccaagatcacgtgctgcctggcacaacgctatggggaaattcagttaccggcaaaaccgagcaggagattgtcgacctaatcaacgaccaggtcgacaacaccgcggtacgagcgaaataccaggggcagtcggcgacgttcacgctgaaagatctcggcatcgaagttgatggtgaagcaatcgcatccgatgtcatcaatgcccaacgcggtgacgcatggtggcaacagtatgcgttctggattacgcatgatgtggccccgcaaatcaatcccgagctcgctgatggcagtgtggtagataaggcgctgaacattgatgcacaagaacctgttgacgcgcaagtcgcattgaacgataacaacagtggcttcaacgttattgcgggagaaaatggccagggagccaacgccaccagcattgcgaagcaagccatttccacagtggagtcattgggcagtgtccagccacagaccgttcgggtggaactcgacgtaaccgaaccgacgattaccaatgcaattgccgatgaggcgaaaaccacgctggaaaccctagtgaacaatgccgtggccatcaaggtggcggataaagacatcgccaccgtgaatgcgtccatgctgggttcggccatgcgcatcgacgccaaccagcagtcaaagctgaaagacaatgaagtacgtaatggctacgtggtctttgatgccgataagctgcagcaatactatgacgagcaaatcaagccgaatctcaaattggaacgtgaagacaagaaggtcgtcgtcaataatgctggcgaggtgctgagcactgaaatagaaggccatgatggcattgtgattgccgatggcgcggatacggaggttggtgctcgcttggctcaggtgctggccacgggaactggctcagtgaatgtggacggcaaggtagatcccaaacaggaagtcaaggtcgctcatcgcgtggcgattgacctgtccgaccgtaagctctatgcctatgagaatgacacggtggtcaagacattgaatgtcgtggtcgcggagggcaacgacaacgtcaccggcgaatgcgttggcatgatgtgtacgccgacaggtgacttcaacgtatggcaaaagttgcccagtcaagatatgagcggcacgctgaatcttgccgatggcacggtggaaacatgggatgtcaaagacgtgggcttcgtcaattacttctcctccggttgcgcaatccaccgtattgccggcggatatgtagcggatgccgtaatgccctccattgccaacggatctcatggttgcgtgggtatcggatgggatgtggccgaatggttctacaactggtgcaatatgggcacgagcgtgcatatccaagtgtgatatgcaacagtgtgatatgtaacaaatacggcatgcagtggtgcgacacataatgccgcatacgcgatgttcggtgtgcatgggacaagcttgcccggctccaatatcgctgtatcgcattcgtgtaatcaagcccacagccaatatgcgtcagggcggctagtgtttgcacttgggttctgctaggttttcataggattaagtgtgatacaaggaaggcaggatggtgaccgaaaacacagcaccaaacgccgccgctgacgtggagatgagccagtatgtggctgatcgtacccgcgtcaacgaggacaagatcaagaaggatgacgagatcatcagccagttcggcgactacaactatggttggcatgattctgatgccgccggcgaagccgcaaaacgaggcattgatgagaacgtcgtacgcgcgatcagcgccgacaaaggcgagccgcagtggatgctcgacatgcgtctgcgtggattcaaggcgttcctcgaaaagcccatgcccgattggggtgtggatctctccggcttcaacgcagacgacttcaagtactacgtcaagccaatcgacaagcaggcgaaaagctgggacgaactgcctgacgacatccgcaacacctacgatcgtctcggcatcccggaggcggagaagaaccgcctcgtctccggcgtggccgcccagtacgagtcggaggtcatctacaactccatccaggaggacctgaagaagcagggcgtcatcttcgtcgacacggacaccgctgtgcgcgaataccctgaactcgtcaagaagtacttcggcaccgtcgtgcctccggaagacaacaagttcggtgccctcaacaccgcggcatggtccggcggctcgttcgtatacgtgccgaagggcgtgcatgtggacatcccgttgcaggcgtacttccgcatcaacaccccggccatgggtcagttcgagcgcacgctcatcatcgcggacgaaggctcctacgtgcactacgtggaaggctgcaccgccccgatctggtccgaggactcgctgcacgccgccatcgtcgagatcatcgtcgaaaagcacgcccgcgtgcgttacaccaccgtgcagaactggtcgaacaacgtctacaacctcgtcacccagcgtgcctacgtgcgcgagggcggcacgatggaatgggtcgacggcaacatcggttccaaggccaccatgaagtacccggcctgcatcctcgccgaaccgtacgccaaggcatccaccatgtccctcggcttcgccggcaagggccagtaccaggacacgggcgcgaagatgattcacctcgccccgcacaccagctccaccatcgtcgccaagtccatttcccgtggtggtggccgctccgcctaccgcggtctggtcaaaatcgtcaagggcgcgtacggttcgtccaactcgaccgtgtgcgatgccctgctggtcgacgacttctcccgctccgatacctacccgcatgtcgacgttcgcgaagacgacgtttcgatggcccacgaagccaccgtttccaagatttccgaagaccagctcttctacctgatgagccgaggtctcacggaggaagaggcgcgaggcatgatcgtgcgcggcttcgtcgaaccgatcagccgtgagctgccgatggaatacgcgctcgaactcaacagacttgtggaacttcagatggaaggatcggtgggctgattccgatgaccgacaacacaacacccgtcaaggaaatcaagattccggtcgccgaccccaacgacccgtacgcgattccggccgccatgccgtcctccgtggaccatgccgtgcgctcgttcaacgcaggcgactacccggagcccagccgcaagcaggacgaatggcgctacacgcctatcgagcgcatcaacgagttcttcaccgtgttcaagcctttcggcgaaacgcagatcgaagtctccatgattgacggctcgccgttggccgaaggcgtgaagctcagccagatcaagctcggtgagggcctgtccggcactgtgtccaagcccaacgaccgcgtctccgcagtcgaatgggaatccggccgcaccgcaaccattctggaactgtccggtgagatcgcccagcccgtgctcgtcaaggtgcacggcgcgggggaggatctcgacgctttccatctggtgatcgccgccgccgacaaggctcatgcggacgtcgtcgtggaacacgacggtgacgcacgactggccgaaggcgtggaaatcaccaccggcaaggactcgcacgtctccaccacgttcgttcaggaatgggccaaaaccgccaagcatgtggccaaccaccgcatccacgtcggcgaaggcgcatccctgcgccactccgtcgtgaccttgggcggcgacatcgtccgcatccgcatggatcaggacttcggcggcgaacagggcgacctcaacatgctcggcatctacttcgtggaccccggcgagcacatcgaacaccgcacgatggtggtacacaaccaccccgactgcaagtcccgcgtggtctacaagggcgcgcttgacggcaagggcgcgcactccacttgggtgggcaacgcgctcatccagcccaccgcccccggcaccgactcctacgagctcaaccgcaacctggtcctgaccccgggcgccatcgccgattccgagccgaacctcgaaatcgaaaacggcaacatcatcggtgccggtcacgcctcttcggtgggccgcttcgacgacgaggaactgttctacctcgaatcccgcggcatccccgaaaccgacgcccgcaagctcgtggtgcgcggcttcttcggcgaactcgtcgaggagatcggcattcccgccatctccgaacatctgatgaccgtgattgaccgccgactggcccgtggtgaaaacgacgccatggcacaggtcctcgaagacaagtaagaacagcatttttaggagcacaacaatgtcaacactcgaaatcaaggacctgcacgtccacgtcgaaaccaaggaaggcatcaagccgatcctgaagggtgccaccctgaccgtccactccggcgaaacccacgccatcatgggccccaacggttccggcaagtccactctcgcctacacgttggccggccaccccaagtacgtggtcgactccggcgaggccctcctcgacggcaaggacatcctcaagatgactccggacgagcgcgccaaggccggcctgttcctggccatgcagtacccggtcgaaataccgggcgtgtccatgaccaacttcttgcgcaccgccaagaccgaaatcgacggcgaggctcccggtattcgccagtgggccaaggacctgtccgcagccatgaagcgcctcaagatggacccgaagttcgcctcccgttccgtgaacgaaggcttctccggcggtgaaaagaagcgcgccgaagtgctgcagctcgaactgctgaaaccgaagtttgccgtccttgacgaaaccgactccggcttggacgtggacgccctgcgcatcgtgtccgaaggcgtgaaccgcgccaaggaagccaaccagttcggcatcctcatggtcacgcactacacccgtatcttgaagtacatcaagccggacatcgtgcacgtgttcgccgacggccacttcgtcaagaccggcggccctgagctggccgacgaactcgaagagaacggctacgaccagtacctgcccgaaggcgccgactccgagtccgcactggcctgagtccgtgaccgtgggagtctgacatgccctattctcgacacgctccgggccgcttaggccaggtctttacggtcgcgaacaggccatgtcagactcccactcgtttcgtacaattgttacgtaagtagggggaacataatggttgattttaaggcgattcgggcgcagttcccgattctggatcaggagattcacgggcacccgctcgtgtacctggattctgcggccacctcgcagaagccgaatgcggtgatcgacgccgaggcgaacttctaccgtacaattaacgccggcgtgcaccgtggtgcgcacgagctggccgcccgtagcaccatggcctttgaggaggcccgagccaaggtggccaagctggtcggcgcgaatgcggccgaaggtgaagaggaggtcgtcgtcaccggtggtgccacggccggactgaacctgctcgccaccgcattcggcaatgcatcgctggggcgtgggggagaagccgccaagcgttttgccctgaagccgggcgatgagatcgtcgtctcgcgtgcggaacatcattcggtgctgctgccgttccaggagctgtcctaccgtaccggcgccaccttcaagtggatcgacctgaccgaggacggccgtgtgcgtacggacaacctcgacgaagtcatcaccgagcgtaccaaggtcgtggccgtcacccacgtgggcaacgccacgggtgccatcaccaacatcgccccgatcatcaagcgtgcgcatgaagtaggttcgatcttcatcttggacgcttgccagtccgtaccgcacctcaaggtcgatttccacgcgcttgatgtggacttcgccgcctggagcgcgcacaagatgtacggtcctaccggcgtcggtttcctgtacggtaagcgcgacctgctcgaagccctgccgccggccaacttcggcggctccatggtcgagctcgcctacatggaccacgaggcccaatacatggcccctccggcccgcttcgaggccggcacccagccggtcgcccaagtggtggccgcaggcgtcgccgccgaatggatgatgaacatcgggctcgagaacatcgaagcccatgagaagaccatcgccgccgaactgctcaagctcggcgacgtcgatggcattcgcatcctcgggccgcgcgaaaacgtggaccgcatcggcaccgtggcgttcgacgtggccggcgtgcatccgcacgatgtgggccagttcatcgacgcccagggcatcgcgattcgcgtgggacaccactgcgcccagccggtacaccgccacttcggcctatacgcatccaaccgtgcctcctccggtgtctacaattcggtcgaagatgcccaagcgttggtcgaagcggccaagggcatccgtaagttctttggagtggagtaaaacagaacaccatgaacgaattcggtatgagcggggatgacctcgaacagatgtaccaagaggtcatcctcgaggcgtcgaaacatccgcatggcaaggaatcctttgcgcccaacgcagcggtcgaacagtccgcggacgcagcggccaatgtcaccgtacaagccagccacgaatactgcacgcccggtgaatcgcaccagttcaacccgacctgcggcgacgaggcgaccatccatgtcgaagtctccgatgacgaaccgcacaccatcaagcgattggtgtgggacggccacggctgctccatttcgcaggccagcctgtcggtgatggtcgatctggtggacggcaaaaccgttgacgaggccatggatctggaacagacattccacaagctgatggaatcgcgcggtgccggtctggacgacgagaacctggaagaaaagctcggcgacgccgtggtattccaaggcgtgtcgaaataccctatgcgcatcaaatgcgctctgctaggctgggaagggctgaaggactccatcgccaaagccctcgctgcaaagaactgaggaaatatgtccaacgataatttggttcccgaaccacagccgtccgttttcgatgctgtcaacggcgtcctgcaggacgaggaggccgctcgccgcgtgatggccaacccggccttggccaagggcttcccgaacggacgcccgatcgagcactctgctgcgtccggcgatgacacctgtgcgtgtggcggtcaccacggcaaatgcggttgccaggatgacgaacagtccgatggcagcgagattccgatcaaggcgattgacgatatcggccgcgccactgccgaagacgtgcgcgaggcactgcatcaggtgattgatccggagcttggcatcgacgtgatcgatttgggtctggtctacggcattgagatcgatgagctaggccgcgccattattacgatgacgctgaccacgccggcctgcccgctgaccgaccttatcgaggacgaatgcgcatccacgctggccggtctggtcgaggagttccgcatcgactggacgtgggatccgcgctggaccatggagcgcatcacgcccgaaggccgcgaccagctcgccgccctaggcttcagcttcgacaatatgccaaagtactgatagcgcttagtaagttccctcatcagagggagctctatacgagaaaagccccgcatgatgcggggcttttccatgtctggactggtcaatcagtcatcgacgatggtgttcttcgggacaaccgtgatgccatccggcgtgacggtgaagccacgggccagatcgtgctcggtatcgatgccgacagtggagttctcggtgagcaccacgttcttgtcaagaatcgccttgtacacgcgggcgcggcggttgatgactacaccgtcgaacagcacggaatcgacaatctgtgcccacgagtggatacgcacattgggggagagcacggagtggtgcacttcaccgccggagacgatcacaccgggggagacgatcgaatcggtggcgtggcccagacggtcgcggccggcgtgcacgaacttggccggcggcaggttgccggacatcgtgtaaatcggccaatcctggttgtacaggttgaactcgggcacataggcgatcagatccatgtgcgcatcgtagaactgcttaatcgtaccgacgtcgcgccagtaagcgtgatcagtggccgtggagcccggaatctcgttcgagttgaagtcgtagacgccggcttcgttgcgggaagcgaagtacggggcgatgtcgccgcccatgtcgtgcttggtgtcggcagccttctcatcgagagccagagcctcgaacagggccttggtgttggcgacgtagttacccatggaggccagaatctggttcggattgtccggcagaccggtggtggtgggcggcttctcctggaagttcttgatcatgttcgggtgatcgggatcgacctcaatcacaccgaactggttcgattcctcgatgggctggcggataccggccacggtgaactcggcgccggactcgatgtgctgctgtaccatctgttcgaagtccatgcggtagacgtgatcggcacccacgatcaccacgatgtccggctggacatcctcgatgatgttgatggtctggtagatggcgtcggcggagccgagataccagtgcttgccgagacgctgctgcgcgggcacaggggagacgtacgagccaagcagcggggagaaacgccagacctgggagatgtggcggtcaagcgagtgagacttgtactgggtgagcaccacgacctgacggtacccggagttcaccaggttgctcaacgggaaatcgatcagacgatacacaccaccgaagggaacggcgggcttcgcgcgatcacgggttaacggcatcaggcgggtcccctcaccacctgcaagcacaatcgacagaatcttgggattcttggtcatcgtaactgtcctctctgttactgagcgtctttcgacaccgcactgccgggccggatgcttccttgcattcggtttacatagttaataattgcagaaaaaaacgaacatgcaaggctttcgcccccgcgtgccgtgaacttgcgatgaacagtttcgtagatttgttaaggatccggccttttcggagcgcgtgcgattccttagcgtgtcgcgtagaacgccactgcgctggatgccgccacgttcaggctatccacgccgtggctcatcggaatcttcacggtcaaatcggcgcgggcaatcgtatggtgggacaggccgtcgccctcggtaccgaagatcagcgcgagcttgtcgatatgcgtcggatcttcggcaggcgcgtgcagacggcgtgtcagttcgtccaacgaaatcgaacgatcctccaatgccatggccacggtggtgaagcccagcgacttcaactcgtcgatgccctggaacggccagtaatgcttgttttcggtgccgtcgtcgttgaacccggtgatacgggtccacggaatctggaatacggtgcccatcgacacgcgggcggcgcgtcggtacagcggatcaccgcaggagggtgtgaccagcacggcatccacatcgagcgcggccgccgaacgcatcagtgcgcccacattggtgtggtccacgatgttttccattactgccacgcggcgggcgctcttgcagacctcggctacggagggcaacggccagcgtcgcatcgcgcatagggcgccgcgatgcaaacggtagccggtcagacgcttgagctgctcaggtgaggccacgtagacgggaatatccgcgccccagcgcccgtcgatgaagtcgaaggtgtctttcatgccctccagccaaggttcctcgaccagcagtgacagcggttcgcggtcagcggccagcgcgcggtcgataaccttgggggactcggcgatgaacacgcccttggctggttccaagcgattacgcaactgcatttcggtgaggctcacatacgcttcgacgcgcgggtcgtcgacggtgtccagcgtgatgaactgcattggtggcctttcgtgtgtgcagataacgaaaaaccccttgcaatgcaaggggtttatctgtgcccgagacgggacttgaacccgtacgcccgtataaaataggcactagcacctcaagctagcgcgtctaccattccgccacccgggcaggtgtcgtttggacaacgagtagatagcttagcatgaaattaccgggatgcaattcgcgcgtgtgcccggcgtgtcgcgtgtagccttgaagtcatgactgatgccctttttcttttcgacccgcaggtcgacgacgtcccggtgaacagcgacgaactccacgccggctggaagctaaccctgcccgctcacatcaagcgccatgccgtgcaggccatgcgattcaaggcaggggacagcctgcaactttccgacggcagcggcttgagaatccaggcagtgatggccgatcctgaagccggactggctgaagtcgtggaagtggggcgcgaacccgagccgctcacccggttggcgctgattcaggcattggcgaaaaccggccatgatgagcaggccatcgatatggctactcagatcggcgtcgaccaagtggtgccatggcaggcggaccgatccattgccaagtggaaggtcggccgtacagacaagaagtggaattcggtactggatgccgccaccgagcagtcgcggcgcgcctttaagccgcaactggaggcgtgtgcgtccagcaaggaggtcgtggccatctgccgcagggcctgcgtgcatggcgatgtggtgattgtgctgcatcaggatgctaccgatacgtggtccggcgtggaggagaaggttgcgcagttggtggaacgcacgctccaggacggcctgccgcggactgtcagtgtggtggtcgggcctgagggcggcatcagtgagcaggaggtagctgatttcgtcaaggccggagcggtgagctgcgtactggggcgcaatattctgagagccgcgacggccggtcctgtagcgttgtcgctgttgtctcgggtgttgggacgttacgagtaacgcccacgcgctaagctggtgcgtagcaacatcaaaccaaggagcatgatgagcgaatccgacgattgcctgttctgcaagatcatcgcagggcagattcccagcagcaaggtctacgaggacgagacgacctacgcattcaacgacatcaatcccaaggccaaggtccacgtgctcgtggtgcccaagaagcactacgccaacgtcgccgaacttgccgccggtgacccgaccgagctggcccacatcgtctccattgcgcagaacatcgccgacaaggaatttcacggcgcctaccgactggtgttcaacaccggtctcgacgccggccagaccgtcttccacgtgcacgcgcacgtgatgaccggcgaaaagctcgacgagtagtaggggaatatccgcttcgtggcaacgactacacgtaccatcaccatcccgccccaacttgaccccgtcgccgtgctcggcccggttgacgaggtcattcgcgaggtagagcgcgcctttccggacctgacgattatcgtgcgcggcaaccgcgtggcgatcgtctcccgctccaagcagaccgaagcccaggccgcacaggccgaggatttggtcaataccatcatccaagccgcctacaccgcgcctatggacgccgacaccgtgcgtcgcatgctcgaccagaacgtgctcaagaaccacgtgcgcctcgaacatcccggtcacggcccggtgcgtgacaaactggcgcaatcgacctcaaacgaacgcgcccatgcacgttctgccggctcccacgacccgacgtaccgcaagcccacggttcccggcgtcatcacctttgctgccggcgtgccggtccgtgcgaaaaccgccggacaagtggcctacgtgaacgccatcgaatcgcacaccatcaccttcggcattggccccgcaggcaccggcaagacgtatctggccgtggccaaggctgtgcgtgccttccaggacaagcagattcgccgcatcatcctcacgcgcccggccgtggaggccggcgaaagcctcggctttctgcccggcacgctgaatgacaaggttgacccgtatctgcgcccgctgtacgacgcgcttggcgacatgctcggcgccgaccagctcaagcggtacatggacgacggctccatcgaagtggcgccgctcgcctacatgcgcggccgtacgctgaacgacgcgttcgtgatcctcgacgaggctcagaacaccaccgaacagcagatgaagatgttcctgacccgtctgggcttcaacaccacgatggtcatcaccggcgatatctcgcaggtggacctgaccgtgcctcgctcgggactggccaccatcgaacgcatcctgggcggcatcaacgacatcgcattcgtgcatctcaaaaccgaggacgtggtacgtcaccagctggtcggacagatcgtggccgcctacgaccgtcactccgccatcgccggcgaccaccgcgacatcgaacgcaagggccgccgcaaccataccgacttcgatgcccgccagcaagcggattcaaccaaccaaagcgagacagacgatgagcgttgacgtcaccaatgaaacccagtgggtcatcgaccccaaggtcttctccgatttgggtatttgggtactcgaccagatgcgcgtgagcacccagtccgacctgaccatcatgttcgtggatcccgatcccatcgccgaactgcacatgcgttggatgaacctcgaaggcccgaccgacgtgatgagcttcccgatggacgagctgcgccccggcgacggcaaaaccgtgatggaaggagtgctcggcgacatcgtcatctgcccgtgggtcgctgcccaacaggctgccgcagccgggcacagcaccatgcaggagatgctattgctcaccatccacggcatcctgcacctgctcggctacgaccacgtgacccccgagcaggagcgccagatgttcggcctgcagcgacagctgctgctcaccttcttcgccctacgccacgatgccaacgtgcaggccacgctgcccgccggcacacccgacgcgctggccctgtacgacgccgcgcacggtgctggccgcgacctcgattccaaataagctcccaaatcaatcacaccaaatccggattattcgataccgttcaaggacattcaaggacaccgaaaaatcattatggagtattccagtaccacgccgatcgccatcaccgtcattcttgtactcgtggcggccctgttcgtctggctctcgctgaccatggccgccgctgaaggcgccgtggcccgcgtaacgcgagccagccttaacaatctcatcctcgaggtgcagaccgactccgaagcaagccagttcctcaagatgaagaagatcgacaagattcatcgcgtgcaacggctcatcgccgaccgttacgccaccgccggcagctgtgcgttcttccgcatcgcctgcaatgtgctcgacggcgtactggtgtcttccatcgcatccctgtggggtgcggaactgtggattgaactgctctccggattcctgttcgcgattatcgtagccgtggtctccgtactggtccgcccgcgcaccgccggcatggccaagccggtcggcatcatgatttccaactcgcgcatcgtgtcgttggccaccaagctcacgccgttcgcacgcatcggtggcgacaagtccggttccaagggaccgggccgccgctccaaggactccgatctgtccgacgacgaggagcttgagaagattcagctcgagcagggcaaggccgccatcgaccgactggtggagtccaacgacttcgatccggaagtctccgaaatgttgcgcaacgtgctcaccctgtctgatacgttgactcgcgagatcatggtgccgcgcaccgatatgatctgcatggagcgcgactccgcactgtcttccgcgctgaaactgttctcccgctccggcttctcccgcgtgccggtgatcggtgaggatgtggatgacctgatcggcgtggcctatttgaaggatgccgtgcgtgccaccgccttcaacccggcggccatggagcgcgcggtcgaatccatcgtccggcagccgctgcttgttcccgaatccaagccggtggacgacctgttccatgagatgcagcgttcccgccagcatgtggccgtggtggtcgatgagtacggcggcatcgccggcatggtgactatcgaggatgccatcgaacagatcgtcggcgagctggaagacgagcacgaccgcacccagcgtactgagccggagaaaatcggagacaacaagtggaagatgcccgcccgtacgccgattgccgatctggaggagatcttcgagatcgacattgatgaggacgatgtcgataccgtgtacggcctgctgaccaagattctgggccgagtgccgattgtcggtgcctcggctgtgacgcgcggtctgcgactgaccgccgtggactccgccggacgccgcaagaaggtgtccaccatcgtcgtagaaccggcgcacgtcgagggcggcgaggaaaataacaagacccatgaggaaactgacggcgagcccgtcgaaggcgatgataccgccagcaaggagtgatatgaccgatcagaacaacagcacgaacgacgtcgatgacattgacgttaccgatgcttccgatgttgccggcgttgccgaagtcgacgcgaccggtgaaacggcgaacgtgaccaagcaggacgtgccgtatcgctccggattcgtggccgtggtcggccgcccgaacgtcggcaaatccacgttgatcaacgcgttgatcggcaagcagatcgccatcgcatcctctcgcccggaaaccacccgtaaggcgatccgcggcatcctgaccgccgaccacgcgcagctcgtgctcgtggacacgcccggtattcaccgtccgcgtacgttgctcggccagcgtctgaacgacgtggtcgacgaatctctggccgatgtggacgtggtggccttcctgctgcccgccgatcaggaaatcggccccggcgacaagcgtattctttcccgactgcgtaccgacttcgccaccaagcgtgaggacggtacgttcaagtggcgcatcccgctgattgccatcgtcaccaagatcgacgagcttggccgtcagcaactcatcaacaagctcatcgaaatcaacgatttcgccgatttctcggacatcgtgccggtgagcgccctgaagcacgacaatctggctgaagtgaagaacgtgctcattgagcacacgcccgagggcccgcagatgtacccggacgatcagatcagcgaggagcgtccggaagacaccatcgccgaactcgtgcgcggtgcgttccttgagaccctggacgacgagctgccgcattcgctggccgtggtggtcgattccatcgactatccggaagacaacgagaccggtcagggctatgacggcaaggcgcaggtcaacgtgtccatttacgtggagcgtgactcccagaagccgatcatcatcggcaagggcgcctcgaacctcacctacgtcaagaagaagctgcgcaccccggtcaaccgcatcgtcggccaaaaagccaagctcgacctccacgtcaaggtagccaaaggctggcagtccgaccccaagcaactagaacgcctcggcttctagggcgtatagacgaaaaaagctccctcgtcagagggagcttttgctatacggtttacttccgcttggtgtacatctgggtgttgaggagggtggagtagcgcttgatgaccttggggcgaatcaccttcatggaagcggtcatgaggccgttctcctgagtgaactcttcaggcaggatgatgaacttgcgcacggactcggcgcgggagacgccctcgttggcctgatcgacccactgctgcacttcggcgcgcacggcggcgttccttgccgcgtcctcgagggacatgttctcgtcaagccccttggcggcgagccacgggcgcaacgacttctcgtccaacgtcaccagggcggagatgaacgggcgtttgtcacccagcaccaacgcctgggagacgaactcgcaacgctggatgacttcctcgatcgggccgggggagacgttcttgccgccggcagtgatgatcagatccttcttgcgcccggtgatgtacaggaagccatcgttgtcgatacggcccaagtcgccggtggcataccagccatcttcggtgaacgacagctcagtggcctcgtcgttcttgtgatagcgcgggaacacggcacgacccttgacctgaatttcgccgtcctcggcgatgcgcagggagaatccggggaatgcgatgcccacggaaccagcgtggaacggcgtacccagcgggttgaacgcgcacggcgcggtggtttcggtcagaccatacccctcgtatacaggcacacccgcgccacggaagaaagccagcagttccgggtcaagcggggcaccgccggccacaatccacttggcgcgaccgccgagcacttcgcgcagcgaagagtagacaatcggatcgaaggcagcgcggcgagtgcgggtcagtgcacctgccttgccattggcggagacttccttcatatagttctgcgcggccaccacggcggaggcgaacaccacgcccttggggccgtggccggccttctgggacgcggcgttgtacaccttctccagcacgcgcggcaccacgatcatgagagtgggcttggccacctgcagatcgctgatcagcgtcttgatgccggtggcgatgtagatgcggacgttcgaggagacgacgatgtagttgatggcgcgggcgaaggaatgggcctgcggcaggaacagcaggatggtgttcctcttgtcgtgtagcagatcgggcatgtaggccggcagattcagcgcggtctggcagtagtgctcgtgggtcatctccacgcctttcggcgcggccgtggaaccggaggtgtacacgatggaacacaggtcggtcttcttgaccgaatcgatgcgctcgtccagctcctcgtccgagaccgtggtgccgtaggccttgatctcgtccaagccaccggtctcgatggtgatgatgtgctccagggacgggcactcttcgacggccccatccgccttcttacgcatgtccgtgtcctgcacgatcagcagtcgggcatcggagttgttgacgatgttgcgaatctgctcggcggaatcggtgtcgtagatggtggcgagcacgccgccgcacgccatgatcgccgcgtcggtcaggtcccagtcgtaggaagtgcggcacatgaatgccacggcatcgcccttcttcaggccgtaatgaatcaggcccttggccacggcacgcacgtcagccaggaactcgttggcggtgacggtcacccaatcgttgccggacttgtaggtgtacagcggctcatcgcccatacgctcggcgcggtccgcatacaggtcgtagatggacgtaccttcgtccagcggcggattgccttcggtggaggtggtgagcaggccggtggcggggtcgatgtcggtgacggtcaggtggccgtcgtcccaatcgtcgctgtgaggcaaagcgatattggtctcgaccggcacgtcggcgttggacaggtaatcgggctcgtccggggtgtcgtcgtggaccgggtggacgaagtcggatcccaacctgagcgccttacgggtgagattgatagtgtgctgcgtgaaggaattgataaccgacaagtcttgctcctgtaaacctttcagtgtcgtccagccatgaggcgaacgcttctcaaagttcaaattgtaatcgcccaaaccgaactcgtcaccttacgcaaccgtaggattctggcgggttaggggagtgcgtggcaaaatattgcacaggttccgatattgttgagtaaccgtgagctacgaaacggtgattgtcgataattactgagcggttggttgctgatcgatgccgggtgattgttggacgacttccgagcaattcatccgcaatgcacatggacacattcgtatttctcgctaatttcgggttcgtttctgtttcgattggcggaatctcaagtcatggcctttaccttccgactatactttctatgcggataaccatgtccattttgaagtagaacaagaaagggctctcatggcgcaaaacccagaagccaccgtggtgttcggcgttttgaatgaaacgtccgaaacggaatcccgcgtcgcgttgacgccggatatcgtcacccggctgaagaggagcggagtctcctcgattattgaggccggtgccggcattgccgccgaatacaccgatgaggattacgaaaaggccggtgcgaaggtgaccagccgcgacgaggtgctcgccgaagccgacgcgctcggttttgtggaccgaccgtccgccgagaccgtggccaagctcagggccggccagtgggtcattggcatgctcggttccttcaccgatgccgattacgtggccgcgctcgagaaggccggtctggtgggcatcgccatcgaaaagctgccccgtaagctttccagcgcccagtccatggatgagatgacctctcagaactccgtgatgggctacaaggcagccatcaccgccgccgatgcttacggttccttcctgccgatgatgaccaccgccgccggcacgattcgcccggctaaggcgctggtgctcggtgccggcatcgccggcctgcaggccatcggtacgctgaagcgtcttggcgcggtcgtcaccgcgtacgacgtgcgtcccgcctcccagggcgaggtcgagtccctcggcgcgaagttccttgatctgggacttgacttctccaagggccagggcgagggcggttatgcccgcgcgctgagcgccgaagagcaggctcagcagcaggctgccgtcgacgaaaaggccgccggctttgacatcatcatcaccaccgccaaggtcccgggccgtaagcccccggtgctgctcaccgcagccggcgtcaagggtctcaagcgtggtgccgtgatcgtggactgcgcagcatccgacctcggcggcaacgtcgaaggctccgccgttggtgagcaggtcaccgagggcggtgtcaagctgatcggcgctccctacctggcctccggcgtcgccaccaccgcatccaacctgctttcgcgcaacgtggccgacatcctcgtgcacttcgtgcgtgacggcaagctcggccaggatctcaccgaagaacttgacgacgcgctggtggttgccggccgcgccgccgccccggcagctgctgccgatgccgagaagtccgagaagtaaggaagaaggaataccatgcctactctcgtcgtttccattaccctgttcgtcctcgcgctgctcatcggcatcgaggtcatcggcaaggtgcccgccaccctgcacacgccgcttatgtccggcgcgaactccatccacggcatcgtcatcgtcggcgttgtgatcgtggcagctgaagccaatagcccgctggcctacgtgttcatcttcctggccgctgtgctgggcaccatgaacgtcgttggtggctacgtggtcaccgaccgcatgcttgagatgttcaagtccagcaagaacgagaagaagggggagtcgaagtaatgacctccgcaaccgttggcgccatcgacatcgtcgcttggttcgtctacctgttctctgccgtcctgtttgtggtcggtctgcatttcatgaattcgccgaagaccgcccgcaagggtaaccagatctccgcgttcggcatggtcgtggccgtgctcatggcgttcatcgtgctcttcgccaagggcttcgtgaacattgtcgccgtggtggtgctggtcgtcggcatcctgatcggtgccgtggccggtgtcgtctccgccaagaaggtgaagatgaccgatatgccgcagctggtctccgtgttcaataccgtgggtggtggcgccgccgcactcgtggccctgaacgacatcctgaccaaggaaggcaccccggacatcgtggtgctcatcaccgctggtctcggtattctcatcggttctgtgaccttcaccggctcgctcatcgctgccggcaagctgcagggtatcaagtgggtcaagaagctgaacctgccgggcaagggcgtatggaacattctgttcgccgtgctgtccgtcgcctcgctggtcatgctgtgcgtccagcccgaacagcgtctgctgtggtcgattctgaccaccgtgttcgccctgtgctacggcttggtgttcgtgattccgatcggcggcgccgatatgcccgtcgtcatctctgtgctcaacgcatgcaccggtacggctgtggctatgtccggtctggcgattgacaatgtcgccctgatcgtggccggcgcactcgtcggttccgcaggtgtgaccctgtccatcctcatggctcaggccatgaaccgcccgctgctctccgtcttggccggtggcttcggcggtggtgctgacgccgccgctgctggcgatggtccggaaggaaccatgaaggagaccacgccggacgatctggccgttcagctcgtctacgcgcagaaggtcatcttcgtgcccggcttcggtttggctcaggctcaggcccagcgcgagctcgctgacctcggcgaactgctcaagggccacggcgtggaagtctcctacgccatccacccggtcgcaggccgtatgcctggccacatgaacgtgttgctggccgaggccaacgtgccctacgaggagctcgtggatcttgatgagatcaacccgcagttcccgcaggccaacgtggctctggtcgtcggcgccaacgatgtgaccaacccggctgctcgccgtcccggcaccccggtctccggcatgccgattctcgacgtcgacaagtcccagaacgtcgtggtcatgaagcgcggccgcggtatgggctacgccggcatccagaacgagctctacttcgaagacaacacccagatgctgttcggtgacgcgaagaagagtctgcagtccgtcatcgccgccgtcaaggaattgctcgcgtaaccattcttggctcccctctgtgaggggagctgtcgaacggagtgagactgaggggagtagcccatacgcgggtgctcccctcagtcagcttcgctggcggctcccctcacagaggggagccgagctctatatctactacagcccaaacacccgcttaacaaagctgttaacgcgacgccaatagcggtccggatcggtgctggcgctcatcgtgtggtcggcgccgggaatcagcagcttctcgcggtcgatgctggcgcaggcgttgtaattgatgtccagatacttcggattgacaaaagtatccgctccgccatgaatgaacatcatcggaatagtcgcgtgccgtaatgccttcacacaggaggcgtcctcaaaccggtatccagccttgcgttcagacacatgactggccactttgaccagcagcacggccaacgagtgcggcaaacggaacatcgcctcggcattatccgtaaactgcgagaccacggaactgtatccgcaatcggaaatcgcggcgacgacgttgcgggggagtcgcgcatcgccggccgccatcatcaccgtggcggcgcccatcgaattgccatgcaacagaatgcgtgcatccggatcagctgcggtgatcagcgaaacccagcccaacagatcgtcgctttccagcaatcccatacccacgtaacgcccttcgctcaactcatgggcgcgctgcgcgggtagcaggaccgtaaaaccgagttgcgcatagcgatgcgcccatttggccatttccgcgggctctccggcatagccatggcagcagatcgcgtatagatgcggctgtgggtcggaacaatccgggtccaacagccagccgtggagtttcaatccatcatggctgcgcagcgtgaccgattgcttggcctcctcgaaccaccgggcggcctcaagctgctcggacatgtcgaattcgatgcctttcggtgtctcctcgtgcggcatgttgaacatcgaacgtttggccttggtgtccagcgcgaacgtgaacatgacgttggcggccgcggctgtgacgccggctcctgtggcggctatcgcggcaagtgccgcagccatacccctgacaacgcgagtgtgtgcggcgatgacgtcatggccatcctcattgatgacgtcgtccgaacgagtcatatcaacctcccgatacggtactcaccatcgtacgttattttcgaaatcatccccaacttcgtgaaagaccgtacactgagtgtcgctgagcgtacgattttcacgaaatggcggacgatttcgtgaaaaccgtacgttgagaacgggtaagcgtacgttcttcacaaagttagggattatttcgcggaaaccgtacgttgacgtggctgggacggccgggatgcagtgtcatcgaagcatcaccgcgccaaagtccggagttggcgtatacttgacaattgttgctttggcgagggaagtgtgcgtgctgacacatgacacagcttccgttatcgactcggtgtatttcactccttgtagggtgtctttcggcgtgtcgtggcgtctgagcgagacagaacgaaacgaaactacaaggagtatccattatggctaccaccattaagcttgagggcgaggcccgttccgagttcggcaagggcgttgctcgtcgtctgcgcgttgccaacaagattccggccaccatctacgccggcggcgaagagcccgccttcgtgaccttgccgatgcgcgagaccaccctggccctgcgtcacaccaacgccctgttcaccatcgccttcgacggcaacaccaagatggccgtcgtcaaggacgtgcagaagaacccggtcaagcgcatcatcgagcacgttgacttccttgaggtcaaggccggtgagaagatcgacgtcgaggtgccggtcttcgttgaaggcaccccgaagggcgctgctgtggcattcgtcgacattcaggagctcaaggttcgcgctgacgtcgccaacctgcctgagaagatcgttgtgagcgtcgagggcctaaccgacggcaccaaggtgttcgctaaggacgttgttctgcctgaaggcgttgagctcgacgttgaggacccggaagagtccgtcgtcaccgttgaggtgccggaagatgcttctgagtccaccgccgctccggaagctgctgctccggctgccgacgctgctgctccggctgccgacgccaagtgagtcgatcgcttcgatagcgaacaattcagaacataactgaaacgtggaagcccgcagccgttgagaacggtgcgggcttcttcgttttttcaccatgtgaactctgccacacgagtaacacatgggtgtgcaaaagtatgcaacagagctcgcgccacaagcgcacagcacacaccccatatggtggctttcgggccgccaaagtcaagaagaagtagctagtaatgactgaaaacacgcaccacgatccggcagcgctcgacaagctcgccgaaccgttcaccgtactgccgaacgacaaccccgcatccgatgagaagcgccagtccctcatcgacaagccggctttcggccaggtgttctccgacaacatgacccacatgacctggaccaagggcgaaggttggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaagtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctccctgctcggcgagtacaagggggttgagaacggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggtgaggtcaccgaggtgttcgcttgcggcaccgcagccatcatcaccccgatcggtcgcttcaagtccgagaagttcgatgtcgccgtcgccgacggcggctccggcaagctcacctgcgaactgcgtgacgagctgctcggcatccagctcggcgaagtcgaggacccgcacaactggatgtggaaagtgtgctgaatcgccttttgtttctgactaagaccccttggaacagcaacaattccaaggggtcttggcgtattggaaatgttcttggctagagagatacagatggatttagcaacattccgcaacaaataatatgatctaggtcttctgcacgttgcggggggtggttatggttcatccagatgagaacaggagcaaacctatgagcaagatgagtgacatgacggaataccatgcttcagcctaccgtttgccgtcaggcttcgaacactgctcgaaattgaagccggtggctgaggcagcgacggcgctggaccgggtcaaggccgtggtggatgtgctgtattcgccgggcggctgcccgtgggacggcaagcagacgaacaagtcgctgctcaagaatctgctcgaggaaacctacgaatacgtcgacgcggtggagactcacgaccgtgacaacatgcgcgaggaactgggtgatgtgttgctgcaatccgtgtttcaggcgcgggtctgcgaatcggatactgaggacccgttcggtattgatgaggtcgccgatcggttggtgaacaagctcatcactcggcatccgcatgtgtttgcggctgatgatgccggcaattcctctgattcttctgatgcttttgatgctgacagtaacgacgggggagaagctgcccaacccgaatccccggaagctgtgctggctctatgggaaaagatgaaacagcaggaaaagcatcgtaaatccgtgcttgagggcatttcccgcgttcaaggtgcgttgcctcgcgcggccaaagtcgtttctcgtatctccaaatcgccgaatgctgatagattgttcgcggcgtttgatgagtcggctgcggctgatgctcagcgagatgatgtacatcctcaagcggcgaaccaatccgaatcaagcggcgacaattccgctgaacgggagaaggccgatgcctacgccgatgaaatcctcgccgtcgtgcgcaaggcccgcgttgacggcatcgatatcgagtccgcactgcgcaatcgcttgcgtgatgtcgaagaaaaagtcgccttgattgaatcagaaatcaacaacgattaagtccatacatgttttttgatcacggatcgtaaaacttagaggtgctgagttgccaacgactaccggcaagctggcgtcattgccatcctattcacgtcttagtggccccttcctccccggccatactactcaggcaaggcctgttgtaggctcgggtacgacgggctgtagcgccgaataaggatgaacgggaacagaacgaagacggactgagacgaaccgaagcggtaccagaggggagtggctcatgcaggtggcgttggagaacaacatcgtttttgtggtcatcgagtatttagcaatcctgtgttggggattatcgggcggacttgccgccattcgcaagggctacgacatcttcaccatcatgctgtgcggatggcttaccgcactcggcggcggtcttgtgcgcgacgtgatgctcggtgccctgccgccggtcggcatcaccgacaaaggctatgtgctcaccacgctgttttccggcattatcgtggtggtggcccatccggagatcaccaaactcaaatggacgatgactgtcatcgatgctctgggcctcggactattcgcagtcagcggcaccgcaaaagctctggcctacggttcctcaggcatgacagccgtattccttggcatgttcacagcactggccggcggcctcattcgtgacatcttcattggcgacgtgccaatgattattcgagacaaacacctctatgctgtgccttcgttcatcggctgcatcctgaccgtgctggtatggcgcggcgtaagctacggctggttcgacatgcgctcggaaatgctgctcgacgtgctgatcgtcatcatcgtggtggcgctgcgactgctctcggtaggcttcaacgtcactctgcccggagccgtcgaacgtcatcgcgtctacctgcccagcgaaagccgatatctcaagcgcccggtcatccatccgcacgccgataccgtcgatcccggcgataccaccaaggacgaagaagacaagcctcaggatggttcaaggccgcctcagggctaactgtcttcaaagaggtacatctggccttctgcagaatgctaactgctttcaaagaggtacctgaagcacgaaacgctgagtataagtgttgcaatgatggcgtttatagttggtttttcccgtattcggtacctctctgaacggagatgtcatttcgcaagaccgccaatgtacctctttgaacggagatacaaaaagtcccgcaagccagatgacttgcgggactttctaaaaccttaagaggcttatgctcacagagcgttgatcgcaacagcgaggccggacttgcggttggcggcctggttcttgtggatcacgccagcgccagcagccttgtcgagcttctgggcggcaaccttgtaggcggcctcggcggcagccttgtcaccggcggcgatggcttcgcgggtggcgcggatggcggtcttcaggccggacttcacagccacgttgcgaaggtgcgccttctcattggtgagcacgcgcttcttctgcgacttaatgtttgccacgtttactccaaacgatgtgtgttataaggacatacaaaagttagaggatagcatgagccccggaaaaacccgcgcaatgccacgccgaatacagtccctcggctacactaggtgaagtttgagtatatgccaagaggaggaatgcgttggtcgtccaacacaatcagccgggttccacggatcagtcggtgattcgcaacttctgtatcatcgcacacatcgaccacggcaagtcgaccgtggccgaccgcatcttgcagttgagcggcattgtgcccgagcgagagatgcgcgatcgcttcctcgaccgtatggatatcgagcaggagcgtggcatcaccatcaaatcccaggccgtgcgcgtgccgtggacctttgacggcaccgaatacacgctcggtatgatcgacacccccggccacgtggacttcacctatgaggtgtcccgcgcactggccgcctgcgaaggcgcggtgctgctcgtcgacgccacccagggcatcgaggcgcagaccctgtccaatctgtatatggccatcgaccatgatctggccatcatccccgtgctcaacaaaatcgacctgccgtccgcagaaccggacaagcatgccgaggagatcgcaggtctgatcggctgcgagccgagcgacgtgctgcgcgtctccggcaaaaccggcgaaggcgtggccgacctgctcgaccagatcgtcatggacgtgcccgccccgcacggcgaccccgatgcccccgcccgcgcgctgatcttcgattccgtctacgactcctaccgcggcatcgtcacctacatccgtatggaggacggcgaactgcacgaccgcgaaaaggtccacatgatgggcattggcatgacccacgatcccattgaaatcggcgtgatcagccccgatatgacccgcaccaaggcactcggtgccggcgaggtcggctacatcatcaccggtgcgaaagatgtgagtcagtccaaggtgggcgacaccctgacttcggccgtccgcccggccgccgagccgttgcccggctatcgcgacccgaagccgatggtctacgccggtttgttcccgatcgacaacgcccagttccccgaactgcgtgatgcactcgacaagctcaagctcaacgacgccgccctgatctacacgccggaaacctccgtggccctaggcttcggcttccgctgcggcttcctgggtctgctgcacatggaaatcgtcaacgagcgactctcccgcgagttcggcctcgacctgatccagaccgccccgaacgtcacctacgacgtgaccgccgaggacggcagccagcatcatgtgaccaacccgagcgaattcccggacggcaaaatcaagaagattgtcgagccgatggttgccgccgacatcatcacgcccaaggaattcatcggtgcggtgatggatctgtgccaggaccaccgtggcattatgggcacgatggagtacatctccaccgatcgtgtcgagatgcactaccgcattccgctggcggaaatcgtgttcgacttcttcgaccagctcaagtcccgcaccaagggctacgcttcccttgattaccatgaggatggcgagcagtccgccgatttggtcaaggtggacatccttattcagggcgagaaggtcgatgcgttcagtgccatcgttcaccgcgataaggcgtattcgtacggtgtgatgatgaccaagaaactgcgtagtctgattccgcgtcagcagttcgagattccgattcaggctgcgattggttcgcgcatcattgcacgtgagaacattcgtgcgttacgcaaggacgtgctcgccaagtgctacggcggcgacatcacccgtaagcgcaagttgctcgaaaagcagaaggctggcaagaagcgcatgaagatgctcggccatgtggaggtgccgcaggaggcgttcatcgcagccctgtccaccggcgaggactccaacgaccgcgacaccaaagacaagatccgcgccgctcagaagaccgagggctagtgttcgaggtctacatccacgtcccgttctgcttgcggcgctgcggttactgcgacttcaacacctacacggctacggatcttggtgcgggggcctcgcgcggcaactatgccaatatggtcattcgggaaatgaaattgaccaagcagtggcagctcgaccacggcatcgaggagccgccggtttccaccgtgttcttcggcggcggcacccccacaattctcgccgcccgcgatctggtcgccatgctcgatgccgtccgcaagatctggagcatcgcgcccgacgcggaaatcactaccgaagccaatccggacacggtcaacgagtattacatcaatgagctcgctgccggcggcttcacccgtgtttccttcggcatgcaatctgccgtgccgcacgtgctcaaaaccctcgaccgcacgcatacgccggccaacgtggccgtaggcgtcaatgcggcgaacaaggctgggctgcgctccagcgtggatctgatttacggcgctccgggggagagccttgacgattggcgcacctcggtcacgaccgccatcgatcttggcgtaaaccacatctccgcctacgcattgaccgtggaacccaccacgaaaatgggccgtcaaatcgcggccggcactctgcccaagcccaatgacgatgacgaggccgctaaatacgagatcgctgacgacctgttcgccgccgccggcctcgaatggtatgaggtctccaactgggctcgccccggatacgaaagccagcacaacctcggctactggcgcaacgttgattgggccggtctagggccaggtgcccactcccactacaacgcggtgaccgaggctgaccacccccagtcggcttcgctgacagcccccgctggcgggagcaagtccgaagccattgcctctgcctcagctgatggacaggccaacgccgaactaggtatgatcaacgcgcatgggaacaactcccaagaaattcatgcccccgctggcgggggttgtccggcggatgccggactgggggtggtttctgtctcacacggtctgcgcagctgggacatcgcgcacccgcgtttgtggggcacggccatcaacgagaaccgtgtgccgtgggccgatagcgagacgatcactcccgaggaaaacctcgaagagctcatcatgctcgggctgcgcctgcacgagggccttgacctcgaccgcatcaaccgcgccatcaacgatgcgggtatgagcagcacgccccagactctccgtaatgtttcccttgaccaactcgccccaatggtcagcgaaggcctgattaccgtatccgataatcatcgagtggtgcccactcgtcgtggccggttgctcaatgactcggtaatcgaacagttcttcgatttcgtcggtgtatgagtcggtggtatggtgcgcggcagtcgccattacctgttcgctagttgtggttacaccgtcagagggagctatttttgttttaccggcgggggagggaaccgcgtaggactacgtccggggcgctttgcacgtagatcaggcggttggcagtgccgccggtggcctccccgtcatcgcggttggacaggatgctgtccacggcggcctggcccatttcggccagcggcagatgcacggtggtcagtggcggaaacacgtcggcggagtaggggatgtcgccgaaaccggtgacgccgatttcccgacccggctcgatgccgttggcgcgcaacgcggtcatcgcaccgatggccatcacgtcgttgagcgcgatgattgaatcgatgcctttgccgtcgtacagtgcgccttcgcccggcttcagcagtccggatcgggccatttgcatgacggccgcatagccgtcggtacggctgaacttaccattcgccacggctttcggatccacggtgatgcctgcctcgtccaacacttccatcacgccggccagtcgttctttggaggagcgatgtgcgtcatcgcccttgagaatcgcagggcgcgtatacccggaatcgacgatcagctttgcgatggcgcgcgcgccgacatcgttcgccacgtccacggcagggaagggcaggttgcggttgagcacgaacacggcacgtccgccggatgcttcgtactgggtgagttccgtctgcaacgcctggcgttccggcgcgtcggtgtattcactttcggagatgatgatgccgcgcggcctggtggatacggacttacgcaccgcctccaactcctcatgcggggtggctgccacgccgatggtcacggaaatgccgcgttcggccgccgccttgaccacgccttgcgacacggatgcgaagtaggggtcggagatatcggagaccagcagcacgatgttcggtgcggtgcctttggccactgcctgagcataggcgttgggacgatagttgagtttggtggctgcttccatcaccttgacatacgattggttgcgtaccttgcgggtgctgccgttgagcacgcgggatgcggtggcgatggagacttgggcttctttggcgacatccatcaatgtcgctggcgattgcgccttatcgttctgtacagccacgatcgaatcgatccttttcttccctgaaacggaaaacgtgtctaaacgtttaccgcaatgatatcgcatttttgcttgcaatagtagcattgtggattggaaagcctgaattctgaacaaaaagaaatcacgcgaattacggaaagcgtttaccgtcccggcgtgtcgtgcggtatgctcgaagcatgacgcgatacttatgcgcccctgactccttcaaagagagcctgaccgccatggaggcggcccgggcgatggctcaggggattgagaatgccgaccacgatgccgaggtccgttgccttcccatggccgacggcggtgaaggcaccgcacgcgcgcttgtcgacgccactggcggatcgatgcacgccgtgccggtccacgacccgctcggccggcctgtcgaaggccacttcggtctgctcgccgacggcacgaccgccgtggtcgagacagccgaagccagcggactagcactgcttgaagccaaagaacgcaacccgttgatcgcctcctcctacggcaccggcgaactcatgctcgccgccgtccgttccggagccaagcgcatcatcgtcgggctcggcggcagcgccaccaacgacgccggtgccggacttctgcaggcccttggcgttcgtcttctggacgggaacggcaacgaccttaagcacgggggagcggctctcgccgatctggccaccatcgatatcagcacgatggacccggctctcaagaacgtcgccatcaccgccgcctgcgacgtgaccaacccgctgaccggccccaccggagccagcgccgtgttcggcccgcagaaaggtgcgtccaaagatgatgtcgccacattggacgccgccctcgcgcattttgcgcagggaatcgacagccagctcggcgttgccgtgaacgacgtgccgggtgccggcgcggccggtggcatcggtgcagcgctgaagggcttcctaaacgccgaattccgcccgggcatcgccatcgtcatcgaacaatccgggctcgatgcggccgcgcaatgggctgacgtggtgttcaccggcgaaggctccatcgacttccagaccaagttcggcaaaaccccggccggcgtggccgaaaccgccaagcgccacggcaagcccgtgatcgccgtcgccggacacatcggcacgggcatcgacgaactgcatgaggtcggcatcgacgcggtattcggcatcgcgcccggagctgccagccttagtgagctgctggccgatgcggccgccaacgtgacccgcaccaccgaacaaatcgtacgaaccctacaactgtgagcaggctcccgctggcgggggctggcgggcttcgcccgacgggggcagcgctgagaaccaccctcagtctcgctatgcgagacagctcccgcagcgggagcgagtaccggaaaggaagacgtgcgcgccacactggaaaccgtgagctgcggcgaactgaccgccgtgtatcgcaaagacagcgacaccggcatcgtggaactggcatcatggatcgtcgacgcgagctcggtcttgtgacatgattggtggtgatggaatcaacgatgagtccaacaaaacggcaccgcctcccattgcgcaatatcgcgcgcaatattacgcagcgtattggctctccgaatgcgtgtctgctaaacctcgtgttgctctatcagcgagctttccgactgcgcagctcaggcaacatcacgacgaacaggatgaccgccacaatcgcggtcagcagatcggcgatggcctgcgcggcgatcacaccctgatagccggccagccaggagccgacgaacagggtaatcgccagcatcacaccctgcctgctgatcgacagcacaaaggcgccgaccgccttgcccgcggactggaaggtgcaggtcgtgaccatcacgacggctacgcacaccaggctcagcagctgaacccgcagcatgccggcgcccagcgtgatgatggtggcgtcctcgatgaagaatcccatcagtagacggtcggacaggctgagcaccacggtcatcaccagggcgaacagggacaggaacaggtaggaaaaacgcagaatgccgcgcagtcgaggcatattgcgggcgccgtagttgtagccgatcagcggctgcgcgccgaacgcgaatcccacgaaaaccagcaccgcgatcatgatgactttcagcgcgatgcccatcgcggctaccgcgtcggtaccgtaggggagcaggaacaggttgatcatgacgatgccgacgctctgcgtgaggttcgtgatcgccgaggggatgccgatggcgaggatgctcccgacctcccgggccgtgaccgccagacgccggcgcgcgcggtcgatgacggtccgcgggtcgatggacaggttgctgctgtgacgcagcgtgaaccagacgaaataggcgtcggtgcagatgttggcgatcacggtggcaccggccgaacccgcagcaccccagccgaatccgtggatgaacaggggattgagcacgatgttgaccgccgtgccggccaccgaaccgatcatggactgcacggcgtggccttcggtgcgcagcaggttggacggcgtcatcgacacgatgatgaacggcgagccgacgatgatcagtgtgtagaagtcggaggcatactgccaagtgtcgtcagtggcgccgagcagcgcgagcatcgggtcgcggaacgccaggcccagcaccagaatcagcaggccggtggcgatggcggcatagaagcagaacgcgctgagtcgcttgccgtcggcgaaccggtgttggccgaacaagcgcgagatgaccgaactgccgccgaggccgaagatgtcgccgagggcgatcatcacggtgaacactggcgcggtgagggagacgcccgccaccatatcggtgtttcccgtatgcgcgatgaaataggtgtcgaccatgttgtacaccaaggtgaccagcatgctgagcaccacgggcatcgccagcgagaaatacgcctccggaatcggcgccttttcgaagagttcgttatccatttccgtcccttggtgtttcgttcttcagtcactgtgcaggatgccgttcggcgtgcatcacaggcattgcagaggcaacagtgtggacaacgggcgggggagtatctcatgatgcggtgagggcgttgatgatgacgcatcgtgtattggcggccgtgtgcatcgtatgtgaacctgtgctggcgcggcgtacgcacgatgggaaaagaaagaatatatggaccccgttgtcccggttattgttcagttttactgtgttgaattattgcgttattcaattattgtggtgtgccggccgattgcggcctgagggggattgccttcgtatgtgtcatgcaatctcatgaacgggattgttcgctagattcagcgagcgtccttgttggcggcgttgatgatgtcggcgaacatcttggagtcggcgtagccggcgcgggcgatggcatccataccggagagggcgagaccgcgaatcatggaatccttgagagacataatcattacctttcgtttgcgcatcgccgtgagcggctttgcgattgttgtttaagctttgttgttatggggtccgtggctaatctgattggattgccggaccggagccgatggctcagcgagcgttcttgttggctttgttgatcaggtcgacgagcgtgctgctgttggcgcgaccgcactggctcatggagctcaggccgtacacagccagaccgcgaatcatggaatccttgagagacatcatgtttcctttcgttggtcaaaaccttggggctttgagttttgtttatcggcttctttctgaaaccggtttcagaataacgcagtccgatgacaaacgcaaggggactattccgctctcggcgtttctggcggaatatcgccgttctttagataccattcggtagttaagaggttgtctagtcgaccttctgacggccttgttctgagcgtacggttttcacgaggtatggcctcatgtcgcggaaatcgtacgctgagtcgtcgtaagcgtacggttttcacgaaatggggtctcatctcgtgaagaacgtacgctgagtcgtcgtaagcgtacggttttcacgaaatggggcctatcttcaccggattttgggcacaccggccttgagcagcttggtctcaagattgatggggcgtagcagatcctcatagaacacatggacgatttcggtgacgccctgttcccggagatgccgatcacgtctgcggtcgtactccattttcgcctggaggcttgcgcgattcttgttgctgatgtcggcgtatttggccatgccgtcgtattctgccacgatgatgcggccgtctgcgagcttccaacagaaatcgacgcgatatgacattgcgggattgtcgggattcatgaactgcacctgcagcagggggatgccgaaagacaattcggtgatctggccacgcatcaatgattcgccgccgttttcgctcaggggatccgcgtacttcagcagcttggtcacggagacctcgtcgcagacgctttgaatcatcagcgactgcacctcttcgatggtcgtcagggactttctcagagccgaatcgtatatgggcagcgcctgtgggaatgggaatgccgcgcagtcgagcagcgttcgcgccggagtcgtcaagagaatgccgttatgcttccgcgtcggaatccgattgatatagatgcggttgagacgcgcctcgtctccgccgccgatgccggacttcgaggcgatgtgcactgtgccgtcgtgcagggaatagttgtgctgcagtccgtatacgcacgccgcactcaaccccgcaaatacccactgagggtggattgcggacaacgcacgtatgacctgcaatgactgttgctctctggtcatggtgttccaaagtgttcggtcggcgtacaggttcttatacggtgacaccagctccccggcatgcaggcgacgtttcagggcgcgccgttgcgcatcactggtgccatagcagcagcgacgctcctgcttcgcctgctgcagcagtgcagaaacttccttgtgttctttcatatctcgacgctaagggtgattttgatcgttgcacaagctcaaccggcaaatgtggatactatgtcacgcgaattgttgctgtggataacttgaatcgacgtcgacggctttgccgacggtcttgtcggaggcgatattagcctaggacaccttgctgcgccgccttccataccgaaaacagtcatcagtgacaccgggggcatcttcagcgtacgttcttcacgaaatcagctgccatttcgtgaaaaccgtacgctcagaatgactcagtgtacgttcttcacgagatgaggccccatttcgtgaaaaccgtacgttgacgacgattcagtgtacgttcttcacgaaattagggatgatttcgcggaaaccgtacactcaccgcaactcagcgtacggttttcacgaagttatcgatttgggtataggttccccgtcatgaactacaatgaatcgcggcgaaaaacggagaaccgaagtcggagcgcggctgaacggatatgggtgtgactggatggctgtcatagtgatgccggttctctaacatacgcaataacaacaactgacaacaacaggggagacaaggatggcgagaagtgcgggccgcacccggccggtgatcaaggacgtggccaaactggccggagtctcggcaccgaccgtctcccggtatctcaacggcaccgtcaacgtcaccgaagacaagcgtgaacgcatcgccaaggccatcaaggagctgggctacgagccgagcattgtggcgcgcgctctgtcgaaccgggagatggactccgtggtggtgttcgcggccaatccttccgccttctccacgtccgaaacgaaccatggggtggaggccgccgcccgtaaacgtcggttcctgctcaatattgtttctttggacgagtccgacatggactccgtcaaggctcgcgtgcgcatgggtttgtcgatcaggccggcgggcgtgatcgtctacgagtacgaccgggccggcatcgccgcactggaatacattcccaaagatatgccgatggtcgtggtgggtggcagcttcggcgacggtgaataccaggtcatcaacgccgaaagggatggcggccgttggatgaccatgcatctgctggatctcggccatcgcaccgtgttccatgtggggcgtccggaaggtccgaccgataacacccgcaccaatgggtggcgtgacgcgctcaaggagcgcggcgtcacggcacctgacccaatcatcgtgcccgacgatgatttggaggagtcggtcaaggctggacgcaccttgggccgtcgtggtgatgtgactgcgattttcgccggcaacgacgagactgccatcgctgtgatccggggtctaagggaggttggtcgccgcgtgcctgctgacgtgagcgtcgtaggctttgacgaccgcaacttcggtgccatgtggaatccggcgctgaccagttacacccagaacttcctggacatgggggagcgatccttccgaatgctgttcgaacagatccaggccaagcgcgccggcgatgacgcgccgccctcgcaggtcgaggtggtgcaaggcaagccgtgtctgcgagcctccgaacgcgcgtacggcgacggcgaaatcgcgtagtcgatggggcgtgcgtatcaatcgatagtgactgtagcgcatccatatcgtggtgaggagtctctcatgccgaactgtaagcgcttaccttaagtagtttgtaatatggtttacgtcataaaaatagatattctaaatcatagtgttttgcaagggcttttgcggaaaatggctatttatcaacagttttcgaaaagtccgcatgacgggcgactgtgagcacgctttatggtaaccgctttccgtagcattaacgttagagtatgacttttgaacaatcggcaactctgaagactcagccccagacctcgggcaccatctcagcggcagacgccgtgatgcaatcggcccgcgacgaactcatccccggcaaactcatctgtgcgatcatggccgtggtcattgttatcgtgttcgtcgccatgctccacgccctacgtaaccggaagtaggttgtaggcgggattggtctgactggtatccgccacagccgggttcggtagagcggctaccaatcggccagtgtctctacggcatcgagtcctgttctgcgatgttgttcgtcaaggttgttccggtaaggtgattcatcggtgagcatgtcgtacgggagcttgatacgtctgcgatccgtgtggctatgtagtcgttaagtttcggcgtcagggtcgctgatgagggatgcgggcattgcggcatcgtacagatgtctatctccaatccggcatggtctgcttggtatgcggcgctcttaagaatcaacgcgccaagcagatccgcgtcggtagtgggacgcacgtcgagaccgtccatgatggcgtgcaactgcaccatgagaccgccggtgagcagtcatgattcggtaatgcgctcggccaccatgtatacgatattccacggatgagcgccgctggggattgcaatgcgggaaatcattgctcatttccttgttgtatgccgtgatgagttctgtaagggtttcgagccctgcgcgtcgttctctcgggtcgttggattcggccagatcagcggcgcatacgccgatgggcatgggcccctgcccggcgggcagaaaatcagcgatatgccgtgattcggcgggaggtctcgtactggccccagcccttctgttcggtagtggtaccgctacaccgactctccccgacactccagtgccgccgatatcagtgaatgcccagcctgatgtcggtagagtaaaggctattggcttggtctcgacggcgagacttctccaatggccaatatgcactgttgcaaaggagcatgcggtatgcaaccaatcaaagccattcaatacggctgtggcaaaatggcgaagtacacgattcgctatatgcacgagaaaggcattcaaatcgtcggtgccatcgacgtgaacccggaagtcgtgggcatggatgccggtgtgtttgcaggcatcggccccatcaatgtgccgattcgcgccgatgccgaggctgtactcaacgagtgcgacgcggatatcgcggtagtcacgctattcagcttcgagaacgaaatcgccaccatgtgcgagcagtgcttggctcgcggcatcagcgtgatcaccacctgcgaggaatgcatctacccgtggaccaccgatccggccaccacgaaccgtctcgacatcatcgccaaggaagccggtgccaccatggtcggctccggcatgcaggacatctactgggtaaacatggtctccaccgtcgccgccggatgccacagcatcaagaagatcaccggtgcggtgagctacaacgtcgaggattacggcctggctttggccaaagcgcacggttgcggtctgaccgccgaggagttcgaggccgagcttgcgcatcccgaaaccgtggtgccctcgtatgtatggaattccaatgaagcgctggcccagaagcttgggcttaccatcgcatcgcagacccaggccagtgtgccgtatttcagcgatgtcgacgtgtattccgaaacgatgggcgagatgattccggtcggcaaatgcatcggcatgtccgccgtggtaaccaccgaaactaatcagggcatcacgttggaaactgcctgtatcggcaaggtgtacgggccggatgatggcgatatgtgcgattggaagatcgagggtgaaccggacgtggagttccacgtggtcaagccggcgaccgtcgagcatacgtgcgccacaatcgtcaaccgcattccggacgtgctcaacgcgccagccggatatgtgacggtcgatcagctcgatgagatttcgtatcttacgtatcccgccgcgctgtacgtggcatagccttcatattttcaaggatgaaggccggcactcataagggtgccggccggtatcaggcggccagagtcgacgtgcgtggcatcacctggaactggatatggtcatgggtgatgtcatcgggccgttcatgccgtaggttcgactcgttcagcgtcaccatgcgatcgataaccgtacgagccattgcggggacgtccatcgccacagtgctgatgggtgggttggtgcaggcggagaaggggataccgtcgaatcccatgagccgtacgtcgtcgggcacgtggatgccatgttcggtgagttcgcggagcgcgccgatcgctatggtgtcagacatgcacagttctcatgttcccgctggcgggagctgtcatgcgaagcatgactgagggtggtccacagccgccaatccgtaacatcacccaacgcagcatttcacgatacggacgtttccgtatcgtattttcgtgtggtcaaatagacatttcgagcgaaaaagttcgaaatacccccataactggccataaaaaaattgcttgagaatcactattgacttttatggcgactcggtatatggacacatgaaacgtaaatgacatggagcgacggtactgtgtcaacagcaatgaacgaagaggcatgattttcttacgtgcccacaaccaattgaggtgatttcggtgacattcaaagccccgctcgatctcacggtccacgctccggacggtatgtatgatcccgccaacgagcatgacgcctgtggtgtgggtatggtcaccactttgaacaagcgtcctgagcgcaagatcgtcaccgacgccattgaggtgctggtcaaccttgatcaccgtggtgccgtgggtgccgaggagaacacaggtgacggcgccggcattctgatgagcatgccggatgagttcatgcgtgccaccgtgcccgccgaactgccggaagccggtcactatgcggcaggcatcgccttccttgaccgcgacatcgaaacctccggtcagcaggaacaggccattgccaagatcgtgcgcgaggagggactcgaagtcctcgcatggcgcgtggtgcccaccaacccggacggccttggcctgcaggcccttgccgccatgccaggattcaagactctcgtggtcgcctctccggacggtgctctggccggcgtggacttggatcgcaagaccttccgcatccgcaagcgcgtcgagcatgaggtgggcgtctacttcgcatccctgtccgcccgtaccatcacgtacaagggcatgctcaccaccatgcagctcacccacttcttcgaggatctgaacgacgagcgcatgaaggccaccatcgccatcgtccactcccgcttctccaccaacaccttcccgagctggccgctggcccagccgttccgtctgctggcccacaatggcgagatcaacaccatccagggcaaccgcaactggctctccgcccgtgaaggccgcctgagcagcgaactgctcggtgaattcgagccgctgctgccgatcaccaccccgggctactccgattccggcaccttcgacgagtgcctcgaactgctgcacctcgccggccgctccctgccgcacgccatctgcatgatgctgccgccggcttgggagaagaacccggatctcgatccggacgtgcgcgccttctacgagtacaacaacacgcttatcgagccgtgggatggcccggccgacatcgtcttcaccgacggcacccaggtcggcgccctgctcgaccgcaacggcttccgtcccggccgctggcagctcaccgatgacggctacatcgttctggcctccgaggccggcgttctgccggagatcgcgcaggaacacatcgtgtccaagggccgtcttgagcccggcgagatgttcctggtcgacaccgccgaaggccgcatcattcccgatgaagaggtcaagaggaacctcgctgcccagcacccgtaccgcaagtgggtggaaggcaactccgttgaaatgagcgacctgccccgccgcgagcacgtcagccactccggccagtccgtccagcgccgtcagcgcgccttcggctacaccgaagaggatctgaagctcctgctcacgccgatggccaacaccggcaaggaaccgctcggttccatgggtaacgatgcgcctatgcctgcgctttccagccgcagccgcatgctgttcgactacttcacccagaagttcgcgcaggtcaccaacccgccgctggactgggagcgtgaggagatcgtcacctcgctcgaatccgccatcggccccgagccgaacctgctggccgattccgagctgcacgccaagaagatcctcatcccgctgcccgtggtcaactctgatgagatggcccagctcaagcgccttgacaaggcccgcatcctcggcggctactaccgcccgtacgtggtcaagggcctctaccaggtcgccggcggcggcaaggccctcgaagagcgacttgacgagatcttcgccgaaatcgacgaggccatcgccaacggcaagaacttcatcgtgctctccgaccgtgagtccaaccatacgtggggtccgatcccgtccctgctgctgacttccgccgtgcagcaccacctgctgcgccgccacacccgtacacagatttccatggccgtcgaggccggtgacgtgcgcgagattcaccatgtcgcgctcctcatcgcctatggcgccgcctgcgtgaacccgtacttggcattcgaatccgtggaagatctggcccgtaacggctacctcaaggtcgacgcggacaccgccgtgaagaacctcaccaaggcgctttccaccggcgtgctcaagatcatgtccaagatgggcgtctccaccatcatgagctaccgtggcgcgcagctgttcgaggctgtgggcctgagccaagaagtcatcgacgaatacttcaccggcaccacctcccgtgtgggcggcgtgagccttgaagaaatcgccgaagaagtggccatccgccaccgcgtggcctacccgaaccagtggagcgcgtccccgcaccgcaacctgcgcaccggcggcgactacaagtggcgtcgcaccggcgaggaccacctcaacgatcccgaggccatcttcctgcttcagcagtccacccagcgtggcgactaccagatgttcaagaagtattcgcaccacatcaacgacacgtcgaaccgactcatgaccctgcgtggcctgatgaagttcaacaccaaccgcaagcccatcgacatcgccgaagtcgagccggcctccgagatcgtcaagcgcttctccaccggtgccatgagctacggctccatctcgcaggaagcacacgagacgctcgccatcgccatgaactcgattggcgcacgctccaactccggtgagggcggcgaatccgacgatcgtatcaacgacccgcagcgctacagccgcatcaagcagatcgcgtccgctcgcttcggcgtgacctccgattacctcgtgcacgccaccgacctgcagatcaagctcgcccagggcgccaagcccggtgagggtggccacctgcccggtgccaaggtcccgccgtggatcgccaaggtccgtcacgccaccccgggcgtggagcttatctccccgccgccgcaccacgacatctactccatcgaggatctgaagcagctgatcaacgatgcgaagatggccaacccgaaggcacgtatccacgtcaagctcgtttccgagttcggcgtcggcaccatcgcggccggtgtggccaagtgccatgccgacgtggtgcttatctccggctatgacggcggtacgggtgcagccccgctcaacgccatcaagcacgccggcaccccgtgggagatcggcctgtccgaaacccagcagacgctgatcctgaacggcctgcgctcccgcatcgtcgtacagtgcgacggcgagctcaagaccggtcgtgacgtggtcatcgccgccctgcttggtgccgaggaattcggcttcgctactgcggccctgatcgtggaaggctgcgtcatgatgcgcgcctgccagaagaacacctgcccgcagggcattgccacccaggatcctgagctgcgcgcccgctttaagggcaagcccgagtacgtggtcaacttcttcatgttcatcgctgaggaggtgcgcgagatcctcgcccagctcggcttcaggactcttgaggaggccatcggccacgttgagtgtttggatcaggacgaggccatcaagcgctggaagtccggcggcatcgacctgaccaacgtgctcaagcaggccggcccggtacccggcacgatcctgcaccagaccatcgagcagaaccacgagctggagaaggcgctggacaacaagctcatcgaacttgcccagccggccctcgaacacaaggaacccgtgcgcatcgaaatgccgattcgcaacgtcaaccgtacggtcggcaccatggtcggctacgagatcacccgccgttacggcgaggaaggtctgccggacgacaccatcgacatgaccctgcacggttccggaggccagtccatcggtgcgttcatcccgcgcggcgagaccatgcgcatctacggtgaagtcaacgactacgccggcaagggcctgtccggcggtcgcatgatcgtgcgcccggaagacaccgtcaccttcgacaagcacagcaacgtcatcgccggcaatgtcaccggtttcggcgccacttccggccagatgttcgtagccggtcgcgccggcgaacgtttcggcgttcgtaacggcggtgccacgttcgtggtcgaaggcgtgggcgaccacggctgcgagtacatgaccggcggcactgttgtggtgctcggccccaccggacgcaacttcggtgcaggcttctccggcggtaacacttatgtgcttgaccttgatatgaagaaggtcaacccgggtgccatcaagtccggtgcactgctcttcaagtcgcttgatgccgaaacctccaagctggtgtacgcactggtcaagcagcatgccgaagagaccggttcccagttcgccgcggccctgctggaggactggaacgaaaccgtcaagcggttcacgcacgtagtgccgaagcagttcgtggccatgacgaaggccatggaagaagccaaggccaacaatgtagatttcaatgcgcccggcgcctgggaaaaggtgtacgagcaggttatggaaggagcgcgctgacatgggcgacccgagaggattcctgaaggtccgtacccgccgagagttggctgaacgccccgttgaggagcgtatcaaggactggttcgacgttcacgccgaaaccggcctgcaaccgtggacccaaacgcaggcggcccgctgcatggattgtggcaccccgttctgcatgaccggatgcccgctgggtaacctgattcccgagtggaacgacttggtccgtcagggcaagtgggaagacgcctacaaccgtctgtccatgaccaacaacttccccgaagtcaccggccgcatctgcccggccctgtgcgagcaggcctgcgtgctcggcatccaccagccgccgaccatgatcaagcttgacgagcagaccatcatcgaccaggcatgggatttggactacgtcaagccgctgccgccgcagcgtctgaccgaccagacggtcgccgtcgtcggctctggccctgccggccttgccgccgcacagcagctcacccgcgccggccacaccgtcgtcgtctacgagaaggacgacgccatcggtggtctgatgcgttacggcatcccgaacttcaagcttgagaagggtctgcttgaccgccgtgtcaagcagatggaggccgaaggcacccgcttccgcaccaacgtggaaatcggcaaggacatcacgtgggatgacctgcgtgaccgttacgacgccgtcgtagtggccatcggctcccgcgtgccgcgcgatatgaagattccgggccgcgagctcgacggcatccacttcgccctcgacttcctgcccgacgccacgcgccgtatcttcggcgtcaagccggtgcacgacatcaccgccaaggacaagcacgtcatcgtcatcggcggtggcgacaccggttccgactgcctcggcacctcgatccgtcagggtgcgaaggacgtcaccgtgctacagatcatgccgaaagagccgtcaagccgtccggacaacagcccgtggccgaccttcgcccgcacctaccagaagacctcctccatggaagagggcggcgagtatatctactccaccgactccgtgaacttcgagggcaccgaagaggagaaggccaaggtcaccattgataactcgaccaccgccgaaggcttcgtggccgatgagcgtggtcatgtcaccggcttgaaggtcgtctccgtggctcccggcgaaaatggtccgttcactcgccagcctggcaccgagcgcgtgctgcccgccgatctggtcctcatctccgtgggcttcctgcatccggacaccgagaccatcctcgaccagctgcccgtcgaactcgacaagcgtggcaacatcgctcgcaatgacaagttcgccacctcccaggatggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaaggccagccagcgtccgatgatgctgcctcgctgaatactttccaaacagaaacatgaaaatcccttcttcgtgaggggatttttgcgtttctgggattaattactgccttgagccttcagtaatgtttatatttcgagaatattgcatacgtggttaacatgaagctcctatggtgtctttcgtcgccaaaaagatgacgccagaatatttgggagagattcatgaacacacgccatgtcacttcactggtcgcggccggtgcggcaatcgtcatgctgctcagcggctgcggatcgaccggtacctccaattccagcaatgcttcagattccaatatcatttccgtgtacggcagtgagccggcacacccactattccccggcaacaccactgaggccggtggcggcaaggttgtagaccagctgttcgcaggtctggtgacctacgatgcgaagggcggcatccacaacgaggtagcagacagcatcacctccagcgacaacgccacgcattacgtcatcaagctcaagagcggatggaagttcaccgacggcactccggtgaccgcgcactccttcgtaaacgcatggaattacaccgccaacagtgccaacaagcaggccagcgccagcttcttcagcacaatcgaaggctatgatgatctgcaaaagccggacgtggaccccaaggccacgctgagcggcctgaccgtcgttgacgacaacaccatcgatgtcaagctcagccagcccgactcggcattcccggtcaaggccggcagccacgcctacatgccgttgcccgaatccgcgttcaaggacccgaagaagttcggtcagcacccagtgagcaacggcccatacaagttcgtgtcctggcagcacaaccacagcatcgaaatggtgaagaaccctgactacaagggcaatcgtgtcgccaagaacgatggcctgaacttcaagatctatacctcgcctgattcggcatacgccgacctacgcggtggcaacctggacttcacgaacacgattcctgacaccgcacttacctccttccaatccgacaagtcgctgaaggcatacaacgagcccggtggcaatacgctcactttcaccattcctgaatggctggaacacttcggccagaacgaggaaggcaacctgcgtcgtcaggccatttccatgtccatcgaccgcaagaccgtcgccgagaagatcttccacggtaccgccacgcccgccgtcgacttccttgcagccccaatcagcgcctactccaaggaactcaagggaaatgaagtactgaagtacaacccgtccaaggccaaggaactgtgggccaaggccaacgccatctccccgtggagcggtgagttcggcattgcatacaatgctgatggcactgcgaagaactgggttgaggcaatctgcaactacatcaagaacacgctggatatcgatgccaagagcatcccgatgtccacttccgacgaattcctgtccaatgtggattcaggcaagatgacctccgcataccgtagcggttggggccctgattatccatccgcggacaactatctggtacagctgtacgattccagttcggccgacggcaagggcggcaacagcggcaactacaagaaccccgagttcgatgccatgatggacaaggctctttccgccccgtccaccgaggaagccgacaagtattatcagcaaggtgaggagattctgctgcaggaccttccggctatcccgttgtggaaccagaatgccaccgcagccagcacctccgcaatctccggcgtcgcattcgactacggcggcggcccagtgttcaccgcactgaccaagaagcagtaagcagtaagtaataaacagacagcgctagccccccgctggcgggggctgtcggcaaagccgactgggggtggtctcaaacagcagaccacccctaatcttgttatatgagcgagctcccgtaagcgggagcaatcgagaacatacaggagcacattaactatggaattcaccgtatccggcactaccgtgcgattcgatgaacgaacaatgcagttcgcttttacgcgcgacggtgccgaatggaatacctgcgctgatttcaagccgaccctgcaatgcgcgcaaggcaccttcgcgttcgcggatgccacttccatcacccatgagcagcgtgaaaccggcacgggaaccggcattcgcagcatcttcaccggctttgggcacagcgcatactcctttgaaacctatgtatgggtggagcgtgcctcaggcgatgtgctcttcgaatggattccgctcaatgagcaaggcctgaacatcaccaatgtgacgtggcccgcagccatggacttcgattgcgccgacgaccatgacacgacactcatcacccatgagcaaggtgtgatgatccccaacacatggcctaccgccgtgagcaccaaagacatcgccttcgacggccgcttcgaaacggctggcggttacatgccgtggttcgcgcagctccgcgcagacggacacgggtatatcgccatctgcgaaactccatggaatgccggttacggcatcgaccatcccagcaatggcccgtacacccatatcaatacttggtttgagccaagcctcggcacaatgaattatcgccgcgtggtacgctaccagttcctcgaccacgccgatcacacggcggtgtgcaaggcctatcgttcgtacgtcaacgaacgaggtcgcctgcgtacgctcgccgaaaaagcggcgcgcaatccctccgtgcgtgacctgattggtcgttcatgggtgcacatcggcatcaaaaccaaagtacagcccgactcgtactactacgataaggatcaccccgagaaaaacgattcattggtcacctttgcgcagcgcgaaaagcaaatgcgaacattgcacagcatgggtgcaggccgactgtacatgcacttggatggttgggcacagcccggatacgacaacgcacaccccgactatctgccggcttgtcaggaggcaggcggctgggaaggcatgaagtcgctggtcgacgcctgccatgagcaaggcgatattttcggcacgcatgaccagtaccgcgattactacttcaccgcgcaaacctttgatgccaacaatgcgattcggctggcagacggtacgatgcccgaacacgcacgctgggcgggcggccaccagacctacctgtgcgccgagctcgcaccggactacgtgcgccgcaatttcgccgaaatcgccgcacacggcatcaaactcgactgcgcatacttggatgtcttcacctgcaacgaaggcgacgaatgctcgaaccccgaacaccgcatgacccgccgcgaatgctttgaccgccgcgccgaatgcttcgaatatctgctctcgcacggcatcctctcctcgtccgaagaggtatcggactgggcagtgccaagcctgatattctgccattacgcgccatacgacttccagatgcgctcacccaacgagccgcgccaaggtgtgccggtgccgctgtataacctcgtctaccatgattgcgttatcgagccgtggatgatggagcgtgtggtggacggcgacgattacatgctgtacgccttgctcaacggcggagccccatacctgattcgcgatgccgcatacatcggcgttgacggcgacatggacgacgaacagcgcgctcgcacggaaaacgacatcgaacgctgccatacggtcgttgcattccatgagcgggtcggcatgcaggaactggttcgtcatgagttcgtggatgatgatccgctggtgcagcgttcggtattcgcggacggcactgcggtcacttgcgacttccatacgcaaacctatcgcatcaccgactgaaaatacaatgacacacagtgggttccgatggactggtggcaaattgccgccgataagcgagtaatatagccaacagtgtcaccgtcgaaacaggagtagtgaaatgccgaatcgtgcagaacgccgtgcccaagccaaagcaggccgcaggggagtgccgtcgcagtatgaccagacccgtggccgcggtcgctcgggaatgattgacgaataccagctgcagcagaagtcccagcgtctgcaggacggcaccgacggcaccgaatggaagcccagcggcggtacgattgcggacaccgaaaccctgctgaccactaacccgaactacacgaatccgaagatgttcaaggcaccgcattcgctgcgtcagtggttccgcgtgggcagctggacgctgatcgccatcgcgattatcgcgttcttcgtggttatgtggctgccaagccatccgatgtggctgatcatcaccgtttccgcggtgttcattgtgggtgtgctgagcctgttctttacggctggcgattccaagcacaatccgaatctggaccagaacggcacggccgtttgatcttttgcccggtaaatccggcttgaaaagcaaaacgcacgacggaagttgtgcgttttcttgtatgcggtgccctaaagtaagaagtgcttgagtttctttctgacgcacgaaggagaggcagtccgatgaaagttgatattctaacccgcgaatacccgccgcacgtgtatggcggtgccggcgtacacgccgaggaactgtccaaggtgcttgccgagcgcatcgacgtaaccgttcgtgcgtttgatggcaagcgcaccgaggcggacattcctgctatcccgaatgctgccgatgctaagggcagcttgaaggtcgtcggctatgacacgccttctgagctggctgatgccaaccccgcattgaagaccttcggcgttgatttgcagatcgccaatgatgtggacgccgacatcatccacgcgcacacctggtatgcctgcttggcgggctacatggccaagatgctgcacggcactccattggttattaccgcgcactctctggagccgttccgcccgtggaagcgcgaacagctcggcggcggctacaatctgagctcctgggccgaaaaagacgcgtacgagcacgccgatcgtgtgatcgccgtttccggtggcatgcgcaaggatattctgactgcttacccgaacctcgatccgaacaaggtggttgtggtgtacaacggcatcaccatggccgacttcgctaccccggcaccagacgatccgggttggaaggtgttcgagcgttaccacatcgaccgctcgcagcccaccctgctgttcgtaggccgcatcacccgtcagaagggtctgccatacctgctcaaggccctacatctgatttccaaggacattcaggtggtgctgtgcgcgggagcgcccgacaccccggaaatcgccgaagaggtcaagaccgcgttcgccaagctggatgaggagcgcggcaacatcgtttggattgaagaaatgctgccgaagtctgagctgaatgctttggaacacggctgtgatgccttcatctgcccgagtatttatgagccgctcggcatcgtgaaccttgaggccatggcctgcggtctgccggtcgtcgcatccgccaccggcggtattccggaagtcgtggtcgacggcgaaaccggctatctggtcccgattgaccagctgcacgacggcaccggcacccccaccgatccggacaagtttgtacatgatatggccgccgctatcgacaagatcatggctgaccccgaactcgccaagaagatgggccaggccggctacgaacgcgcccgcgacgtgttcagctgggagaccatcgccgacaagaccgtggaagtctaccagtccgtgctcgacgagcagaagaagtaaaagcgagccagcgcaggctcgcgcagcgtgacggagggagagaccgtgcaataagcggtgctctccctccgttttgtaccactgaggagaatcatgtcccaaaccgtcctccaacttgacaacgtcgaattccgccgcaaccgccgcgtcatcatcaccgacgtgaacctcaccatcaacgcaggggagcgttgggtgctgttcgggccgaacggcatcggcaaatccaccgcagtcggcatgctggccacccgcaccttcccctcggaaggccgcgtgttcattctcggccaccagctcggcaaatacgacgtgttcaagctgcgcacccgcatcggtctcgcatcggccgacctgggtcgccagttccccgagttcgaggacccgctggatgccgtggtcaccggcctgtccgccgtgaccggacgttggcgcgatacttacacggacgaagaatacgcccgcgcacgccagctgctgcgtgatttccgcgtctcctatctggaaggcaaggagatgtggcgactgtccgaaggcgaacgcacccgtgtgctgatcgcccgtgcgctgatgggcgatcctgagcttttgattatggacgagccgaccaccggccttgacctgggcggccgcgagcaggtgatgcgcacgttgagccgaatcggcgaggaaagctctgaacgtgccgtggtgctggtcacccaccgtctggaagagattccggcaggcttcgatcacatcgccattatgggccgcaagccgattcccgccgaagatgccaccgaagcgggcgtcgactcaatgggcaatcccggtgctggcaccatcgtctataccggttcgctggaagacggtctaaccgacgagcgtctctccgacctgttcggcatgcccatcgaagtccagcacactcacggccgctgggccgcctacgccgtgtgatgccgttttggtctccgccagcggaagccgtcggccaagccgactgggggaggtgtcagcagtacttttcctttttcggcaggttttatttttctcttcgccccctctggagggggctgtcagcgtaagctgacttggggaggttcgacatatgacggaaagcgacatgactggtagcaaactcgtattcattgatatcgacggcacgctggctgatgagaatcatattgtgccggagtcggcaaaaacggcgtgtgcgcgggcccaagccaacggtcacaagctcttcatctgcaccggtcgatccgtgccgaaaatcgaacgcaacattctggatcttggattcgacggtgtagtttccgtagccggcgcacaggcgaatatcggcgataagctgctgttccagcacctcgtatcgcccgaagccatcgatgcggcgatggcctattttgccgaacaccatatcgagagctaccagtggcagggtgcggacggcatgtacatttccgaaggttatcgccgccatctggagtccaagggcaagacgtggaatcgtggtgagtttgcgcggttctggcatttgctggacgaggtagaggttccggctggatctacgctgggtcacacgattcatgtgagcaagggatcgtatttcaccgggcccgagccggatgtttccttcgagaacactcagcatgatcttgccccctggttcgaactcgtgcacggctcatacgacaagatctcgccgaataacggcgaactgctcatcaacggcatcgacaaaggcaccgccgtgcgcgacgtggcttccttgcttggctatgccatcgccgacaccatcgccatcggcgactccgataacgacaccgccatgctcaaagccgccggcacatccgtggccatgggcaacgccatccacggcatccaggccttctgcgacatcattaccaccgacatccgcgacaacggtctagccaacgccttcaagacattggggctggcgtgacgagtgcgaagtccttaccagttgcgattgcgcaatttacggtggcggaggagccggaacggaatctggagatcatcgacggattcgcgcgtgatgcggcggcgggcggcgcgaagttgctggcattgccggaaggtttgattgcgcggcgcggcgatgacgattcatatgctgtcgcgcacgcgcaaccactggacgggccgtttgtagacggcttgcggcgtatcagcgcgcagcggcatattgtgctgatgggtaccgtgcatgttgcgccggagcaagtaacagaacgggatgcagattcccgagtttccaacacgttccttgtgattcgcgatggtgaaattatcgctgaatatcgcaagctgcatctttacgatgcgttcgcggcccgcgaatccgacgtggttctcccaggagatgcgttgccgcctatcgtcgatattgacggttggaaaatcggcgtcatgacctgttatgacgttcgtttcccggaaaccgctcgctcactggccgtgcgcggggcagatgcgattgttgtaagcgccgcttgggtgcgcggcccgttgaaagagcagcattggaagctgctgactgcggctcgcgcattggaaaacacttgctatgtgttggcttgcagtgaggtgagttcgcggaacatcggatgctgtcgcatcatcgacccgatgggagaggtagttgccgaagcgggcgatgagggagccgagcttattgctactgggcttagtcgcgaatgccttgcttccgcacgccagataatgccggttctgcagaatcgccgttttgccgacccgcagttgcccgattagtcgagtctttcagagcccgctgccgacgctttgatggcatattactgtcgaatataacgtgccgaattattgacgcaatcagtggtcatcgaaagtctgtgatagatgtcgcgggctcggacgcctatcatgggacgcatgactgctactgttcatgattccgcccaagctcctgtatacgctcgtctgcaagaggggagtgatgctcctgatttcactctgccggcgattgtgcccggcactgcggagaacggcttaatcaatctgtctgacgtgctcgaggacggacgtagggttgtactgtacttctatccggcggcaatgacgcccggatgcaccactgaggcttgcgatttccgagataatctcgcacgcttggagtcgcagaatgttgcggtgctcggtgtctccaaggattcactcgagaaactgcgcaagttcgccgagcacgaccatctcacattcccgctgctgtctgatcccgacctgaccgtgcacaagctgtacggcgcatatggcgaaaagaagctctacggcaagatacacgtaggcgtgatccgttcgacgctcgtcatcaatcccgacggctccgtggttatcgctcgttacaacgtacgtgccaaaggccatgtcgattcgctattaaaggcactggaaaagttggagaagctggagaagtagtgcgttctcgttgttcggacacagtggttcgtgcggtatgcgccgtatgaaccactgccgtatgaaccaccggttgacttctcggactcaccggcaaatagtgagaccgtgggcgcgcagtacgtctatggctggcatgtaatcgagcgatgttgcggtgggattgagcatcagttcgcggatggcggcggatgctgaggactcgcttgtcttcgaggattctgcggccgggaacagagcgtcggcgattagggagatgatacgggaacgtgcatcgccggcattggcattgttgctgctgttgccggcgtcggcagtggcggatttgccaataattgtggagctgtttcgtagaatcgtattcaacgctgcggcaagcggctcgggattgttctttgtcgcttcgacaatgtcatcgagctgatcgaataaggcgaacagccatgcacggcgttgcccctcatcgttgccagccgcaagcctttcattggtgacgcgcacgagttcatcaatcggtactgctggcgtctttgccggatcgcgatgctcgcggttgtcttcgatatctcccatcagatgctggattttgcactcgtcctgcaatacggtggtctcggcaaatgcggtggcgatggcgtccgcatcgatgaacttgccaccttcggactggaagcgcacgcgcttgggctcgctgtaataatgcgacatgccgaatgtgatgtactgcggcatctcgtcctgcaattgcttgaccgcatccgctaccttgcgcatgtccgcaagctgctgatgcaccacaataaaggcaagcactgctttggcgtcggcgagagtgagcggctgaccgatgctggctccatgatggtgctcatgatgcgcgaacatgttcttcagcgaatcaaacaatcccataatgtcctccttcgaactgggcgaattagctgcatcggccattcacactagtccggaatgtatgagaatcatcgtggaacgccgagagcgaattattgacgctgcacgcagcaacgtgagaactgaaccgacaccaagaacacggggcatacctgcagcatgtcgagcaatgcgatggcattatttgttaagagctcgaaaatatcgcacaggacgtagaagtgcttgtccgaatcatgtatggcaagaaggctctacagtttgcttgtgaacgactccactggctaactggtagagaagtagcggtttggtatacgcaaacagtgcgatcggcgatgaagatgactgtgaggttgtcatgtgtattcctcagaacgatgagcaagagccatggacttggtgcgtaatagcaaatgtcgtagatgagcatgaggttggtgttgaccatcatattgagcatggaacgaagatattcagtcctggaacaaaagtgtatgtgtcgactgaatggaggacgagcctaaaggatgacggtggaacattgtttgtgattgggaaagcgcgtaagcaatggcgaatggtaggtatgttcattccacgtaatcgattgacgaactttcgagttggacgagtattcgatccacgtgtactgcggcgtatggctaaggattgcaggcaatcagtgccagatccgtctgaatggggttggcgctggtggggcaatgatgaggatgcccaccaaacagtcattaagagggttgaatacttcagtcaagatggattttcgttgccagaagctggggctgaagatgattagaatcaggtgagtaacacgatgctgaagaattctgatgcgtctagtctttcttcttgagggaccttccaccgccaacaccgcgaccaggacggcttgcattccaatcatctattgttcaggtagctaacctttagtagtgccatatatacgtcaggttccggcagcttatatactgatgcgttcttgacgccgaggcgctcgctaacttctttggtgctgagaaacctaagtgccatttgagttcctctcatcttcgtggagatttcagtacgtcggtatattgagcatacctgcatattagcgaggcaaatcctctagtgaattgagatcttgactcactgataggcggttagtgaagcgattctgcggttaagtcgagcttttgcttcgctgagcagcctcagtgaggcaaatcctcgggcggaccgaggcattgctctactaaaaggccacttagcgaggcttttcctctactaactctctgagttgcttcgctgacgacgattcagcggggtattcccttgacctatccgtgttttcgctctgcaaagtagttctgagcggcggatcgatactcacacagatgtgtacggtgcgctgtcagcgtctttgtagtttcgccggtcagttgcttggtaatccaggataagtcagtcatggttccttacttccgtgtgaggcggtacacttgggtactgcctctattgagtgcattgataaaggtcagccccgcaagtattgctagtgcttgcggggcatttatgtagcggcagtgccgccgtcgtgcgtagtcagggactgcacctgattaagccgctaaccggcctacgctcaaagattgagtagggctcacaactagcttgcgctagtgttttcttttggcttctcagcctctaacagtttgcgagggttactgaccttgagcgcgtcacataacttgatagccatgccaagactcatattttcgataggtcttgaaccagtctcagtcgcggcgattcgcgtgtgcggcacacctgacttgtcagctagttgacgctgggttaacccgcgcttctgccttaactccctaagactcattacccacctcgcttatgctcagtgggcccgattatacctatcgttgaaacatatgtagagtgaggggcataaatcgaaaggcgtcaatgatgaacggaacattcgagcagttaagagcagccgtgtatggccaagcagtcggtgatgccttgggcgtgccttatgaattcatgccgagagataccttccgatgcgaaggtatgacgggatacggtacgcataaccagccgattggcacatggtcggacgataccagcatgatgctcgccacattggactcgctgatcgccaatgaatggcaagtcaatactgaagatatgcgagagcgatatctggcatggctgagtaatggcgaatacacgattgacggacgagtcttcgattgcgggcgaacggtctccgtcgcgttgcagcagcgtgtgggcttaagcggtgaacgagacaatggcaacggctcactgatgcggatcatgccgttggcgttcgcggatgcttccgcggatgacgtacgtgccgcatctgcaatcacgcacgcccatgcaatctcgatggatgcctgttcgagcatggtggatgtgttgcgcgacggactcatcaaaggcatatggccgcaagagctggatgatgaaccgttacgcggtatgccgcgtgatgaagttggttcgagcggcttcgtcaaagacacgtatgaggcggcgctctggtgcctcgcgaataccgatgattatgcgagttgtgtgctcgccgccgtcaacttgggtgacgatacagacacgaccgccgccgtcgccggatacctggccggcatcaaatatggattcgatgccattcccgctcagtggctggcggtattgcgcggacgtgagcttattgaggatgtgcttggacggacggagtcggcgtggcattaaggcgctcgcggtgagtggcaacctactgtttctgtatgcgatgaagatggccagtacgccaccatcaacagtgaggactccctgcctactgttctccacgatcacgcccaagcactggacgctcccatgtctcgttccgctgaacattgccgagaactcccttcttctggatgcgcatcatcgaatcccacttgctcgacgcccagactgctttggacggggatacgccgctagtgggggacagagattgagacgcattcgggttcgaatagtgtgagggatttggctttgccaacggttgttggacacattccatacggtggtgcctgtgttgttcgcaaaagtatgtctatctaatcgttaatcgaggatgacgatatggtgagtttttctgccgctataatgtaggattattaacaggttacggctgaagaactgattacagtattagaacatttttttctgatatatgtggttggcgtagatgtggcatatgcgagggggcatcctatggcggatgatgaaactcatatcggtcgaaataacgaggaacgcaaggaagacgaaaaccgtcgcattatgggaaaggcgctggaaggtgttgcggcggaaaccgtgcaacgctttggttctgccatcaaggaacatttagcggcctatgcgggtgatagagagaaacctgctgatgagaattccagacctcctaagaccttgaagtccattgctaagatggagactagcaatgaattcaaaaagcagaatctagctcagcaagcgggttttagtgccgaggttgaggcggtagccaggaagaacgccgataacatcattgctggcaacgatacgcgattcaaacgatatgatgacgtgaagcatccagatggacggcaagtgtcgaacgaccccatcgtggacattgtcgaagtggatgacttgggcaaaccaatcatcggctctgaggctcaaatgaagttcgtcggcagtagcccgaaaaagcttcttgataagttgaaaagcaagaaatatgcaaaatatcgtgatgcagacgtcagcatggttattccggatgattattacgatgtactgatgggtgatgggcctgacggcatcaacgaacagatacgaaaacttcagggcgagctggatggaggtcggcttgccggcaagaattctgaggctattcagcagcaaatcgatgatctgaaacagattaagaaaagcctgcggaaaagtggactcaccaagcgagaagcgttgtatgcgcgagaacatcccagacgcatggtggcgaaagatgtagccaaagttgccaataaagccgggttgcagcaggcaaggaatggtgcgctgattggtggtggtgtttctctgattcgaaatatggttgcctgcattaatggctctattgagccagcggaggcagcgagaaacgtcggcgtcgatgcaggcttggctgcggcgttcggctatgtcaccgctttttccggcgctgccattaagggtgccatgcaaaacgcgtcgagcgagtatctgcgtagtctatcgagaacgaacgttgcagctacgatggtctccactgtaacggatgtttccaaggtggttgcactgtattgccgcggcgagattactggagctgtttgtatagagcgcctcggccagcagggaatggggcagctcggaggagtgatgggcgttgccgtggcgatggccgcaatacctgcagatggtgcttttatggctgcgatggttggtatggctggaagcaccttgggatatgctgcagctgttgccgtatatgaggaattatccactgctctgcatgactatgagctggcgaaagaggagcgtattcgtgtggaacgcgaatgtgcggaagcggtggagctcatccgccaatataggcgtgatatgtctagggatgtcgagaattatctggcgactcatgatgaattgtttaatagagcattcgatgcaatggatcaagcgttgatttccaatgatattgatggatatttgaccggaaacgccgaaattcaagaatccttgggatacttgccaaggtttcggactcagcaggagtttgatgatttgatggcgtcagacgacaatttcgttttataaggaggagccagttaatgaagtacatcaaaacacgtgatgcattacaagcattttattatctgattgctgtcgatggatcagtccgtgacgacgaacgcgcactattcgatcatataggtgacaatttggatgcaaagcacttccatgattatcgcaaagagattatcgattcgtgcgatgagcgtataaaccagtgccacgattccgatgatcgctacgacgtaattgttgagggtgttgatgcagtcttgtcgcatcgaacggataaaagagctgcaggaattgcaccaaggctgcttctgtggaatatgttgtcagttgccttcgctgatggggaatatgatgcagtagaaagcagactcatcagacatattgcccggacgatgattgccgatcgttccatataccccgaaatggaacatcttatgcgcgcggcgtatgacgtgcgaggcgagctcgactggatcagcaattccgaactgccatatagtgaagttcgccccatggtggatcagctggaagagcgcgtgaatgttctccaaaacgctgccgtgttgctgattgaagacgagacggccgcgccagccccggaagtcatggttccagagaaggacgtgtttgatcagaccaaggatgccgttgactcggtggtcgctccggttgtggatcaggttcagcagggtgctcagggagccgcggatgcggtgaagcatacgtttgacgataatgttgctcctgttctcaaccaagttggcgatgcgctgaagccggtgaatgatgcagtgctgaaaccggtaggcaacgcagccaatgaggttgcgaaacgtgcgggtgacgcagccaatgaggttgcgaaacatgcgggtgacgcagtcaatgaggctgcaaaacgtgcgggcgatgcggcccatgctgtacaaggcttcttcggtggcctctttggacgcaaataagagaaacccaggaaggaattcactatgccattttttgttgttccactattcatcggaatggccgctgctgccggtaccgcaggcgtgggtatggctgccaaaggtagtcttgatcagcacacggcgaatcagcttaacgacaattccggagcacgcattcgatgggcagctaataacctcgaaaagcttcgtgggcaatgttcagattccctgaatgccttgggcaaagagaaagtcattattttggatgggagcgttcagcgcttccttgatgcttttcaacagctgaaaaatgttgatttcaccgcgtccgaagggcttgatgaactcaataaactgcgcatagacaaagcggcttttgctgaacttaaaaccatgggaaacatagcttcgtctttgctggaaggtggtgtgaccggtgcggccagcggtgcattggctgcgtttggtgcatatagtgccgcgtcggcacttgccacggcttccacaggaactgcgatcagtgcattaagtggtgtggctgcttccaacgccacgttggcgttcttcgggggagggtctttggctgcaggtggcttgggcatggccggtggcgccgctgtacttggaggtttagttgcaggtcctgcattgctggtcatgggcgttatcatcggtgccaagggtggcaaaaaccttgaggaagcgaagacccagtctgctgaggcaagcaagtattgtgagcagatgatggccggtgcggaccagtgcgttgccattcgtcggcgcagttatatgttccacgctttgcttgcccgtcttgatgctaaattcctgccttcaattcttgaaatggaaaatatcataaagaccgagggaacggattattcgcaattccgtcaggaaagtaagaagactattgccgcagctgcgtccactgcagcatcaatcaaggccgtgctagatactcctctgctggccgaggatgggtcacttactttggagtcggagaagctgatgaagaacagtggcatttgatgggatgaggattccggagctggactgatggttctgtgtcttcttccgtcatttttcatggcttcatatagatacgacgcatgacgaattctaccaggcgatctgggaggaagcgcttgagttgtatcagggccttgtagctgctgccgacggcgatgcgcaccggaggattgcgtttgccgagcgtcgcgacgatgactcgggccacgctttccggaccgtcaccggtctgctcgtcatgagccatttgcccgactgaacgttggcattcgtcgtagtacggtgaattggctggttcggcgaggatacgcgagccggtgaatccagtggataggtcacccggttcgatgattgtggcggtgatgccatgacggcgcccctccaaccgcagcgcctccacatacatttccagcgcagcctttgtggaagagtagtgcgattggaacggcaaacccagccgtcctccaatcgagccgacaacgatgactcgtccccgcttacggttgcgtgccgcggtacggcgcagcaacggcagtgcgatttcgttgacctgcaacacgccaaaataattcacatcgaactgcttgcgagcgagcgtcattggtgtgcattccgcagagccggcgatgccgaatcccgcgcaatggacgatagcgtccaatcgggggagagcgccgagaatgcgcgtgatgtcagacggcttggtgacgtccatttcgtaggtaaacagttcgcctcggccaagacgctgagtctcaggaacgctcccgtctgcattaagtcccaccgcaattacacgccagccttgcgcagcgagcatcctcgcagttgccttgccgataccactcgtgcctccggtgaccaatgccaccggccggccatcatccttgattggttccatgtgtactattatcgcgcggtggtggtgtcggaatcacggtatggtgatagcagccgcatggaacaagctacatgctaggcgaagcttgagcgtcgtcatccgtcttgcgagcattcagatgccggtgctcgtattcctcgaagtcatcacggacggctgccgcgggatacttgctcttggtctttgcgagcttgcccatgacgatgtcatccatatccacgccaagcgcatcggccatcatgatgcaatacgtaagcacatccgctagttcttccctgacatgtccttcatccacggatggcgactgcggcgtccactggtagcattccagcaattccgacgcctcgatgctgatggacttcgccaggttctcaggagtgtggtattggccccagccacgctccgccacaaaatcacgaatcgactgaatggtgctgtcactgatcatgactgacattctaggacttgctgaatgttggtcatgtaccagagctcatgatggaccataatatgactatgaacagtgagagcttggcgccgtttgtcatcaacctgccatatggccaatacagtagggaagcttttgaaaaggcttttgacgaatccctcgagaagcagatggggcgcagtgttaatgattccgagctggaacatttcatgctgcgatatgtgttggcatatccaacggtttatgtcgtgtattcaggaaagaccaatcgctattcgatgaagaacgaatatacggtgtacgtcggtgagaccaacgatatacggcatcgtacattccagcatcttgaaagagatgctaaagaacgcgaggactggaaagctgtagctgatgctgtctcgcggaatgatgatgcatatcggcaatatgttattgcacatcccaaattcaataagtcgttaaccctagatgtcgaaaaccgtcttatgcactatatgtccagtaccgattcggtgaaaaggctcaacaatcgacggaccaatgcgcaaggcgattattacaccgcagaccagtttgatcggattttctcgcaaatctggttgagattacacaaggaagattctgacctgttcccggcggaggagatcatccgagattccgcgttgttcaaggcatcgccttttcataaactcagcgatagccagctcgaagccgaagaatctattttggtgcaacttgccgccttggttgccgatagccggcaacagaagaaagccgatgagcaatctttagaccgccatccgaaattaatctttgttcaaggtgctgcaggtacaggcaaaacggtcctgttaagccacctgttctacagaatcgcgactgaaatcggcatccaaggcgacacctattccgaagacgaagattatcctgagctgccacaaacggcgaatggccggctttcctcatacattcttgtcaatcataaggaacaggtgcacgtatataatcagattgccacgaaactgggtttgcagaagaaatctgatgaagtggtcatgctgcccagtcggttcatcaatcgattcagcttacgcaacgagcatggtcgaggcattccagaccagccgcaaggcctggcggacatcgtgctcatcgacgaggcccatttgttgatgacgcaaggaaatcagggatattccgggaagaaccagctgtatgacattctgcgcagagcccgggtagtgattgcggtctttgatcacaatcagattatgcagtccagccagcagtgggacccagcggtgctggaaaaacttcagctggactctgattcgactcagaccgcatgtgcgaccgggaaaatcggcgcattcaaagcggttgatttgggcgccgaatatcatctgccgtccatttccgtggacgttgcgcatgtccatttgaaaaagcaattccgtattgccgcgagtaagtcgatgattcagtggattgaccgattcgcttcggggaaaggtatcggtcctttgcccgttgatacgggcgagtatgccgcagatggtgaagtgattcgagaaccttatgacgttaaggtgttcgactcgccggttgatttgtttaatgccattcacgcgaaggcccagctgaagcccgatggttgggatggggctggactgtcccgtttgttggccacctatgactggaagtattcggcgaaatctgagaatcagaatgatccgcatggcttttggaatgtggaactgcatcgcgatacttccggcgtatggcgtatgggacttgcggaggaccatggattcgatcattccgcaataagttctgaccaattctgcaagccttggaactatcagctcgaagattccgctccgaaaagcaggaaaggcatcgacaaagaactggcttgggcggagaagccgtacaccatagatgagattggctccatcttcaccatccaagggtttgatttgaactatgccggtgtgattattggaccctcggtgacgtatcgtaacgggggaatcgtgttcgatgcaaaggccagccaaaactatctggcaaccaataagcgcaaagatttaggagattttgccgaagaaaatttgaagcatgagttgaatgtcctgctcaagcgcggcgtccacggtctgtaccttttcgcggtggacgaaggcctgcagcagcgtttgaaggagtgctgcatccattaaggtatgtgacggaattattgtgctgaaaatgcacgcgaagcgcacgcaaatgatgttgaatgcgctgaaaatgcgctcaacatgctgggtgtcgtcgttcgctatgccaaaggcaggggattcctcatggatgagcatttggccaaggtctgggtttgcagccagctgaccaatatcatcaggaatctcagcgaagaacaggctggcatttctctgcatagtcaatggatatgtgccgaatgccgtaccgcgttgccactgtcgcccctacaacgcaaacgccagctcctcccgcaacgcagtacgattcggataacgcccgacgatctcgtgtgccagcacacgggtctcctcatcgccgaacactgcggcgaaacgacgcagctgtttggcgatctgctggtatgtggtgcggcgtgccgtcaatgtattgtcgacgccacgttccactgtaaaccggaacacgggcgtgcccatggtgccgtatggcatcgcgtcgaggattatcgattttgctgattcggggtgttcgatggcgatggtgcgcagcaacggtagcggcgggtaatcgaccatgacgcaatagatcagggccgcgcccgaaagccgctcatccacgatgagcttctcataagcgggattgcgccagctactgtgacgctgtgtaccgcccttggtggtcatttccggctggtacttgatacggtcgatgatgttccgggcgcaatctctggccagcccatcagccacgtcatgccattcttctgcgctaagaccgccgtagatgcgtaacagattgcgtagtttactcacgtaatgggtatcggatctgtcgttgcaggaaagaatgtagtaccgatacacgttggcgagcaggccaacgtcattgagtccctcggcgcagcattccatgatggtatgccatccatggggcagcagatccggcagcagaccgttatgccgggcatcgatatcgacatcttccatatcccggctcgacagaaggaaaccttgtgcgagcatgtatgcggaacgcaaatgcccttcatgaatcatgttcgcagcgttcatcagtgtgagggccattgactccgagtattcgctcagaagctgctcgcgtccagcgtcatcgttggatagagcgtataggtcgtagacgctcatgagtgtgaacaactgcaatacgtgcaacgattcatccgaaatgaagtcggtttcgtcgtctacttcgctcgaatcctcgttatcctcgtcctcgtcgtcctcgtcgctttcttcgctctcttcgctgaacgagtattccagattacgcgttatcgcgttgtcgatcacgtcataggcccacatgcgtttgtcatcatattgggcgaaagcgagcgcgctggaaatcagcaacatactgttcaatggttcgcattgccgcatgtccttgtcgttcgcggcctgcgcaatggtgttcaatgccttgccggcggtaggggagtcggcgaattccgccacattctccatatagcatcgcacgcgcatcgccagatcatccataagcgtgagcaaaggttcggagccatcgtcgtcctcggacgagagcagaagcgcgtggacttcgtgtatgcacagtcgcaggttgccgcatgcgctcgcgtaatcactggattgcagggcattgcccgcgatagcctgcacggttttgatgaattctgtgtagtcacaggatttgctgtacgcatcgctgtgcttactgatatgaataatgaaacgttcatggcatcggcggattgtgtcggagagcatggtttgtgcgtcgatcagcgggattagcggtcgttcttcgtctggctgggcgcagaaagtctttgcggcttcgcgcagctgggcggaccacaggaacagcagatggcctttgccttgctctgcgcgcgcgtcgaggtgttgctggatgggatccagcacggtgcgggggagtgcgatgacgccatcgtgagcgttggcggtgtcatcattgtggtgattgccgtgcgcgccaatgagctgtttgcgcagttcgtaaagcacggcacctatgtgcttgcaatatggtgttctctgatacgggcaggtgcacgcggcggattgtatgcgaatcgaattgtcgtcggttgtggattcgtggtcggtgttactgctggtagtggcttggtcatcggtgtttgcttcattggtgttctcgccgtgagcgtctttgccgaggcggatgtcaacgtcgtaatagtcatcgtcactgccggccacccgcgcgtgatacagctgcggcgcgatctcctgcaccgaactcactcggcctgattcccagtaatcggtggcgcgttcgagaatcagcggcgtgccttcgaacatgacctcgaattgagccaacgctggcttttgcggaacaaccatactgctgattgtagcgggtggagtgttactcgccgctaatgcctatcctgtgacgtaagtgatatcatgagctttgaagccggccgcctgcgggtggtttggaagtgaaagccggtgaccctgtgccatcataggggcccggctttcgcgtatacaccttattgaaaactaacaagcgataatttcatcgagaacgttttcccgaagaaattcagaaaaatctaattttccagttttggtatctccataagcgccgagaacttggtctggaatccatagacaaggctccgctgaaccgcgtatatgatccattcggattgttctgacaagatgcctggtacgcatctgtgcaagatgttcaaggtcgcgttggtcttgaggaggagtgcgactttctaacaccaaagtactgacctcatatgactctagaacaggtaacaaccgttctaaacacttacggcgtgctctttcgtccttgtggacagatgattcggccttttctgagggcgcgaatcagattcgtaatgcagtggtttgccccggactctgttacggtgataataacctcatcgttgataagggagtcttcatggcaggcaatggcaacacggcatttcgtttccgagtcgccttgcgccttgacgggcgtgaatgctggcgggagattctggtgccggcatcattgacgttcttcgatttgcatgcggtattgcaggaatgctttatgtggtacggcgagcatctgttctgcttctgtgccacattcccggatgggaagcaggtgcaagtggaagaattgtggggagaagagtccgcataccatgaggcgaaatacgaacaatatatgccggtggagccgttgccggaagttcgcattgcttcggaaaccgagctgggcgacgtgtttcccaaggcgcgtaccgctcgctattactacgattatggtgacgattggatccatgatattaagctgctgcgtacctaccgcagcgtgcacgttgcggatcctcagctttgggacggggcgggggatgcgcctccggaggatgtcggcggggtgtatgggttcgagcggttccttgataccttgggcaatcccgaagatgaagaacatgatggcatggttgagtgggccaaggatcagatgtgggatcgtctcacgctgaaccgccatcgtgaacgtctgttccgttggcacaagcaccgtgacatgatgttgcagtagatggcgtggctacaatatgagcagctgtcagcggaatagccgtttgtggcttgcggactaggggctgaaaatgctataaatatattgctttactcggaaacgagaaaggctccaagtcgccggggggctcccccggcattttttgtcaacggggacgggggatgcgatgccgtctgtattgagcatcttcgctgatgagagcggtgagtggggtaaacgatcagaatattatttaattactcttgtctttcatgaccagtctaaggacattagtcttgccttagagcggtaccgccagtcgttggctgactatggacttcctgatgtccctttccatgctgggccgctgcttaccgggcatgatgcttacgaagggatgagcctatcggagcgtaagaggcttctgggtttattcgttatcatgactcggcggctgccgattacatatcggacgtttgtgcatcgtaaaagtgattttgacgataaccgccaacgttttgaagcgcaactcaaacgcgatattgttaatctacttttggcgcatctttcggatttccattcttatggcactgtcaaggtgtattacgacggtggccaacagatagttactgatgccctgcgaggcgggattgagtatgcactctcaaaagatgccattgtctatcgtgacgcttctccacgcgactaccggcttgaacaagttgcggattttctatgcacccttgaattgacctgtgagaaattccggaatggggaacaaactgaaacggacaacaagttttttggtgattggaaatccttcagagtcaattatcttaagccgatccgcaggaaaagattggaatcataaatttggcagtgcccatatatattcgggacacaattgaataacacgaaatagcaaacaaaatccccggacctacacaatcatcgtcacgacaatctcagaaaacaccgttacggcaatcagtggtgtggtgccgtcgatgaaagcgggcatgggtggcagatgatagtaggcgaggtagcaggccatgtcggcgataagcaaaatcagcaggacgatggccaaaacgatggcggcggttgccctgagagctccggaactgtgcaacatggtcagcgcacatagttccagcgtgatccacatgacgatgagcaacagttccgtggtgatcggccgttgcaacagtagcgaagtaagcacggccagaatggtataggcggcaacgccaccgaccgcgaaccgctgaatccgccgatttcgccggccctattaagtccctcaactccatcaatcgccgtctgacccatcacatcacgctttcatacacattgccgattgacagtcctagaacacagcctagaactgtcatggcatgttcgtgcagataggggctccaacaaaattggctaaaagagaacttggcaacctataacaaggacgcgcccgtgtgcccttaccgttcagctccgctcacgaatgaaatcgaagatcacgtcgaagacctgctggctccagaaatcgtactcatgttcggcgccgtcgactagcaccagctgcgcgtccacgccgtgctcgaccagtcggtcgcgcatcttgacggattgatgataggggaccacggtgtcggcggtaccgtgcaacaggagcatcggcggatactgttggtcatcccgcacctgcaggtaggggctcatgtcagccgcgcgctgacggacctcggcattgatgccggtctcatgggtcgcacccaccacggccgcgaacgggccgaaataatacagccggaatggattggtctcatcgtcgaatgcgtcgactgcttcaagcatgtcggtgggcgggaagcagctgaccacgtacttcaccgcatcgctctcatcggcattggtgccgtcctcataccgcggatcgtcggcggtcaaccccaccagcagcgacgtgttgccgccggacgacgtgccccagataccgagacggtcggggtccacgtgccattggcgcgcgtttgccctgagatagcggatggctgctttgacgtcctcgagatatgcggggaacacgtcgcggggatcgctcgaggcatcgcgatgattcaccgtggccaccacaaagccttcgcgggccaaagccgagagctgcgggatctcgtagtcgcgatgcggcgtggtccaggcgctgccttgcacgaataccacggtggggtagcggcggtcatcgtcatcgccggtggattgtggtgagatgatatccatcaccaggttatcggccccggtcttgtacgccacgttgcgggtcagcgtggccaatccggcaagcgtgggattgtgcgggatatggatggcattgtttgcgccggcattggcatcggtgactttggctgaatcggcagtgttcatggaatccccctagctctgttgctatagaggtcatcatacaagaaataggcatgattacggcacaacgatgtctcggtcacagcgaagacatgaaggcgcgaagacgcgcccggcagcgcgcgctgcctgcctgcgagttgccttcaagtgcacttcaagcgataaggtgacataagccgcggcaatggagattgctgcccggcaacgaggcggacagtgcccgttcgccgattcgcgataacagaaatgagacactatgaagactcaggaaatcggacaatccggcatgattgcgtcacgagtggcgctgggcgtgatgcgcatggacgcgctggatgccgccgatgcggcacgtaccgtggccgtggcccatgattctggcatcgactatttcgacacggcggacatctatggattccatgatcatgccgcgcacgccagttcgaagcgtttcggccaagcgtggaaggacgcaggactcgaccgcagcaccatcttcatccaaaccaagttcggcatcgactacagtttcggcgaaaacgatggcggcgccaacggatatgacttcagcgccaagcatctgattgacgcactcgatcacgagcttgaggctttgcagacggattacgtcgacgccgtgctgctgcaccgtattgacacgctgtttgagttgaacgaggtcgccgaagcattcgacgcgttggaatcaagcggtaaagtgcgtcatttcggagtcagcaatatgggcccgtggcagatcgaactattgcaaagcggccttcgtcagaaattggaaatcaaccaactgcagttcggcctgatgcatacacagatgctcgacgctgaaatccaattcaatatggcgagcgatcccgcagccgatcgcaccggcggcatcctgccttattcacggctgaagcatatgaccattcaggcatggtgcccattccaatccggcacggaatacggtccgttcgtcggcaacgagcatttccccgagctgaacgccgaattgacccgtcttgccggcaaatacggttccacgcccaacggcattgccgtcgcttggattctgcgtcatcccgccggtatccagccgttgctcggctcaatgacaccggagcgcatccgccagatggcggccggtgccgatatcgaactcgaacgccgtgactggtggtcgctgtatcaggcagccggcaatccgttggtgtgagcgagagatgacgagaccactgccgttgaggcgcgtgttcagcgtgcatacatctcaacggcagtcaatgctgtgtcaatccacccacgacgagaacaacgacacgaacattccgcgaatcacatcagaacgacggcatatcgagcgagggaactgaatcatcggccttactggtcccgttcgcgggcgagccgacatcgtgattgtggaaccactcgacaacccgtgtttcactcatcggcatcaaatcccaagcatccaagccaacattcagtgcctccgggcgtgcaccaccgagtccctcaatctcaaccgtatcgtgcggctccaaactttcgaacaggttaagtgcggggcggtcttccaaccaccagtcgtgaaatacctcatgacagtcgccttcccttttcggcgtgcagcaatcgtttcccatcctaggcgcagccggcacctgtcggttcgtgttgccataatgaggcgcattgcaggggaaccagtgaacgcaagctgccagccatcgtgacggcgaacgggttgagaaaggcgctgtgcctgacccttggaacctgttggccaacaccatcgaagggagcaaacgatgtcttttgacgccgccgcattcggcccgatcaccttgaaccacctgccgccgttcgcccagcgcctacgacatgcagtacacgtggaaacccgaatgggacgtgtgaggcgcacgatggatgagcggtgggcgcgtgctttgcgtgccaagggcattgatattgacgaggctgacggtgctggtgggaaacaggcacacgacggcaaacggcataccgacatcacgggtactggtcgacgccccgagtcccagccggctgccgggctccgcggtcgatccaataccagtacgaatctgccggggccgaaggtgacggcacgcgccacgccattcaaggccaccggtcataagggcggcatcagccggcaggggaattgagctgatcgcagaaccatcgcgcgatgaatgggcgcggccaacgccattccgccattgttgagccgcttctacttggaccggtacctctttgaacggagatatcattccgcaaaaggtcgaatgtacctctttgaacggagatattccatattgaagctattccggcatcatatggtacgtaggaaatcccggatatcggcgatttcctcatcacagatggcatgggccatgccggaatactcgcgataggtcagatgtccggcccgttcaaggacctgatgggccgtttgctggtcgggcagcggaatcgtgcggtcctgcgcgccatacgccaggaagaatcgggtaggggagtcaagcgccgcctgttcctcgcccatgaacgaaggactgagcaggatcgcggcatcgaacaacgtcggatgcaccttgaccagacgatacgacagataaccgccttgggagaaaccgatcaatatcttcctgcgatgggcgaatgccgaggcatccagcagtgaagccaccgcatccccgaccgccgcgcattcgcgttggcgctcgtccacgccgcagccgtcgggataccagtaattgccgcccatatagggcctcgcgtaggtggcgcggaacgagatatagctgggtacggcggcaattgcggccggggccgcatcggctcgcgtcggcgcatatacggcgtcgagaatccgcatcatctcgctttcgtcgttgccgtaaccgtggaacatcaggaaaatggggtcattgccgccggcatcgatctggcttgtcatctgcattcgcatcgtcatcacctcaccagcgagcttacatgcattagacttgtagcgattgacccaccgagcacgcaaggagcaagttatggagccgaggcgcgggcctctcaccgcaggcgagaaagtgcagttcaccgaccgcaagggcaagaagatcaccgatcagcttgtggccggcggctccacgcagaccgagcatggcctgattctgcatgacgatgtgattggcaagatcgaaggcaccgtaatcctcaccgtgcatgccaagcgcgaggcacaggtcaatcaggtctaccccgagaaagacaagaacaagccgtggaaatcgtcgcgcgccatcggcggctgggagtatgcggtgatgcgcccgcggctggccgattatgtgctttcgatgccgcgcggcgcgcagatcatgtatccgaaggacatcgcccaagttattcagctcggcgacatccgctccggcatgcgcgtgcttgagtccggtgccggctcgggcgcgatgagcgtgaacctgctggacgccgtgggcgagcgcggccacctgaccacgatcgagctgcgccccgaattcgccaaggtcgcccaagccaatgccacgctgtactatggcgaggcccccagctggtgggatctcaaaaccggcgacttcgattccgttgccgccgaactgcccgaacactggttcgaccgcatcatgctcgacatgctcgacccgtggaacaggctcgagcaggcataccgcgtgattgcccccggcggcgtgttggtcagttacgtaactaccaccacgcagatgagccgcatggccgaagccctgcgcgcggccggctgctggaccgagccgcagatccaggaatcgttcgaacgcacatggaaggcccagggcctcgccgtacgccccgaccaccagatgatcggtcataccggtttccttgttatctcgcgcgccatggcctccgggttcgaggcgctcagaaagcgcgatcgcgtgaccaaggacacacagaccgacatcgactcgctcaccgacgaacagcgtgaagcgcagatcgaggaactggaactgcgcgacatctccgaccacaaactacgtaaggtgttgcgcgacctcgaccgtcaggtgggagaacttggcaatacgcacgaataaccgccaaacgatgagtttgtgaacgctcacacacctctatactggaagcaataccacaccgccacaccgccacaccgggcagacggttcgtgaagggagccacggatgggcatcaagctgagtaaagtcgccaaagcggcgaagaaatacgaccatattctcatcatcatgaggcatgccaaggctgagccgttcggcgacaagggtgactcggagcgcgagctcaccgacaaaggtctgaaacaggcgaaggccgtgggcaagggcatcgagtcgttgggactggtgcccgaccaaatctcctgctcgtccgttacccgcacgcgccagacgttggaccgcatgctcaagacctttggcgacaagccaatcgtcgactaccgcatcagcctgtatgacgggggagtgcaggcggtgttcgacgagctcgcccacgtcaaggccaagaatcgcgtgttcatgatcgtgggccacgagccgactgtgtcgatcagcgcccaatggctcgcctccgccgactccgacggcgaacgactcgacctgctgaatttgggactttcgcccgcatccatcgtgatcatgggatcgaacaaaccgttcgacgaatggcaggtgcacagcggcgaactgctcgcggtcatcaatgtgaaagacttcgactaaagcggatataaattccatctataacgacactctgcggccatttataagggccggaatccggatgttttgctaccctaagtcgggttacgaacgcatacattggaggattcatgtccactctgacttccgtctccggcttcccccgcatcgggcagaaccgcgaactgaagaagatcatcgaaggctactggaagggtgccaacgacctcgccgccgtcaaggccaccgccgccgaactgcgcgccaagcactggaagctgcagcaggccgccggcatcgacctcattcccagcaacgacttcagctactacgatcagatgctggacaccgccatccttctcaacgtgattccgcagcgttacgcacgtctctccttcgacaaccaggaggacacgctcttcgccatggcccgcggctatcagggcgacaagggcgacgtgaccgccctgccgatgaagaagtggttcaccaccaactaccactatctggtgcccgaagtcgagtcggccgcggagatcaagctcaactccaccaagccgttcgacgagttcaacgaggccaaggcgctgggcatcgacaccaagcccgtgttcatcggcccgtacacgttcctgaagctcgcccgtaccccggaagccaccgaactcgagctcgacaagggcctggtcaacgccgtggccgccgtctacgtcgaagtgctcgccaagttcaacgagctcggcgccgcatgggtccagctcgacgagccgtacctcgtgctcgacaaggagccgggcgacgttgaactcttcaagaccctgtacaccaagatcctgtccgccaagggcaatgtcaaggtgctgctcaacacctacttcggccacatcgccgacgtgtacgagaccgtcaacctgctcggcttcgacggcatcggcctggacctcaacgaaggtcgcgaggagaacctcgaagccgtcgccaagtatggcgtggcctccaacaccaccatcttcgccggcgtgatcaacggccgcaacatctggcgcaacaactacgccacctccctcggcctggtcgacgccctgaagcaggtcaccgccaacgtggccgtctccaccgcatcctccctgctgcacgtgccgttcagcaccgaaggcgagaccggcatcccggccgaagacctcaagcacttcgcgttcgccgtccagaagctcgacgagctcaaggaagtcgccgccctggccgacgccaccgaggacgagaagaaggcatccgccgccctcgccgccaaccaggctctgttcgacggcacccgcgtggccgccgacccggccgtcgccgagcgcatcggcaagctgtccgacgccgactacgtgcgtcagcctgcccgcgaggagcgtcaggccctgcagcgcgaggccctcggcctgccgctgctgccgaccaccaccatcggctccttcccccagaccaaggagattcgcgccgagcgtgccaagctgcgcaagggcgaggtcaccaaggaagcctacgacgagttcatcaaagcccagatcgacgccgtcatcaagaagcaggaggagatcggcctcgacgtgctggtccacggcgagttcgagcgtaacgacatggtcgaatatttcggccagaacctcaacggcttcctgttcaccaagaacgcttgggtccagtcctacggcacccgttgcgtcaagcccccgatcgtctggggcgacgtttcccgcgccaacccgattaccgtggaatggtccgcgtacgcccagtccaagaccgaccatgtgatgaagggcatgctcaccggcccggtgaccatcctcaactggtcctggccgcgcgaggacatcacccacgaggagcagaccaagcagctcgcccttgccatccgcgacgaagtgctcgatctcgaggccgccggtatcaaggtcatccagatcgatgaggccgccctgcgtgagaagctgccgctgcgcaagtccgactggcacgtcaagtacctcgactgggccgttccggccttccgtctggtgcactccgccgtcaagccgaccacccagatccacacccacatgtgctactccgagttcaacgacatcatccgcgacatcgacgcgatggatgccgacgtgatctccttcgaagcctcccgtggcgatctggtggtgctcgacgccattcatgacgcgcacttcgagaccgaggccggcccgggcgtctacgacattcactccccgcgtattccttccgagaaggagatcgaggatcgtatctacgagatccttgacaagatggacgtcaagaaggtgtggatcaaccctgactgcggtctgaagacccgtggtaacgccgagacctggccgagcctggagaacctggtcgccgccgccaaggccgtgcgcgccaagctcgacaagtagcggaaatcaccgagctccctctggatgagggagctcgggtttatgtaaggaaatcagcatgcattccccgatgttcacccttgaggtctttcccccgaagcgcaacgcgcctgtcggcaccatctacgacaccctcgacggactcgaagggctgaaccccgacttcatctccgtgacctacggtcacggcacccattccgaccgcaccgccaccgcgcgcatcgcccacacgatcagcaaggaatacggcatccctgcagtcgcccacctgaccgcgctctactccgacaaggccaagatcgatgaggctctcgacatgttcgaggaagccggcgtgagcgccgtgctcgcgctgcgcggcgactacatcgacggcgagcagctggtcggcgagttcaaccacgccagcgacctcgtgtcatacatccgctccgtgaagccggacttcaaggtgtttggtgcttgctacccggaaggccactatcaggctgactcgctggaccaggacatcgaaaacctcaaaatcaaggttgatgccggcgtcactcacctgatttcccagctcttctacgacaatgaggacttctaccgcttcctcgacaaggcgcgcgccgccggcatcaccgtgccgatcgaggcgggcatcatgccggtgcgtggagccaagtccgtgcgtcgcatggccgagcgcaacgcctcgcgcatcccggacaggctcaacaccctgctgaacaagtggggggacgacatccagtccctgcgtgccgccggcatcctctacgcttccgagcagatcgccgacctcgtggcccacgacgtggacggcgtccacctgtattcgatgaaccaccccgccaccacgcgccgtatctggcgcaatgcggaaccgttgttccgcggtacgcaaggttgacgcatatcgcggcgcggcgcatctcaatgcgtcgcgccgcacgttaatctgctggcgaaacccagagttctcccagcggccgatgggtatcatgaacgtgcaagccaaccaaagcgatggaagggagtccgttatgtgcactggtgtccgtttctccgatgatgagggcaacacctatttcggccgtaatctcgactggagtttctcatatggggagaccatcctggttactccgcgcggctaccactatgacacggtgtttggtgcgggcggcaaggcgaagccgaacgcggtgatcggcgtgggtgtggtcatggccgataggccgatgtatttcgactgcgccaatgaacatggtctggccatcgccggcttgaatttccccggctacgcctcgttcgtccacgaaccggtcgaaggcacggaaaacgtcgccacgttcgaatttccgctgtgggtggcgcgtaatttcgactccgtcgacgaggtcgaggaggcgctcaggaacgtgacgctcgtctcccagatcgtgccgggacagcaggagtctctgctgcactggttcatcggcgacggcaagcgcagcatcgtcgtcgagcagatggccgatggcatgcacgtgcatcatgatgacgtcgatgtgctgaccaatcagccgacgttcgacttccatatggaaaacctgcgcaactacatgtgcgccagcaacgagatggccgaaccgacttcatggggcaaggcctccttgaccgcctggggtgcgggtgtgggcatgcatggcatcccgggcgacgtgagttccccgtcgcgcttcgttcgtgtggcctacaccaacgcgcattacccgcagcagaacgatgaagccgccaatgtgtcgcgcctgttccacaccctcggctccgtgcagatggtggacggcatggcgaagatgggcgacggccagttcgaacgcacgctgttcaccagcggatattcgtccaagaccaacacctattacatgaacacctatgatgaccccgccatccgttcctacgccatggccgattacgatatggattcctcggagctcatcagcgtcgcccgatgactccttcccggctcatgccccattcggagggcatgagcgtatatagtggaatcttatggaatcgtcgatcttcaaacccagctccatggacctcatcagggcaggtctgcaagacctcgacaaggcccgcgccttgttcgaccagctcaaggcggacgacattcccgatgagcgatgcgccgaactgctgagcgcgctggcccacgcctgcgaccccgatatggcattgagcaatttcgtggatatcgtcaacgcgatgcaatccagccagcgcgatctggaacacgtcatccccgacaacgacgccctgaagcgtctggtcacggtgctcggcgtctccgacgcgatgggcaagttcatgcgcttcaagccgcagcttgtggaggcggcagcagtcgacaactgcaacagccatctgttcaatcacgcgcaacgccgtgcacgtctgctcaaggcggtcggcgcggacccggacgaaccggccatgcccgtcgcctccaaggatctggccgaagcggccacggccctgcgttccagctaccggaaccaactggccgccatcatcgcccaggatgccgtggcggacgacccgacctccatccaaccgaccatcagccgcgaactgtccgacctcgcggacgcggcgctcgaaggcgcgctggccatcgcccgccacgaaaccgagggcagcgagcacgtgcgcttcaccatcatcggcatgggcaaactcggcgcacaggaactgaactacgtctccgacgtggacctcatctacgtggtcgaaccggccgacaaggatgtggaccatcagacgctgattcgcgtgggcaccaagatgggcaccatgttacagcgcgtctgccagtccgccatcatgggcgtggccgagcagccgctgtggcagatcgacggcggcctgcgcccggaaggcaaggacggcgcgctggtgcgcgtgctctcctcgcacaagaactattacgagcagtgggccgagaattgggagttccaagcgctgctcaaggcccgcccggtggccggcgaccccgacctcggtcaggcctacatggacatgacccggccgttcgtgtggagcgcatccaagcgcaagaacttcgtctacgactgccagaaaatgcgcaagcgcgtggaggatttgattcccgcgcccctgaaggaccgcgagattaagctcggccgcggcggtctgcgcgatgtggaattcaccgtgcagatgctccagctcgtacacggccgcaccgacgaatcgctgcgcaccagcaacacgctcgactcgctgcagcgcctgtccgaaggcggctatgtctcgcgcaagcaggccgtgcgcatgtcccaggactaccgcttcgagcgcgtgatggaacatcgccagcagatctggtccctgaagcgcacgcacctgttcccggacctcggccgggcctcggtcggaggcctcgaaaagaagcgcgacatcgacgtggacgagctcaaccagaaccaggagctgcgccgactcgcccgcgcattcggcctgcacccggaagaactcgtcgacaagtacgacgacacccgccgcgaagtacgccacctgcacctcgacatctactatcgcccgatgctgccggtcaacgcccagatggagaacgaccagatcgtcctgagcgtcgaggcagcacaggaacgattcgaatccatcggtttcggcgacccggacgccgccatccgccacgtgcaggcgctcaccgccggcgtggggcgcgcggccaaaatcaaccgcatcattctgcccgccgtcttgcagtggctgggcgagggccagaacccggacatgggcctgctcaactggcgcaaactggaggagaacttcggcaccgaatccggctacctcggcttcctgcgcgactccacctccgccgcccagcgcctgtgccacatcctgtccaactcacgattcctgggcgacgcgctcaacaagtcggtcgaatcgatcagctggcttggcgacgacgacaatctgcaggcccgcacgcgcgaggccttggacgtgcagaccggctcggcgctggaacgtttcggctcgaacatcaacgagttcgccacctccatgcgcgccatgcgccgccacgaaatcgaacgcatcggcctgtcttggatgagcggtgtgatcagcgactccgacagtctcaaggccatgaccgacgtgtatgacgcgatcatcgatgcctccctgacctgggccgtgcgccaccagatcgccgagttcggcgtcgaaaccgcgccggccggcatcaccgtcatcgccatgggccgttacggcgggcgcgaagtgaacttcagctccgatgcggatgccattctcatctaccgtccggccgacgatgccgacgacggccaagccaacgccttcgccaagaaggtcgtggaagacctgcgcaacatcctgcaaggaccgacgacgctggaacccaagatcgaactcgacctggacctgcgcccggaaggcaagaacggcccgctcgtgcgctcctatgcctcctgcgaggaatactacgaatcctgggcttcgacctgggagcgccaggcgctgctgcgcgcccggtacgcggccggcgacgctgaactggcgcgggacttcctaatcaacatcgccgacccgttgcgctacccgaccacggagctgaccgaggccgaattgcagaacatccgcaagctcaaggcccgtatggaggccgagcgtctgccgcgcggcgtgcgtcgagaacgtcatctgaagctcggcaagggcggtctgtctgacgtggaatggaccgtgcaactcatgcagctccagcacgccggcgatatcaaagatctgcgcgtcaacggcacattggaggcattggacgtgctggaggccaagaagctcatcagcgctatcgatgcgattcagctgcgcaaggcatggacgttgtgcaccgcggcccgcaacggcagctatctgtggagcgggcgcgccaaccaggccgatattctgcctgatgacatctattcgctgggcggcatcgccgtctacctcggctacggcgcccaccgcggccagcatttcgagaacgacctgctggccgtgatgcgcaaatgccgtgacgtatgccagcgcttgttctatgggaagaccgaaggcgaggcggctgcggcaaccaccgccacggcctccgccgcaacgcagcagccgcaaaccgcccctcgcccgcgtatgcacgtgatcgcaccgcgactggaacgaaatcgacaccgcgcgcagcgataaggtagcatattcgttggattttcaggtggacactcggtgaatgcggctgtccgaaaaatggcgtaagttagattaggtcacgcaagggtggccacctgaaaaccacgagcgaaaaggtgagccttgtctgaagaaacgccaatggtcggcaaaagcgtcgtaacgctggacggcctgtctacaaaccagattctcgacctgctgcataaggccgaatacatcgattcccaccgcaaagagattgcccatacctgcgatgggcgagtgctggccacgctgttctacgagccctccacccgtacgcgcctgagctttgagaccgcaatgctacgtctcggcggcaaggtcatcggattcgccggcgcgcagctggcctccgtgaccaagggcgaatccatcgccgacacgttgaagaccgtgtccaactacgtggacgtggtcgccatccgtcacccgaaggagggtgccgcgctggtggcctcccgcgccgcatccgtgccggtaatcaacgccggcgacggcggccacatgcaccccacgcagacgctggccgacctggccacgctgcagtcgcgcttcggccgcatcaccgacctgaccgtgggactgtgcggcgatttgaccttcggccgcaccgtgcactccctgatcgagaccctgtgccgcttcggcaacgtgcgcttcgtgctcatcagcccggacgagctcaagaccccgcagtacgtgatcgaccgcatcaacgccaccgacagctgctcctacgtggaagtgcgcgacctggcctccgtgatcggcgacctcgacgtgctgtacatgacccgcgtacagaaggaacgcttcttcaacgaagacgactacctgcgcctgcgcgacacctacattctcgacgaagagaagctgcagctcgccaagccgtccatggccgtgcttcacccgctgccgcgcgtcaacgaaatcgccgtggacgtggacgacgacccgcgtgccgcctacttcgaacaggtcaagaacggcatgctcgtgcgcatggccctcgaaagcaccgtggtgggcgacgaactgcccggatacgaaccgctcaaccccaaggaggttcaggcctgatggaagtcaccagcattcagaacggcatcattatcgaccatgtgccggccggaacctcgctgaaggttctcgaatacctgaaaatcgacccggccaaaaccaagcttgcgctcatcatgaacgccgactccaagcgttacggctccaaggacatcatcaaaatcgaagatgacaaggacatcgacctcgacgtgctcggcttcgtggcccgccaagccaccgtggacgtggtgcgcggcggcaagatcgtcgaaaagaagcagccgaacctgcccgagcacatcgtcggcgtgatttcctgcgtgaacccgcgctgcgtgaccaccgccgagcccggcatcaagcagatgttccacctcgtgcactccgagcggctcgaataccgctgcgactactgcgacgaggaagccaaactgtgagcatcaccctacgcaacatcaaggtctggaacaccggcgaggtcatcgacctcgtggtgcccgggaccgctgccgcctacttcgccgacacctccgccgtggctgacggcgccgacatcgacgccaccggcctgaccgtggcccccggtttcgaagacccacacgtccacttccgcgatcccggccagacctacaaggaatcgatggtctccggctgccgtgcgtccgcatccggcggatacacgaacgtgctcatcatgccgaacacgttgccggcactggatgggcagaccgtgtctggcccggaagcgaccggtgcaaaagaggttctggatgccggcttcgacaacgtcatcgacttcctgcagcagtacgatactgcgcatgacgttcaattgccggttcgttacgatctgtgcgtgtgcgcgtccaaggatcgcgccggtcatgaggcaagcgacgttgccgattggctcaagtacgtgcccggattcgaggacgacgccaagacgccggccatgctcacgcaccccatcaccgcaatcagcgacgacggttccgctgtgacgccggagatcctggaccaggtgctggagaacgtcaaggcctccgacctgtacctgatcgagcattgcgagcatcacgatacaggtgccgtgaacgaaggccccgtttcccgcgagcttggcgtgcccggcattccggaagacaccgagctcaagatcgtggcccgcgatatcgaagcggcccgccgcaccggtgtccacgtgcacttccagcatgtgagcactgccatctcgttcgaggcgattcgcagggccaaggccgaaggactgccgattacctgcgagaccgcgccgcactatctggcgttgagcgacgaggcgctgctcaagtacggcacgctcgccaagatgaatccgccactgcgctccgaagcggaccgcaaagccaccatcgcggccatcgccgacggcaccgtggatctgctggctaccgaccatgcgccgcacacgttggcagagaaggaactcggcttccttgaggcgcccaacggcatcatcggactggaatgcgcgtacggcgtgtgccacaaggtgctcgtcgacggcggcttcatttccgatgagcgtctgatcgagctcatgtccgttggacctgccgaactcatggggcatgtgccaaccgacgtggccgcgctggtcgaggactacgccgaacccgcgcccaccggggatgatccggatggcgtgattgcgggggagagcgacgctcagccgcagcgtgaaggcgtcaaccgactgctcgacttgagccgcgtggatgacgccgacaatgtcgacctcgtggtgctcaacgccgccgaggaatggaccgtggaccccgaacagttccactccaaggctcgtaacaccccgttcggcggctggcaggtcaccggacgccccctcgccacaatcatcggctcccagctgatgttcagccgtctgtagataacacaaggagcagcatggatcgcctgatcgaagcgattgacaacactcagaaccccagcgtcgtgggccttgaccccactgaggcgctggtgccgccgcaggtcgtggcgagctttgccgacgaggtgcgtgactcggtcgaatccccggaggaagtcgaatccgcgcagctggccgtcgcctacttcgaatacaaccgcacgatcattgacgccatcgccgacatcgtgcccgccgtcaaaccgcagatcgccatgtacgaggcgctcggccccgccggcgtggacatctacacgatgacctgcgaatacgcggcccagcagggcctctacgtgctcggcgacatcaagcgtggcgacatcggctccaccgcagccgcctacgcccaccacctgaacggcgtgggcgacttcgacccgtggcatgaggatgcggtgaccgtcaacccgtatctcggcaccgacggcatcaccccgttcgtcgaggccgccgccgaagccgacaaggacatcttcgtgctcgtgcgcacctccaacccgtcctccagcgaactgcagatgctcgatctggccgacggcacgaaggtctacgagcacgtggccgatcttgtggaaggatggggcgccgagaccatcggcagccacggctactcccgcgtgggcgcggtggtcggcgccacccaccccgaggaaggcaaggcgttgcgcgcgcgcatgccgcacacgttcttcctcgtgccgggctacggtgcgcagggcggcacggccgcggacgtggcaggcatgttcgacaagcagggcagcggcgccatcgtcaactcgtcgcgcggcattatcggcgcatggaagaagagcggcaagtactccgaatccatgaccgccgacgaggcgctggaccttgtggcgagcagcgcgcgccaggcggcgctcgacatgcgcgataatctgcgggttgccgtatataggtaggtagattgtccggctgtgggctatacgtgagtgtgggctggaaaccggagccgagtgtgtttaactacctctcagtcaacctgcggttgaccgctcccctgatagggggagcttgatgtgctgaataggaatgaaatgacaactttcacccccacccatgatgtggttacggaagcgactgcggccggattcttcccgccgcgccacaacgtcgaaatcacgcaggttacggaactgaccgaccgcgtgatgcgactgacgttccgcgacccgttcatcgcctcccatgccaagcccgcccagttcgtcaacctgttcacgcacgacgacttcatgctcatgccgcgtccgttcggcgtcagcgaagtcgacggcgacgaagtcagcgtgatcttcgccgtcgtgggacacggcaccgaacagttggcaggactgcaggccggcgacaccgtcgacgtgctcggcccgctcggccgcggcttcaacctcaaggaagacgccaactacattcttgtcggcggcggactcggcgtgcccccgctaatctacgccgcgcaaaagctcgccgaacacgacgcctcctttgccaccgccgtattcggttaccgcaacgaccacttcgccgaggaatacgtctcccggtacgcggactggtcgtggagcatcgacgacgccgaaggcaacgtggtcgacctgctcaacaaactggaacaaggcgacgacctgaaggcctacgatcgcaagccgatcattctgtcctgcggaccgctgcctatgatgaaggccgtggccgactgggccgccgaacgcggcatccccgcgcagctgagcatggaacagcgcatgggctgcggctatggcacctgcgtgctgtgcaccatcgacaccgtggacggccgcctcaaggtctgctccgacggacccgtgttcacccgcgaacagctcggatgggggaagtgacgatgagcgcaaacaaccagtccgcgcagggcggcgacaaccacatcaacctgtacgagccccacgtgtggaagcaccacaccaaggtggccggtctggaatggaagaatccggtcggcaccgcctccggcaccttccagtacgccgccgtccgctggttctacgacgtcagccagctcggcgccgtatgcaccaagggcgcctcgcccgtaccgtgggaaggcaatccctcgccgcgcaccgccgaatcgccggccgcgaacatcaacgccgtgggcctgcagaatcccggcatcgaccattacttggccgaggacctgcccaagctcaaggccgcgggcgcgttcgtcatctccaatgtcgccggacattgcgatgacgattacgcggcggtcgtggaaaagctcgccgactccgacgcggacatgctggaaatcaacgtcagctgcccgaacgtttccgccggcggcatgagcgtgggcaccgacccggtggccctcgccaatcttatggaccggctgcgcccgatgaccgacaagccgatgatcgtcaaactcacgccgaacgtcaccgacatcaccgtgccggcgcgcgcggccgtggaacatggcgccgacgcgttgagcatgatcaacacgctcaaaggcatgcgcattaacattcgcaccggcaagccgatcatcgccaacgtcaccggcggcgtatccggcccggccgtgctgccggtcggcctggcagccgtctatcgggtgcgcaccgcactgccggagattccgatcatcggcctcggcggcatcgacagcggcgagaaggcgctcgaatacctgtacgccggcgcgaacgccgtcgaagtgggtgcggccgcgctcttcgacccggtggccccgctgcgcgtcgcccgcgaactcgacgacctgttggacagccgtcccgaactcgctgctaaactggccgcaggacagacttggaggtaaggaacatcatggcagaaacactcgcacatcgcttcactgaattcctgttggaatccaacgcgctgaagttcggcgacttcacgctgaagtccggccgcaagagcccgtacttcatcaacgccggcgccttcgacgacggcaagaagatcgccgcgctcggcgcgttctacgccgaaaagattagccaggccatcgtgcacaacacgattccccgcaacatcgacaccgtgttcggccccgcctacaagggcattccgctggccgtgtccaccgcgatcgcgctgaccgccggccacaacatgaccgtcggatacaccttcgaccgcaaggagaagaaggaccacggcgacggcggctggatggttggcaccccgctgaccgacggcatgaaggtgctgctcgtggacgacgtgatgaccgccggcaccgccgtgcgcgaagtcatccccaaactcaaggccgaggcgaacgtcgaggtcgtgggtctcgtgctctccgtggaccgcatggagaagaccaaggactccgacatgtccgccgtgaaggccgtggaagccgaattcggcttcccggtgctctccatcgccaacgtgcgcgagatcttcgacgccgccgccaagatgaagaaccccgacggcaccccgctgctcagccacgacatccagcagcgcgccgccgcctaccttgaggaatacggcgcctgatcgtcttcaatctaaaaaccaaaagcgggcttgcgagcccgctttttttattacgttccatgaacagcagcaccatattaaggcaaaagctttggcaaggagcgtgctatgaactggttagttgatatagggctgtttgcgctcgtggggatatgcagttacttcggcatcgagcatcatctggacagcaaagcgaacaagttgtcgcaaggtaatgaagaagaccgccgagatgctgatgcccaagtagaagcagcatgaaaatggcggaatgacgttggggtgacgccgctcatactcgggatatgacggatgaacagcctcttgaaacggagataaatgtctccagaaggccaaatcagctcccttgaaagcgagatagggttctaaactctgggaccgactcgcctgtgatgaaaacccgctcggcgtagaattaccgtaggttcgttgcattcgaacaaggaaggccgctatggggaacatcaccgacgatattcggcaacatttcgacactttcgccgaactgccgttcaccgaggcggatagcctcgctttgtcccagttggcctatgctcgcatgccggataacgtgccgcgctatcacgagaatgcagagaccgccgacggcatgatcgccacggttccgattcacgatttgctgcgtgccgaatgctatgacgacatgttcggcaaggtgtggtcgccttcgatgaatgtcgatctgttacgtgcgatgagcgagagcccacgttggaggaacctacgcgtgggcgcatacgtggacgaattcgatgctgcaaccaccaagcagttctcggcctgcgtgttcgaactgggtaacggcacgctctatgtggcttttcgcggtaccgacagctcaatcgtcgggtggaaagaggacttcatgatggcgttccgccgcccggtcgcctcgcaggaggccgccgcgcgttatctgaccgagctggctggccattgggccgggccgattatggtcggcggccattccaaaggcggcaatctggcggtgtatgcggcggccaatgtgcctagcgagattcaggaacgtatcacggtcgtatattcgcacgatgggcctggattcgatgaggtgttcttcgatgaggacgggtacgtacgcattgcgtcgaagatccataaatcggtaccgggctcgtcgatcatcggcatgctgtttgagactcgtgagcatgtggaagacggctatacggtggtcagcagcgacggtgccagcatcatgcagcatttcgcattgcactggcaagtcgatcatggccaattcgtacaggctgatggactgacaagtagcgcgcaatacctggcacgcacgatcaacggatggatggcaaaatacgacgacgagcatcgccgcaagttcatcgaaaacctgtttgccatcttcgaggctggcggatacgacacattcggcgacctcacttcgcatttgacacagtcactgccgattatgctcgccgcggcccgcaacattgatgtcgaagatcgcgacgtgatgattgaagtgctcaaaggcttcgccgcgacagccgccgcgtcggtaatcttggccaagtagtcggaggccatcaaactggttttgccagtcagtctcaatagcgcaaaagccggcccctgagatactcaggagccggcccttacttccatttccccagcggggttggcttaatcgcagtatatctcactgctgaccatgcctgttttacttactcctaatcaatgagcttgtagccgtggtcggagactacggacttgagcttgtcgagataggtttcggcggccttggagagcttggaacgctcgttcgtgatccagccgaccaacatcgtttcgtcggtgtcgagcggcacggtgacgatcttctcgttgttgaggtcgccgttgtcgatgccggtgcacaccgtgtagccgttgaggccgatgatgaagttcaggatcgtggcgcggtcggtcacgttgatctgcttgggggagtactccggccagaccgcttcctcatagaagtagaacgagccttcctcgccctgctcgtactggatgaacggataaggtttcaggtcctccatggtgatgaccttcttggcggccagcgggttgttgcgcgagatgaacacgtgcagcggcgcgcggaagagcgggtggaattcgaggtgcttctcgcgcaggagcttgccgatcacgtccttgttaaaatcggacaggtagatgatgccgatttcggactgcatgttggcgacctggttgatgatgtcgcgcgtgcgggtctcgcggatggtgaactcgtattcgtcggacttgatggagttgatcatctccacgaacgcctcgacggcgaacatgtagtgctgggtggagacctggcacagctgcttgcgcggtttggcatgcttatagcgctcttcgagcaggtcggcctggtcgagcacttggcgggcgtaggtcaggaattccgcgccgtccacggtcagggcgatgccctgcgaggagcgggtgaagatctcgatgcccagctcgttctccaattccttgaccgacgagctcagagccggctgggagacgtacagggcatgggaggcctcgttcatcgagccgcactcgacgattttgacgatgtatttcagctgcagcagtgtcataaagtctatttatatcgctagggatagtcgccacacggccggtcaccgtcgtcaaggacgggtccatagacttcaactgccgcgatgcaacgtttggcgacttacagacgtacgccgagttctgcgagcgattcgcgtgcctgcaacgcgttctcgaagaggatgccgtggatgccgacctcgttggcgccgacgatgttcttggcggtgtcgtcgaagaacacgcagcgctcggccgtgaggccgaaacgggtcagggccagctcgtagatgtcggcgttcggcttatgcatcttctccacgccggagaccacggtgccctgcaacagctgttcaaggcgcgggtacttctcgaaggccaggtggaaggtctcatgcgaccagttggtcagaccccatacgccgtagccgtgggccttcaaatccgccagcagctcgaccatgcccggaagcgtgcggggcagcgcgtccgcgtagtggccgatgtagaacttgaagatgtcggcgagttcctggccttgttcgcgtaccacatccgggtagatgtccgcgaaatcctcgccggtgtccatgcggtcctcgtagcggaagaagccgcaggggtcgtcgtcggcgcagatgcgttccacgatctcatcggggaatcggccttccaggcatgcgcgggtgttccagtccagcagcacgccgcagaagtcgaaaatcacgtcggtgatgggggagttggccatgatgctccttgtgttgttggggccgttgagtggggtctgcgatttagtatagggggtttcatacgttggctcccctctctgaggggagccaacgtacggaatcatgcgatgacgtcggcgatggcttcggggatggcgtgggccacgtcgccggccacaatcgggtggccgagcgtcatgaagcgctggcgatgctcgcggccgatcagttccggctcctgccagccttgttgctcggattcggaggcgatcgccgccgccaggccatgcaggtaggcggccgaggccacggtctcgcccgtggtggccacgtcatcctgctgggcgagcagggcgccggttagaccggccagcacgtcgcccgcgccggcggtgcccagccaggccggtgcgctacccgacgcatagacgtggtcctcatccaccacgatggtcaccgcgcccttcaacaatacggtggcgccggtgagctcgtgggcacgcttcgcgctggccaacgggttcaaccgcacgtcgtcggcggtgtacggctcgtgcgaatcggcatgctccgcggtgctggcggcggtttcgaaccggttgagcagtttcgccatctcgccggcatgtggcgtgatcaccacctggccgggcacacgctccggcagcaggtcgagtgcgccggcatccaccacgattggcggcatgtcgtaggcgtccttgttctcatcctcgctgccgagcgcgtaatgcttgagcaatgcggcgatggtgtcccgctgcatatcgccgtcggtgccctcgacgctagcctcgggcacgccggaccccacgacccaggactgcacatgtcccttgccgatcacggcttccggcagtgcggcgagcaccatgttctgcgcgcgctccgggcccagataccggaccatgccggtgttcgcgcgggcggcggcgctggcggtgagcacggcggcaccggggtagcgctgcgagccggtcaccagaccaaccacgccccgggaatatttggaatcctcgaacctggggagacggaccgcgtcggacgcgaacgaattatccaccacctcgacgtccggatccttgtcgtcgatatcgaatccgaaatcgagcaactcgatacggccgcaggcgaacgtggcgggcggcagcaccgcgcacggcttcatcgcgccgaacgtgaccgtgaccgtggccggaatgtacgggccgggcagagaaccatcgttcacaccgacgccggatggcgtatccacggcaagtaccagcggaaaatcgcctgacgactcacggtttggcagggcgggctcatcgggagcctcgccgtcgagaccaagggcggaggcgagtgcggcggggatgccgcgtagcgagccttggatgccgatgccggtcatcgcgtcgatgatcagatgcgatttcctggccacggcgatggcggtctgcaatcgctcgccggcctcaccggcggaaaacccggacgcgcaaccgggaatatcagccgcgggatcaagcaccagcaccttgcctccggcgcgcacgaatgaggcgaatccggcctcatgcaacgaccggcccacggcgatggcggtgacgttcgcgccctcctgggccagcgcggcggccgcgaacagaccatcgccaccattgtctccggccccggccagcagcacgatcgacgtgtcctccagcgccagatcctcgtcgtccagcataccggccgccatgtgggccgcggcctgggcggccatgcgcatcagcggcacgcctttgtccagcaggggtcgctccatggcccggaccgtatcggagtcataggcgctgtgcagcagcagttcgcgacgatcggcgtcttcggtgtattccatggcaacccctttcttgtgtttgttacttgcggtccgtgtttacaggccgtacacctcgtgggcgaacttttcgaacacggggatcgagcgcttgaccttctccgtgtcgatgcagtaggccatgcggaagtatccgggcacgccgaagctgtcggacggcacaagaatcaggtcgtattccttggccttcatgcagaacgccacggcgtcgtcctccagcgccttggggaagatgtagaacgtgccgccggggcgtaccacgtcgaagccgatgccggtcagcgcatcgtagagcaggttcatgttcgtctcgtagacgttgagatcggcggtctggtcgatgaccttggccacgcccagctgaatcgagctcggcgggcagttgtggccggtgccgcgcgagatctggcccatcatgggcacgagcaggtcggcgtcggtggctgtgggattcaccgcgacatagccgatgcgttcgccaggcaggctcagcgacttcgaccacgagtagcaggtcagcgagttcgcgtagaagctggccgggtagggctgggtggcgccgtcgaacacgatttcgcggtacggttcgtcgctgatcaggaagatatcgtggccgtattcgacctgcttggcggtcaggatcgcggccagacgcttgagcgtgtccgctgaatacaccgcgccggacgggttgttcggggtgttgataagcacgacctgcacgttcgggttaagtgcagcctcgaatgcgtcgaagttgatttggaagttctcggtgtcggccggcacgatggtcagcttggcgccggcgcccttgacgtacggctggtattcggggaagtagggggcgaaggtgatgatctcatcgcccggcttggtcaccgcacgcatcgcgtgggacagcgcgcccgccgcgcccgtggtcgggaagatgtggttgccggtgtatgccatgccgaaacgttcgttgaggttttcggcgatcgcgtccttgacggatgggataccgagcgagggagagtagccgtggatggccaccggatcgccgttttcgtagaggtcgaccatggcgtcggtgaaggatttcggagccggcaccgagggattgccaaggctgtaatcgaacacgttctggtagccgatttcggcaccgcggctcgtggcgtactcgctcagctcgcgaatcacggacttgccgccaagcatggccttgtattcctcattgatcatggctgttctcctcgcatggttgtactggtatgcaccacgctactactatcgcggccggtttgcgccatttgccgcgccgtgcctaagctggctgttctatttgttctatttgttctattaactgtcgaaaccgcggaataacgccgatttccgctacagctccatgattatccacaaccgttcatagcgagcgctgtgggacggcgggcggaaaacggccgaatccgcgtgccgtcccacacctcgtgcaatccacgtttcgggaaagcaccaccgtaagaccggcgcgcatccgcatccacgacaggagccttaccggccgtaatcccgcactcgattattttttctgacagggaatcgaacccgaaacactaacccatgcacgccccaccgcaaacagcgaataaccaaatgtatgcattttcggcaccatgagcgaaggagttcgcaaacacaacagtgattggcatatacggcatcgaccggatgaacagcatcgcgtcctcataggtcaagacccactgggactcgtcgcccttgggtatagggacattgcctgtgtcatagtcgttaagcagcacaagactcggcaaatatcgttccaagatctcggcggtgccagcaatttccggttcggtggacctcgatagcaccttgacgacggcgtgaagtgcgtcaagccgcttgcgattgatggtataaccatcaacgagatgctgcttcagaactgagttggcccatcgccggaaatagatgccttccttggatttgacgcggtatccgaccgacaggatcatatccaggttgtaatgctcgacttggtatgtcttaccgtcagatgcagttgtcgcaaattttgcgacaactgaaaatccattgagctcttcccttaatgcattgccgacatgcttgccgattgttttgatatcgcggccaaacagcaaggccaattgctgtctgttaagccacaccgtgtcctcgtctaccttcacatcgaggtgcacggtgtggtccgcgctctcatacaaagcaatctgccgcttcagttcctcgccagtcatgagatcgcctttcttttttcgggcgtctgtaaatcatgtcgttgtcgtcgctaaattatgcatccagtttatcagggcagtcgaacgtttgttcgattactgtatctctcatatttgtatgactttcccggctcccgccatcaatcaccagtcgcaggtaatcgcggtcggcggacttgcggcgtggcacgaaacgactgatgatggagtccttcttgccgcggttcttcacgtacaggaaaccgaacacggagaacacgaccgcgccgatgaagttgacgaccagatcctccatcgtgtcgatcagaccgatgtcgaggtagccgccgaggcccaggtcttggccattgaccgtgacctgggtaatgtcgttgatgcgaatcgcatggttggtgtgcgtggggtcgagcatcaccgagctgatggaatgcacgatggcgtccttctgcatgtcgaacccgaacaactggtccatgccgaattcgaagaactcccagatcacgccgatggtcatggagaagcagaaggacacgatcgccagatacaggggcgaaagctcgaacttcacccggtcggaccggttgagcaggtcgaccagcgagaagccgatcgccgcagcgaggaagccgttcatcgtatgcaacaccgtgtcccagaacgggaagatctcatagaacgaactgatctcgccaagaatctcagccgagaacacgaacaccagcacgatgacttccagcaccgaaggcagctcgatgcggaactgcacctggatgaacgccggcgccaacagcagcagcaacgtcaggatgcacaggaacacattttcgtagtcgccgttaaagaactggagtattgccatggcgagcaccagcatgcgcagcaccacatagaccgcgaatgagcttttgtgttcgcggatttccatgcccacggctcggctcatggttttccagcgtacgcgccaggacggtttgcgttgtgcgtcgtgctgttgcgactgtttccgggtcatccttacctctttctcgcattgttctcgcgccagtctatccgaacctgctcacaggcaatcggcaagaacgggcgatagtctggccgcacgaaccgaacggaaaccgatactgtctcgattgtgggccacgcgaatcatccgacaatgctcgatgaggccattacgccggctcctcatggctactggtcgtagggctggcaatcatggccatgccggtagtttgggctatcgtgaggtgtgcgagatgggctttgtgccggctggcagcaaatccaagcagcgaaacaacggaatgaacgaagcgaaaggaacggtatctgatgactccgattgaattgtcaacccgacgccgggttacgggactgacttcggatgagttcgccaggctgttcgtctctttgcagcgtgaagtggacggcgaagccgcgcattggagcgccacggatgtcgaatcctgggagctggtcggcccgccggtgaccgccgaacagcatctcatcgacacgttcgccgcggccaacgaattcgtggccacgcttgcggaccgcctgtaccacacgattatgccagtcacggaagaatcggtcatcaccgcatacgctgatgacctcacattctgggcatcgcatccggaccttggcggagtgccgtgcgcattatggaacatcgccgcactgcaggcggccgaatgggcccgcaaagaaaccggcatcgcctgtgaactggacgtgcgcgaaccgctggtgtgacagctgagctcaaacatgcgtaggtaacggcatggtttgaggactatggtgttgcgttatcggtcggaaaggatgtgatggtggggcgtcatagcaaaaaagcgcgtggccagtcgaggagatatgcgcgaaagccctccgtttggagcgaaattcgcggctatctgctgacagtgatcgcggtgatgctggtcgtgttgctgggacgtaccttcgtgttcaacgtatatgtgattccatcccgcagcatggaagacacgttgcaaatcggcgaccgcgtatttgcctcgcgattgactccgagactctttacactgcaccgtggcgacatcatcgtgttcaaagatcccgcagactggatggagggggagcagcttcccaccaatctgatgtcgataatcgacagcaatcgttacctaatcaaacgtgtcatcggtctgcccggcgataccgtcgcctgcaagggatccggggagcccatcacggtcaacggcaaacccattgatgaaagcgcttatcttaagtccggcgtgaatccaagcgacagccctttttccgtaaccgttactgacggcaacgtgttcgtgcttggtgataatcgctccaattccagagattctcgataccatcttgacgacggcaacaatgggctagtgccatacgacgatatccaaggtgtggcgttgttccgcttctggccatttacgagaatcggcatactgaactgagtttggcgtgaatccacgagttgatacgtgccgcacggtccggtgcatcctgcagccggaccgttaccggaaccctccccccgaaatctgacgacccccctgtctcacagctatcgtacagctccgatacgggaaacgtgcgggtgattccataacgactacgtacttcaggaagtgacgtgtatcacactatggtcatgtgttcagtcgcgcgcgacccaaagcgtatcgaggtcgtcggcctcggtcgcctttttgcgcttgcgtacccactgttgcaggaaatacgccccatagcaggccacgatgaacacgagctcggccacgagcgcgaaccgttgctccacgtcgaaaatcaccaatacgaacgatgcggtgcacaggatgaacgccgcccaagacacgtacggatagccgggcgtgcggtatttgagttcgctggtggaatggccggactccagccaacggcgacggaacacgatctggcagtaggcgatggcgatccacaccaccacggcggacaggccggaaagcgccaccagcaccaggtacacagtcgaggcggcgatcacggaagacaggagcgccagcaggccaccggccatcgcggcgcacaaggcgagcatcggcacgccgcgacggttcgttttggcgaaccagcgcggaatcatgccttcgttgcccatcgaccacaccatgcgcgtggaggcgtacaggccggaattcgaggcggagagcacggccgtgagcaccacgaagttcatgatgtctcccgcataggggatgcctatgccgttgaacacgagcacgaacgggctttcgcccacgccggccttgcgccacgggatcagcgcgcacatcacggtgattgagccgatgaagaagagcaccagacgccacagggtggtgtggatggctttcggcacggcggtttgcgggtccctcgtctcaccggcggtcacgccgatgagttcggtgccggagaacgcgaagttgacggtcagaatcgtggcgaacaccggcatgaagccgttggggaagacgccgtccttgatgagattgacgaacatcggggcatgttggtagccggcgaccgggatgacgccgaagatggcgagcgatccgatgacgatgaacgcgcagatggcgaacaccttgatcgaggcgaaccagaattccgcttcggcgaagagccgcaccgacaaggcgtttaaggtgaagatgagaatgatgcacgccgcgctccacacccatgtggggctgtccgggaaccagcgttgcatgagcaggccggcggcggtgaattcggagccgagcgccaccgtccaggtgagccaatactggattgcgatcacgaagccggtgccagggccgatgaacttctcggcatacacatggaaggagccggtcaccggcatggccacggacagttcgccgagcgtgagcatgaccaggtagacgatcagcgcgccgatgctgtatgccaggatcgtgccgatggggcccgcctgctggatggtgtatccggagctcaggaacaggccggtgccgatcacgccgcctaatgagatcatctgcaggtggcgggattccatgccgcgcttcaggttggtatgtagggcgtgctcgtctttgccatcatgtgacgactcggactggctggtttgcgctggttggttcacctgttccgaatggcttcgacggccatccgtctgaatctgcggttcctgttgcgaggacggcgactgtgccgccgtgtcggtgtcgggctgactcatgtttctctctttgccgtgcgtgcgttccataggcgtcgtcgtgacggcccggaatagtatacccgcaccgaggatatagctgcgctgcatgatgctgagtcaaaatcagccccctgaaacggagataggcactcgcagcggctacttcaccttctggatgcgcagcacggtggccaccacgtacaggccggtgctccacaggaggccaaaggccagaaacccgacggcaaatcgaatgttgtttgtttttttccatgttctcggacatgttcgatggcctcctatggttttcgttgacgttttggttattttgtcgaccatctcatattgtggaattccgggctttttgggcgtgctgttgcctttgttgcgccgttgcgatatcggtcttgtgaacggttaatctactcaggactcaaaatacattccagcctgcggcacgttcggtgttgcaggacagtaattcgaggatgagcgactttgatatgcagtgatacgccagtggcggagcgctacaagtcatggtggatgagatgtgattttcgtcgaattggtcagtgcttttggacaataccgaattggcgtcgaatcgggtatatactgggaccgtcttccaggcggaagtatggttcagaaggaatgggtagaacatcatgaacggcattgcacttggcacccggctggggtttgccgtatgcgtgctgctgatgatgccagttcttctgcccgtggcctgtgcggagtcgttgcggcagcgtttggccggtgcgtggacgatggctgcctcgcgtgggcgggtactgtcgcgtccgatgccgatggcggacatcatcgtgttgatgacgttgttgttgttgtcgttgagtgccactggctgctggattgccggcggtgattcgcagactgccctggccgccatggtcttcgtcgccacggtgacggctgtatgtgcgtgctgcgcggtcgtgctgttgtcgttcgtaggttcggccggccgccgaccgttgcccgccagcttccgcttcgatgcgacggtgatgaacgccgtccgctcatgggcccgcccgcaatggatgccacgctggccccgttacacgctccccgattcccgaatctgatttagcttctcttttcagctctcatcgttgcgccccacggtctaacgcaattgtgttgtttaggcgacatgtggatacgcatttatgcgatgttcttgtttccccctaatttggttcccctctctgaggggagctgtccgcgaagcggactgaggggagttcccagctgttgccgtaccagattgcagttgcttgaactcggaaacacatcccagattcgtcaattcatcaggaatcccaatgaacttcatcaatatcctcaaccacatcctgcgacccctagaatgggttgtcgcccaactgctcaccctgtttcaccacgccctggtcacgtttggcatgactgctggccccagccccgcgtggggcatcacgatcatgtgcctcgtgctcgtcatccgcatctgtctgctgccgctcttcctttcccaaatgcgtgcgatgcagcggatacaggtgctccaaccgcagattcaacgcatccagcacaagtacgccgcgcgcaaggacccgcgttccaaagaagccatgcaacgtgaaatcatggccttgcagcagcgatataacgccaatccgcttggctcctgcctgccttcactgatccaggcgcctattttgtgctcgctgttctacacgctgcaatccctgcctgcaatcgccgatgggaatgcggaaccgttgggcggcatcgaccacaccatggcgggcgacatcgaatcatcgtccatattcggcgtacgcatcgccgactcgttcggcacggttgcctcgccgcagtcacgcatcatcatcggcgtggccgtggcgttgatgtgcctgacgttgttcgcgatccagtggatgctcattcaccgcaatacgtcgaaagatgctatggtctcgccgcaattccgtgtgcagaagatgaccgtgttcgtctttcccgccatttacgtggtgtcgggtgccacgttgccgttcggcgtgctgctctattggttgaccaacaatctgtggaatctcggccagacgctctgtcaattgcgatggttccccacgcccggttcggcggcaggcgagcgcaaggccaggcgcgactacgagcaggacaaccgtcgccgtgccgcagccggtctgccatccctagaggaggagcgtgcgatggccgcccgcgaggaggcgaaagcccgacgcgagcgcgaaaagtcggccgccagccgcaaccgcaaacaacacaaaaccccacacctcgccaagcgctcaatcgtgaaacggtaacgcactactcgtctactggctcccctctggaggctgagccgttaagcaaacagcgaagctgtttgtaagcgagggcgaggcgacagtcgagctatgtagcgcggtcgccagaccgtcttcattacggctgaactggcgccgtagacgactgaggggagttttgctaaggccgcatgatgttgtcacattgtttttcaatggttttcacttggcgtgtattgactgattacattggagtacaacacaattgacctatacggataaatttcgcagctcaaagatggggaaacgatatgagactggcgatggcgcagatggcgatgaccgacaatatcgacgaagacgccgatagggccttggcctactacgatcaggccggtgaggccggtgccgatctgttgttcttccctgagatacagttctccccgttcttcccccagtatgagaaccgcgatgcgtcgtgatatctcatggacctgaccgaccgtcacgtcgccgcattgcagagcaagactcggcaacatggcatgtacgttttcaccgaacctgtacctcaaagctcaggacggccacaactgcgacgcttcgctatggatcaacgaacaaggccatatcagcgccgaaccgttggagatgttcctgtgggagattcgcgtccaggtcacgcagaaccaggtggccatcgccatgggcaaccgggtcggcacggagggtgatgtggcgttcgccggccaatcagtggtggtggacccgtacgtcaacgctgccagcgaggccgacgaccaagaacagttgattatcgccgacatcgatctcacacagaccgcagcagcgcgcaaacagcggccattcctaggactgcgccggcctgaatggtacgtctgacaagaacaaaccgacgtcagcccggaatcttctcgacgatggtgttcaaggtgtcgaaagcctcatcgatttggtccactacctgcttgccctggttgaccatttcggtgatctgttctgtgtggggttgcggcagcgcataaatcgacgtcttgacgcgcttcaagaccacgccggcgtcggacagatcctgcttgatggaggcgattttgggaatggacagcgtgccgtcggagaagttcatgccggacagcagctcttcgatattgaagtccaccaacgtgccctgcgcggcactgtcgattttgggcagggcgttggtcgcggcgtcggcggccgcgcccagcatgccgcgcaccgccttcacgtccgaaccgtaatatggcacgtattcggcggcctgccatggcatgccttgggtttcatcacgcgccgtgacgatgtgactgccagcgctgcccatctgctcaagcgcttgcttgaagtcgccctgctcgacggattactgcgcctcgccgattacccgttgcgccgactgccagaacagccagccggaaatgcccgacgccagcagagccgcgaccagtatcgtgagaattacggtgccgatatgtttgcgcttagccataggaccaatgtaccttttgtcccatctagcgccattgtgttctggcctttagtccatcaaagtgtccaacagacttgtcttctctgaagaagcgcatggaaatcagttatagtcgattctctcctgtagctggcgaaaaaacagatataactgattccttaacatctatcggtgtctttgcttggcttttgttgagtaacgctctgccgcatcatgcaagtgcttgaccgctatgcgtttgcactgaacattatcgttggtggtgcataggctgtgctgtccgggcgcatcacgtcggcgcgcgtggtcggcacgttgttctccatcgaccccgccatgagcgtgatcatcgccgcgccgatactgcgccagaccattaccgcggtggccgtgcttggcgtcatcgtcgtctccctcgcgggtaccctgctggtgtgggcctccggcggcgatgacgcgaatggaaaagtcggtcaataagttcctgggaaaggaacatcgaatcctgtaagagcgatgatggcgcggtccagttctcgtcttctcgtcgtcctgtttttgttttcacacgtaacgaaccccacaatcgcaccatcaacatcgtgatctcttcgggggagggcgatgtcgcttgggcgcggctgtggggattcgcggcttacaggtcctgaacgttcatacgggccagctcggcgcgacgattgatcttgtcacgctgatacaagtagatgccggccagcacgatggtggatacgttgttggacaggaacgcgatgaatgcggaaagcacgacgttccacatgttgccatacgcaccgatgtccgccctggcgaagacggtaatcgccgccacaagcgacagcagcaatgtgatggcgggcaataccagaccgggccacttgctgtccatcttcgaaagcctgatctgcaatatgatgaagccgatgcagatggcgatgagaaacacgaaaaacactacggcaaatattgtggcgccaatcatgattactctccttgcttgagctgcttgcgatattcgctgatgaggattttggcggtgtcgaagtcgagcttgtcatcgaccgcgagccgtttgatgagcgcgatatacggctcgttctcgatctgctcgcccaactggattttctggatgagccggtcgagccgaagccgaacggtggggtaggagacgccgtactgcgcggcgacctccttcatggagcctgatgcgagcagaaaccgtttgatgaacgtcatatcctcgtcatcgaggttcgacatccacggcgggatcatcgtcatatccatacctgcctccttcaatccacggcgggtttaataaaattaagtataccataaataatattaaaatcaaatagatatctgtttaaagtttttcgtagattagtttgaggtcgtgatgtaagaatgcgtacgcggacgcgaaggaccggcacatgtcggcacgcatgtagaagcatcggtcaatcggatatgcatcgacagcaccctgaggcattgacggatagccgattcctgtcatgcgatcgcttgacagcatgttgtctgattgactctttgagtgccataattgagatggcatgcgtacgcgtcggactttatggaatgcggggacgatatggttgcggacgatgaggtgcgggcctcccatggtgggcgtcggaatcaaggtctgctgtggtttttcggcgcttccgccacattgggcgtggccgccgtcacggccatcacgtgcgccgtcatccggtacggctggaatgacggggagttctggaagctggtggtgccggcggccgtggcgttggtggcggccatcgtgtgggcggcgctcggcttcatgcgtcgcgccgggcggacgcctgacgttccggccgacgcgaacgataccagcccggccgaatccaggttcgattcggcggccgcccagattctggcgatcgtcgccatcaacgtgtggggcgtcatgttcatcgtcttcgatacgttccagattgacccgtggcggtacgtgacatgggtcgtgcccgtgatgttcctgctttatctggcggtcttgggcatcggcagggcttgtttccgcaaacgacagaaggatattcgcttcccggaggaaccaagtatgacgagcagccgtccatcatacttggcataggcgggcagttggacgatgccgggcaggtcctcgttgtcgctggtctggttgagggcatattgggtgccggtcatggaacgctactggaatctgtcaccctagggtgtcactttccgtgtttacctcgacctgccatgcccctggcgcgaaggttgagaaaaacggcgtcaactttcacgacagggggctacctcatgccttggcaaaatgccggcacaccgattcaggcgctcggactggtgaaacggacagggttcgatgctcgaaccgcctcccgacccgcaaacacgcagactgttctcaataatgtttcgttggatatcgatggagcgggcttgacggcgatcgtcggtccgtccggcgcaggcaagacctcgctgctgtatgtgctgtccggattggacaggcccgattccgggcgggtgaccatcggcggtaccgacgtctacgcactgaatgaggaacggcgttcgcggttcattcgcgggcatatcggtttcgtgttccagcaatacaatctcgtgccgtatctgacggtcgaggagaacgtgatgttgccgctctcgctcgcccatcgcaaggccgactacgtgcaggtcacgcagctgctgtcccggttcggtcttcgccagagggcgaagacgacggtaagcgccctgtccggtggcgaacagcagcgcgtcgccctgtgccgtgcgctgctcatgcgtccggcggtggtgttcgccgacgagccgaccggcgcgctcgacaccgcgaacagcgagcttgtgctgcaggtgctgcgcgagctggcggatgcgggctccagcgtggtcatggtcacgcatgacacggatgccgccgctttggccgaccacgtgatcttcctgcgcgacggtcaggtcacccacatcgctggcagactcaccgccgagcagattgccgatggcatacgccgcactttcgtaccggccgggtcgccgccgctggttgcgccggcgcggtctgtcggcccgatgatggtgaacgcccagcctatccaatccgtccaaccgggccgaccggtccagcgcgtggcgtatccgcagcagcggaaggaggctcatcgtggctaggtatgtgctgcgtgtgttccgtgacaatgtcacgggatgggtacccacgattctggtggtcgcggtggtgaccacgctggtgggcatatgcatgaaccaattcgtgtggacctcgtctccgtcgttcacattggccgcgcggcaggcgggtcttgatccggccgagttcggcatggtgtcggtcacgatctatgtggtggtgtcattactcgcgttcttctcgttgacggtggtcggctcggccacggtcaaccgtattcacggcacgttcgcgcaatggcggcttatgggcgccagcccgagtcaggtgcttgccagcatgtggatgctcgtgggtgtggcgagcctgttcggttccctgatcggctctctggctgcagtgccggccagcctgctggcggttcccgagttcaacgccatggctgcggaaagcttcgccgatggattcggctcgttcgcacctcctgcgttcacgccgtcgatggccgcgtggctcggatccctgctgttgggtgtggccacgtgcatgttgggcgcgtccatcccctcgctgcgcgcagcgaagatccgtcccatcgaggtgattcgcggcacgggagccatcgggatacggcacggttggcggtcttgggcgcactgggcacttggtttgattgtcatggcggcggcgctggcattggcgttctccggcatgggcacgccacggacgctcgcgttcggccaggaggcggggcagacattcaacagcgcgctgtgggccggcatcatcgcctcgttcggcatgtacatccttgtcagcatgctgattccgattctattgggcatcggacgtgtcgtgcgtcgcctgtgcgggtccgcgaccggcgtgctcgccgcccgttccgccaaggcgaaggccgccagcaacacgaacacgattgccccgctcgcccttgccatgggactgtcggtcaccctgctgacctgcgcgcgatcctatggccggatactcgccttaggcggccatccgaagagcctgaactacgcggactcgctgctgctcataacgatgctgtgcatcgtgtccctggccaccagcatggcggtcattgccctgtcgaaccgcagcatggtcgccgaccaggcattgctgcgcagcatcggcctgtccccacgtcgtgtgatccgcatgtatctctggcagagcctgcagctggccgccggcgcggtcattctctcgctcatcccggtcgccgtcagcgcaagcgttttcgccgcaaaatccgcggcgctcgtcggcatccccgtggccgaaatcccatggccgggcgtaatcggcatgggcacggcctgctggctggcattgttcctcatccagttcacgcagattcgccccgcgctacaccgcagcgtggccgacacgatacgcacatgctgacatgcacgcaacatcatacaaaaagagccacaatgggagccatgaaaccgcaatccgcgcaggccaataaggtcacggtcctggccgtgccactggtcatcgccgtggtcgaatgtgcagcgatgctgtgggagcatgcgatcggagcgccggccgacaccatgtatacgtttgccaaagatccgctgggattggctctgctgctggcgatgaccatagccagcagtgcgatactgcttgtccgttactggctgccagccgttgccttggcgcttgaagcggtattgttaatagttgcctcgtactggcggttggactcaatcgtgatgattcagacgctcgtcgcctgctatgcgttcgcccggacagcgagggggcgcgggctgtgcgttggaggcatcggcatgatgctgtcgatgaccgcgtcggccatcatggtgcatccggacgttctcgcgaccgaatgggtgagtcgagtggtaacgctggcagccgtgggaggcggcgcgcttgcagtacgtggcaggcaacaggccaaggaagccgaacacaaagctgccgaggaatgccggcgggcagccgagctggccttccaacgcgatgccgcaatacgccgttcgcgcatagccggtcaactgcacgacagtgtgggccagggtctgaccgtaatcatcgcactgtctgagggtctggccggcaaaaccgatgacccacgcgtggaggatgcgctgcacggcatcaacgaaatcgcacgagagagtctgggcgacacgcgcaaagccgtccgcgcactgaccgagttcgatggagcggcgaacggtgacgatacgcacacccaagaatccgaccagcattcatgggatgacattcggccgattctcgcgcacgcacgccggctgggcatcgtcacggtgttcaccgagactggtacgcgcgccgatgacgaagctcaggctgatttgtgtttcgatgtgactcgcgaagccatcaccaacgccatacgtcacggacagaacgtggtgcatatcagcatcgcctggaaccacagcgagaacggcaccgtcgccgtgattatccgcaatgacggcagtcccgcgcgcaaggacgcgcgcaaggatgacggtactgggctcgtccgtctattccaccgcgtcgaatcggcaagcggcatcttcgaatacggtccaaacgaagacggcgaatgggtcgtcgaggcgaccatcccgtccaacggagtgaacgaaaaggaccacaccgcatgattcgtataatgctcgtagacgaccagcgtttcgcgcgacttggcttccaactcatgcttgacgatgcttccgacatcgtcgtcactgcccagtccgctgacggccgatccgccatcgagacgctcgaacaggtcgccgttcagcatcgtccattgccgaatgtaatcctcatggatgtgcggatgcccggtatggacggcatcgaagccactcgccgcatcaccagacgctggcccaccatcagcattctcatccttaccacgtacgacgaggacgattacgcctttggcggtctcgacgccggagccagcggcttcctgctcaaggacgtcaccaagcacaacctcatcgacgcggttcacgccatcgccaacggtgacgcaatactcaccccacgaatcaccagacaagtgcttgaacgaggcgttccgcatcccaccagcagccagcgccagcaagaaatgcgcaaagctttcgacgcactcacccctcgccagcgtgaaatctgcgcactcatctccgaagggctcatcaacgaggaaatcgccaatcaactcaccgtcgaacctgcctccgtcaaacgtgccgtgacccgtatcctcgcaactttgggcctgcgcaatcgcactcaaatcgccatcggctggttcaaagcaggcatgtagacctgctatttgctcagcagctcattcaagcggattgttgttacgaatgcgactaccgcacgccctcccaagacggattccatgttcgacaccccattcggcaaggtgggcttggcggattttagtgatggttgcaacacctgtgtgttttgccgctcttgatggcggtcttggattggtgcgatcgtatcatgctgtgttgatgagttcgagtattttctcggatggtttcctgtagccgagtgttttgcggggccggtcgttgagttcctcggcgaccgcgtcgaggtggtcctcggggtatgcgctcaggtcggtgcccttggggaagtattggcgcaggagcccgttggtgttctcgttggtgccgcgctgccagggtgaatgcgggccacggaaatacacctgcatgtccaatgtggtcgagatgcgtttgtgcagggcgagctcgcttccctggtcccaggtcagcgagttcctcaggagcttgggcaggtattgcattttccggatgacggcctgctggacgtgtttggcgtcgtgcccgtcgggcaggtgcaggaggatcgtgaaccgtgtcgagcgttccacgagcgtgccgatcgcgcttttgttggccgcgctgcagatcaggtcgccttcccaatgaccgggtatcgcccggtcctcgacttcggcgggccgctcgctgatcatgatcatgggttcgcggaaacggggcttgcgcgagtccgtctgcccgtgcggccggcgttgggcgcgcccgctcctcagggccttgatgacgtcctttttcagttcgcctttggcctggacgtagatggcctggtagatcgtctccgcgcacacatgcatagcatcattatccgggaaatcggcgcgcaggcgccccgcgatctgctcgggactccaatgcgcccgcaatcctgcgcgaatgtatgcgagcaggccgggcaccgtatggatcttcgcgggcttgggtcgtctgggccgtccgcgctcatctgctggggccggtacggctcgtacatgccggtcgcgggattcgtgttgcgcaccagctcgcggctggcggtcgacgcgggacgattgagcgtgcgcgcgatcccgcgcacgctcatgccggccttccgccagtcggcgatgctgatgcgctcgtcctggctcagatacctcgaactgatcttttggggaatgtccacggtggaacgataccagtccaccgacggtttctcgttcctgccgttcgatcgtgtccttccgttgcgccacaccttgccggtgcgtttggacacgcccaccgcccgcgcggcctgcgtgaagttcatgcccgcctcgagatgctcgacgtaccggcgtcgccgcgccgcgcacatctcgccacgcgtcgcgtactccacgccctcgaacacccacctgtccacctggccctcccatcagtcagccaggcgttgcgacgatcactggaacccgcccttcgccatttttttgggggggagagaccggtggcggcaagtgtgcgatggaagtcggatgcatcgtccttgcggatgatgcgcaggttcattcctttggccgatggatagtttcggcaaatcgagggagcatggagcaaccgtcatgcgattgcctgacatgatgttgcgtttgcggccgctgaagggtgaaatggcggcgacattgcaacgcgcgggtctgggcaaggcatcctgcctttgccttcaggcccgcctttcgtgaagggtgattatgccagttatatcggctgcgaatctctcgatcgggtacaagggttccccaatcgtcagcaacattaacctgcggttgagcacgggtaggatcatctgtctgcttggggcaaacggcgcgggcaaaaccacgttgatgaagacgctactcggacggataaagcccgtgagcggagaggtcacgtacacagggacgaatatcaatgagatgtccgcggcgatagaccatcccagtttctttccttacctgagtggtagagagaacgtcgaggtggtctccgcgttctggggtctggatgtggacccggaggcggcgttggacggtgtgggcatcaatcgcgcggcgtatgggcggaaggcgaaggactactcgacgggcatgaaagagcgtctggagctgtgcctcgcccttgtgccgcatccgaggttcctgttcctcgacgagccgcagaacggtctggaccccgatggcatagcctccttgtccgaaacgcttcgcgcctaccgggacaaggggaactgcgtagtcatctccacgcatctgcttcatgagatccagggcgtcccggacgagtgcatcatgattcgtcacggccgggccgtgcaggtcacggatctgaccggggtgaacctcgcggatctgtatcaggggaggtagggtcttgaacgccgtttcccctgttcgcgcgttggtcgcctactactggaacacgtggtatttcctcgccgcggtgtttggggccgtctcgtcccttctgctgggtgcgtggatctcaagcgcggcgaacggaaccccgataaccggagggtattgcgtctatttcaccgccacccagccgttgatctgcctttcgctgctcttcgcatgcgatgccagggtcgcgaaggcgcactacggtggcctgccgcgccacgtgtattccgcgtggacgccatgctcgctcagggccgtgttccgggccctgatcctgacctccgtgaacctgattggcgtactgtgcttcgacgccatcatggtcctgacgggtaccggaattcacccgcatctggcagctgtcctgtgcttcgtcgtgctgcagagccttgcgacctccctgatctactcgatcgtcgagatcgccgccgatcccagaaccgccggaatcgtctcggccatcctttgctatgcatggattctcctgccgggcgaccttcccgactatgcgacgccctacgtcgcgaacgccctacggaccgtcggacttaacctgaacggcaccgtgatgtcgccggcggaagcggcgagtcgagcgtccgtcggccccgtgatggtcgtcgtcccgatcgtggtgcttttggttgcctatatgctgttgagccggttccgtcgcgaaggagtggagaggaaatgaagtccctattgcgtattgagcgtgtggcggtgatccgctggtcgacgctcgccttcgtggccgtgctgctgtttccgttgttctttttgcgttacgggaacacgggtgcggtggtgcagtcggcgatggtgatggcgcttcccgtaaccgcggccggtctcgtcttctccaatgcaagggtgccctcctcgtaccgttccttcagcatccacgaccggctcctgcttcgcttcagcgtgaagtcgctgtcgctcggcgtcgtgatcaacgtctgcctgactttgctgtacgggcttgccgtcggattcgtcgtcaacgagacgctttcgtcgcgtaccattctgatgcttgcgttcaccgccgtcgtcctttccctggcatgcttcgttctgcgactctgggtcagtcctctcgtcgcctggaacgtcgtcgccttcttcatcgtcgccggacttacggtgagttccggcatgttcgaggacgcgccgatgctgtacgccgtcataccaaccacatgggtgttgaacggggtgaaattcgccggttacgtgattccggtcggcgtcgtcatcgccgcgataagcgcatgtctgctgttcaaggcggtgaaacgtgtctgaccgaagccgtatacgggtgcactgtttcggatcgtaatcgtccggcagccagctttctcaccgtattccgttgcgggagtgagcctgccgctttccgctgatcccgccatacaaagtcgactccgcacgtcgcgagtcttcgccgaacactgtcattggtgacgcagaggtcgtgtgggaatggccgtgacaggggaggggtattgggcaagcttcgggcgccgcgttcggcgcgtggccgtgtgatggcggcggccggcatggttatggtgggatcgttgggcatccagacgtcgtcgtccctgtcggcgtcgttgtttagtgcgttggggccgattccggtcagttcgatgcgcatgctggtcgccgcgatcgtcatgctcgcgctcgtccgtgtgcttcggcctgtacacgctcttcgccgaccgggtcggcaagacgggcaccgggctcgacgggctcgccttgtcggtcacggtcgcggcgctggccacttcgccggtatccatcagtcacgccccgcacatgtcggccgcccagtggggcatcatcgccgcctcggcggtgctgggagtcgcgattccctacacgatggacacgttgtccgggcgtatcacgtcggcgcgcgtggtcggcacgctgttctccatcgaccccgccatgagcgtgattatcgccgcgctgatattgcgacagaccatcaccgcggtggccgtgatcggcgtcatcgtcgtctccctcgcgggtgccctgctggtgtggtcatccggcggcgatgccgtaaacggatgattcttgtcatacgattgcttgacatggctggtctgcgaatgcatgttttaccggccgccatcgattggaatgccagcctccagctgccagtgggcttgttcggtgtgggtttggaaggtgccgacgtgtgtttcgatgatggtttggtagcggtcgaggccgagtctcgtgtcatcgggtgtgatggtgtcgctggcggagacgtggatggcgtccgtgtcgaaggtgacgcagatggcgtaccattcgcccggatggcgtgtttggcgatgttcgcgtacagttccgccagcaggttcgacagcaggcccgccagcagtcgcatggtctccggcgtgagcggccggtgtggttcggcgagcaggttgtcgccggtgaatcccggggcttcgagcctggcctcctcctcgtcgatcagcgattgcagcccggcacgctgcgcggcggcatcgacttccgtggaatcggctgtgcggggttgcttgctgccgtgcgagccttcatgcgatgggtcggatggacgttgcgggtggttttcgagcgagtcgatgacctcgtgcgtgtggcccatggcccggctggcggcgtcgcgcaattcgtcgagctgttgctggtattcgtgttcgtcggcgggcatgccttcggtttcggcgtggtcgatgcgcaggatcaggtaggccaggtcgttgccgatggtgtcatgcaggctgcgggccgtctccccgcgttcgtgttgtcggcgcagcaggtacgagtcatggtcgcgttggcgcatcacatgtaacagcaggccggtcaggagcggaaagcagtagaacgccagactctgcaccgcggccaccatcacccggctcctgctgagatcaaggccgtccatggtggaggcgagcaggatcatggtggcggatgacgccggcccgcgatctcgtcggtggtcagccgccgcgcgtacaggcgcaggatctccttctcgcgcaatgacaggggatccctcatgtcaacagacatcttcgccggcaccgtgccggacagtagcccataggcggtctgcgcgtcacgaaaacccacagcggcctgttcgtcggcgggaaggccttgagccgcccagcgtatcgccacggcgatatcggtcctcagtcgttccttcgcgaacagtccctgagcgccggacgcgatcgcctcccgctggtagacgtccacggaatacgaggtgacgcacacgatgcctgtcccaccggtcctgcgccggatgcgccggcacacgtccgcgcccgtgatcccgcccaatgccatatccagcaccaacacctccggcctggtatgcgggttgtggcaatgctcaatcgccgccgcgggagagcccgtgctccacatgacgcggaagtccttggaaacggccgagatcatcgcgcacatcgcgtccaaggcgaacggatcattatccaatacgccgatacggattgcccgcgccgaaaccccaaccatatcatcatgcctcatgccgctcatcgtagccatgcccacagccggatgaaaacctgttgtcatgcgattgcttgacacgatgtcgcgggcacgtcgcagccggaccatattgggtgttgttgattccgagtagaagaggggagctgtgatgatagagatttccggtttgtcgaaaacgtacggcggcaaacaggcgttggatgatgtgtcgtttcgagccgagcagggcaaggtcaccgcgctaatcggtccgaacggtgccggaaagtcgacgttgctgcacatcctgctcgggttggagcctgccagtagcggcgcggccacgttcgatggcagccgatacaacgaactggggccatctccgtgcaatatcgtcggctcgttcatcgacgggttgacgccgcatccgtcccggacgggactcagccatctccgttggattgcactggtcgccggcgttccgttctcccgatgcgacgaatgcctgcggctcgtgggattgcacgaggcgcgcagacggacgttcaagacctattcgcttggcatgaaacaacgtctgggcatcgcggccgcgatcctgaccgacgccccgtatctcatcttggacgaacccttgaacggcctcgacccggaaggcatccaatgggtgcgcgacttcatcaaggattacgtttcggatcaccgtaccgtcatcgtctccagccattacatggccgagctcgaactggtgaccgatcacgtcgtgggcctgtcgaatggccggaaggttctcgatggtgacatcgctgcgttgctcgaccagtacggcagccttgaacaggcgtatttcaacgtggtgaagaagtgaggctgatgaagatgacatctttgccccgccatctgtcctgccagctggtgcgatactgcgcaaactggcaattctactggtccgtatgcgccgttctggcactcaccgcgctgttcgcggtgctcgacgtgcagacgatttcctcgacggtgtccatcacggcaaacggtaccgtacaatcgcacgacgcattggacccgaacctggcgcatatcgtgtccgacgccatgctcgcctcgccctaccagacctcaatcattctcatccctattatcgtggcgttgattgtggcggcgggattccggccgggcgatgaacgccagctgcggctgctgtataaccggccctatccgttcgcggtcagtgacgtgctcgcgaccgtgctctactgcatagccgtctcactgctgtcatcactgctgaatgcggcgatactcgtggtgatgttgaatcccgcgctgcgaccgatgttcctcacggctacggttattaccacacctctgagggtgatggcgttcgccgtggtcatgggactgatcggctatatcgcggccttgtccacgaagcgtgacgtgccatcactggccgtgattctgctgctacttgtcgtttcgctatccggcgtgctgaaagtggttcacgctgatatggtgctgccgacgatcggcgggaaaagctttgcgttcggacgggacgatgaggcaggagaatttccggtggccgcatccgcaatcgtcatgacgtgttggctggtggcggtgtttactgcggcggtgatggtgcgtagccggcttttcctgaaatcgaaagtatgagaggggcgtgatgtgacgagcatggttaaagccctgatatacaaggacgcgacaacacgaatcctgcgggtcgtttgtctgctggctatgtgctgggtgtctctcgtgtacacggtcgctctgatgccgattagtttggacgcttccggaaccaacccgctgaccgtcgaaagcagcacgacacttgcctcgcaagcgctcgtgatcatcgccgctgctctggccattatcgaaatcaattcgggcgaaacggcgatagcggctctcctcgtcggttcccggcggcgaatggcgttttccctgatgacagcgaaagtcgtgagtatcgtcgttgtcgggttgatgctgaccatggtgaacgccattggaaacttcatcgcctacggacacggcgtcagcggccgtctgatgatccggtacatgatgctggtagtgatgaacggcgttgcggtactgtcgctttctttgcttgccgggaatgtgctgctcggactatccatctacttcctggtgcccatactgcttaagccgttcatcgtctatttggtgccggctgtcagtgacttgttctattcgtcggcgattcgctcgctggctgatggtgcgttgcctttgcagaattcattagtgtcgctcgtgtggttgctggttttcctgctcgcgggatatttatcaatagtcgtgcgaatccttgaatggtgagagtcgcggacgttgtagattgcgggatgagtgcgggatgcaacgtgaatttcagcgtttttcgtctatcatcccgcagcatttcttacgagtgattatggctcaacatggaaaatggcgtaatcccgcgattttaataattaatgatgtgggatgctacgtgcgtcaaacgattgatctcgatggcatcccgcagtactgcgggacgtcacgcaaaaaatggccagatctgtgtgtcatcccgcaaatgtgaagatatatttgagtacatgcatgccgtaggaatttcgggcacaagctgattgactagaagaagcgaatcatatccgtgaacaaggggagaagctcaattgaatttgaaaacagaactgcagacggaacgacttctgttacgcccgtggaaaatcgatgatgttgccgacgcgaaggcgctgttcaagtatgcaagcaatccgcacatcgggccggccgctgcatggccggtgcatgccagtgtcgaggacagtgcgcgggtaatccgtaatgtgctgagcactcccgaaacatatgcggtcgtcctgaaggagacgggggagccaatcggcagtatcggattggcgccgttgtcggacgcagtcgaccccgagcgtcgcgagccggagtcgacgcgcgagatcggctattggatcggcgaaccgtattggggccaaggactgattcccgaagctgggcgggaaatactgcatcacgggttcgaggacctgcaactgaccgcaatctggggcgtgcatgacgtcaacaaccacaaatcctcccgcgtgatggacaaactcggactagcacccgtgcgcaccgcccgccatgtgcatctcaaactgctcggcgacgtatatcgcgacgaactcgtacgccgcatcaccgcagacgaatggctaaccagataaagttcgcgcccgttggccgagcagtagtagtatggtctgctgtatcaacaggaggagtgcgaccgatgcggctgatcgagacatggctggcggatccagaacgtgcatttgacttgttcgcgaaattcccggcggaagagacgggattcgagaacccggcggttggcatggaccgtgaacaattcgccgcatacgtgcgagggttgcgtgatgagtcgcttggcgtcggcctgccggacggctgggtgccagccaccaaatacattctcgtcaacgatgagggcgactatgtgggcatcttcaacctgcgtcaccggctcaccgacttcctgcgcaacggtccgggccacatcggctacggtatcgcccgcgaataccgcggccacggctacgcgaccgccgggctcaagctcacgctcgccaaggcccgcgagctcggcatcgaggaggcttacctgagtgtccacaaaaccaatccggcaagtcttgcggtgcagcagcattgcggcgcacgtatcgaccatgaggacaagacggaatactacacacgcatcgccacctgcatggagagcgatggcctctatgcgcgaggcgattgacggcgcctcttgcgtgtaaatggccgattatcaatcggttttaatcgatttcgcctcggtcgatagagtcgccgtcgaggaaccaataatcgtgcggatttccgcgtaacgccatgaacggcgtgagttccacgccctgtgtctcagctctgctcagcagataggcgcggataatccacggatactccagcacgcccgacttgagggtgatgatttgctccactctgctgccgctgacgccaaaatccttgccgccgttcggcggtcagacccagccggctcatgttctcctgaaattcgcggatagtcgccgcgcgttgctcactgttcaaagacatggcttcatggtagcgccggacgcgtgtgggaggtcgggctgctcactggaatacgccgtcagagtagttgatcatttcgagttccgggcccatgtcttcggtttgagtcaggccggtctcatggaagccgatgtgacggtagaaaccttgggcgttggtgttgaatccggcgacccacaaggcgagccgatcgttgccgatggcgcgttggcctgcctcaaccaaagcacggccaacaccatgacgatggcaagattccagcacatatagcgaagccagttccgcagcctcggaccgtttgattggcgaacgtggcgtttgcagaagctcagcaaaaccaatcacgtggttgttctccaaagcgaccaatacgacctgattggggtctttggcgtgactgcgcgtcagtttgagcgcgaattcgggagtgatcgcatccacgattccctgcggaatatgcccctgattgagttcgcgccacgtgcacgactgaacttgggccttttcctcaaaccatggcggctcaatcggaacaatacgaatcgtcatgccgcccatagtaggccggttcgtgagtacagtgtcacttgttgtcatgtgattgcttggcatcaggttgtattgaccgtaatggaggccactggatcagcgccggaaactcatggaattcgggctattatgatgggagtaagaaaagcacagcacaattgaacataaagacgatctggagcattgcatgagcgtcaatacggcatttgaaaccagtgatttgcccaaagcggagtttatgtttcctgggcctgaacgcgatcgcttggtgaagctcattctggacggcgtaaaaaccgccaccgctgcgctgatgattgaatatgaggaagaggtcgaaccgctgccgtgcgttggcgcgcattcggtgttggtggattccgatgaacgacccgtagccgtactcgtcaccactgcggttgacgtgattccgctcggaaaagtcactgaccggtacgccatcgatgagggtgaaggcgacgtcacggcggcccaatggcggagcgcacacgaatctttctggaattcggcggaataccgcgatgaattcgccaacccaatctttccgttgaacgacaactcgctcatagtattcgagcatttcgaagtcgagcaacggttggagtcgaataacgcattaggttaggcgatagcaaaacttttcttcaggcaactctccgagctccgcaacatctgaaggaatgcccatgtccactagagcgacagaagcggaaagcgtattgaaggagcatatgggatatcttccggtatcggaaatggagcgtcgaggagtttcccgcacggagatttcgcgattcgtgcgtgaagccaagcttgagaaagcggcaaagggcttatatgtttcaccgaatgcggagtccgatccgctgttcgaattgcagtatcgatatccgaaagccattttttcgcatgaaactgcgttgttcttgcttggagagggggcgagccccccctgacaccgacgattaccttaccgcaatcatcaggtacggctcgtctcaagaatgaagacgtaacagtgagaaaggtggccgacaatcgctttacaattggcctggcgtcggctatcactatgttcgggcatacggttcgcgtttatgatttggaacgaaccatttgcgatttgttccgctcccgcagcacagtggatccgcaagatttgcaatccgccttccagaattacatgagatccgcgcacactgacttggtcaaactcatgaactacgctcgcgaatttcggctcgtgaacgtgatgcgcccttacctcgaagcggtgatgccggcatggttcaccggcgaattcatcttgtaggcagattcagcatcttgtaggtagctggccttggcgagaggtcattgcaatggcggtattccgatcatcgccattggaatcatctgcctacaagagcacgaaacaccctacaagatgagacgggccagttgggtcagtcccattcatcctgccggttcgcaggccgcaattgtcagtcacaactggtgcatcttcctcatccatgcgaatgatacgaatcgcctttcatcccaatgatttcgctctcatggccgatacccgcatgccgtcatgttccgtaccttggaatcagaagtcgagagtcatggtccgaaaccgaacggagcgggccgaagcagggagcattgaagatgggatttcttaagaacttttccgaaccgtttgcgttcgcgctggcattgtggccgtttgtgtccatgctgctgacggtgccggtgctggcgctgctgtatcaccgcgacaatcgcatccgactgtcgtcggccatagtggcgtatggcacggtgctgtatctgctcggcctgctgtgcttcacactgtatccgatgccggccgatgcggcggcctattgcgccgcgcaccatctgacaccgcagatcaacccactgcagttcatcggtgacatccgtaccgatggtctcaccgccgtactgcaaatcgcgtttaatatcgtgttcttcctgccgttgggcttcatcatgggccgtatctggcgttggccgctgccggttaccgcagtactgtcgttcgccacgtcgctgtttctggagacgatgcagctgaccggcctcatgggcgtgttcccgtgcgcctaccgtctgttcgacgtggacgatctcctgtggaacacgaccggcgcgctgatcgggttcgcgctggccatgttctcgctgcgcctgattccggcgcgggtcgccgatacgacgccgaccaccacacccggcttcatgaggcggctgatcacgttcatcatcgacatgacgctgatcgggttcgccgtgatgccgacgcatctgttcgtcatgatcgtccaatcgaacctgccctcgggctccaacggctcatggcagtcgatggaaccgttcgactggaccggctcgatcctcttcctggcggcgctcatcctcttcgagggcgtggtgccatggttgcgcggcggctgtacgctcggcggcagcttcacgcatatgacagtggaaacccggccgcgagaaggctggcggcgtgcggcgttctatgtggcgcgcatggcgacgctgatcgccgtggtgtggtggcatagcggcggattcaatctgctggtgttcatcggcctcggcatcttctggatggtcaagcatcagatgccgtacgacctgatataagacgtaattcgccgaaaaagtggggctcttggctttcaaggggctgatttcgtccggtggggacatctacttggctttcgaggggctgctcaaacgccaaaccgcaagtataaacggctttgtggcaacgacataacgccatttcagagccttgtctacttgggcatcagccccttgaaacggggatagacctccggcgaacgccgaatcagcccctcgaaaccgagttaggcgctcttttcgtgtttgagctgccgttcgagggcgtaataggccgcataacagcaggcgacgaacggaatcatgcaatcagggtcgaacgttgcgtctcatcgagcaccacgagcaccagcgcgccgatgcacatcacgatggccagccacggcagcaccgggaaaccgggcgcacggtagtcgagctcatcggcgctgtgcccgtccctcgcccattcacgccggaaacggatatggcacacgcacacggagaaccacaccaccagcgtcgccaaaccggatactgcgaccaacaccaaattacacggtcgaggcggcgagcacggaagacagcagcgccagcagcgaacccgccatgctgaacagcacggcccacaccggcacaccacggaaattcgtcttggcgaatcgcgcgggaatcagccgctccttggccagcgaccataccatgcgcgaacaccaccacaatgaacacggccgaccacacccaggacggcgaatgaggaaaccatcgctgcatcagcagcccggccgccgtgaactccgatgcgagcgccaccgcccagttcagccaatacaggatagcaatggtgaacgcggtgccggggccgatgaaccgcttcgcatacatgtggaagctgccggcatacggcatggccacggacagttcgcccagcgagaccatcacacagtagacgagcagggagccgaccgcgtaagcgaggatcgcgcccaacggccccgcctgatgaatcgtatagccggagctgacgaacaggccggtaccgattacgccgcccagggagatcatcgtcaggtggcgcgactccattttccgttcgaggccggtatcgtccttgggtgtgccggctgccgccatgctcgggtctcctttggtcgggtgaacagttgtgtctcgtgtcggttgtgcgggcggcgctcgatgcctcctaccatatgatagcggtaacacgaacagcgagtggaacacgaggaatttggaatgacggaactgtatatcggatcgcatctgtcgacggccggcggatggaatgcgctgctggaacgctcccatgaggagggcggcaccgcgttcgcgttcttcccgcgatctccgtatggcaaacgttccaaggcgctcgacccggccggtgcggcggcgttcggtgcgcgtctgaaggctgagggctatgggccgttggtcgtccacgcgccgtacgtctacaatctggccggcaaggatgaggccaagcgcgcattcgcgatcgaggcgttggccgaggacatcgagctgctgaccgccatccgcgcggccggccaggaggtatatatcaacattcatcccggcgcgcatgtgggccaaggcgccgagaccggctgccggctgattagcgaggggctgaatcaggtgttcgagcgtgcggatggcgtcatggtgcttctggagaccatggccggcaaaggcacggaatgtggccgcaatttcgatgagctcgccacgatcatggatggcgtggagaataaggcgaacgtcggcgtcacgttcgacacctgccatgtgttggatgctggctacgatttggagaacgactacgacggcgtgatgcgccagttggatgaggtgatcggcttggccagggtcaaggcgattcatgtgaacgattcgcagttcggcctcggctcgcataaggaccgtcacgccaacatcggcgaagggcagctcggcatcccgttcttcacgcgactggtcaacgatccgaccatggccaagctcccgatgattctcgaaaccaaggagcagacgccgaccacgcaccgcgacgaaatcgcgctgctgcgcgggctggtggactgaatcacatcggcagttcagcaccaccaccggcagcaacggcacctactggtccacctaccaacggtgacatcgttgtcatgcgaacttcatataccacaattccacaatatgatttcatagttatgacactgtgatacatatatagcaaacaatgattcagtgacgatctctcgtcaaagatgttccgtcaaaacaggcgcatgggctcggtcgaatccaacggctgaatcaggcgtttgccgtcgccctgcagcggggcgacctcgtgaaattgcaagcggcgggataacgcagtgcctgagttccgcacgccggcgagcaaggatgcgccgtcgattgtgcggtccagccacggcgtcccattccaagtcgagcgcgaaacgtctgtacatgcgtgccagtttatgccaatgttctgcctaagccggaatcgcctgcgaaagcccaaaatgtaggacgggttcggcaatcgggacaggacgtgacctagagtggcgcatgaccgaacaccaacaaagggaggaccatgtcggttttggacgaactggtggcgggagcgctggaggatcagcgcacccgtgagctcaccgtatcgcttgaggatgtgaagaaggccacgctggcggccccggctccgattgacgcgacacgatggcttaagcgcgccgacggcatccccgtgatcgccgagatcaagcgcgcgtctccgtccaagggccacctgtccgacatcccggacccggccgcgctggcccgcgagtacgagaagggcggcgcaagcgccatctccgtgctcaccgaaggccgcaaattcctcggcagccttgacgatttcgacaaggtccgcgccgccgtgcacattccagtgctgcgcaaggacttcatcgtcaccgactaccagatcttcgaggcccgcgcccacggcgccgacctggtgctgctcatcgtcgccgcattggacgacgcccagctcaagcacctgctcgacctggcgcacgagctcggcatgaccgtgctggtggagacgcacacccgcgaagagatcgaacgcgcccgcaaggccggtgccaaggtgatcggcatcaacgcgcgcaacctgaagaacctcaaggtggacgtgaacaaatacaacgaactcgcggccgatctgcccgatgacgtcatcaaggtggcggaatccggcgtattcggcgcggtcgaggtcgaagactacgcccgcgcgggagcggacgcggtactggtcggcgagggcgtggccaccgccgacaatcatgaacttgcagtggaacgactagtaaaggcaggagcacaagtgaaagcatccgaaacgaccccgctcagcgaacatcagggaccgtattggggccagttcggtggccgctatgtgcccgaggccctcatcaccgccctcgacgagcttgagcgcgtgtacacgcaagccaaggccgaccccgaattccacaaggaattcatgacgctccagcagcgttacgtgggccgcccgagcccgctgaccgaagccccgcgcttctccgcacttgtcaaagagaagaccggtctcgacgcccgtatcttcctcaagcgtgaggacttgaaccacaccggcgcgcacaagatcaacaacgcgctcggccaggccctgctcgtcaagcgcatgggcaagacccgcgtgatcgccgagaccggcgccggccagcacggcgtggccaccgccaccgtgtgcgccatgctcggcctcaagtgccgcatctacatgggccagatcgacgcccgccgtcaggccctcaacgtggcccgcatgcgtatgctcggcgccgaagtggtcgaggtgacccttggcgacaagatcctgaaggacgccatcaacgaagccctgcgcgactgggtcaccaacgtcaaggacacgcactacctgctcggcaccgtcgcgggcccgcacccgttcccggccatggtgcgcgacttccagaagatcatcggcgaggaagccaagcagcagctccaggactggtacggcatcgaccatccggacgcgatctgcgcctgcgtgggcggcggctccaacgccatcggcgtgatgaacgccttcctggacgacgagcgcgtgaacctctacggctacgaagccggcggcaacggccccgaatccggcaagcacgccatccgcttcgcccccggcaccggccagctcggcatgttccagggcgccaagagctacctgctggaaaccgacgaaggccagacgctcgacacctactcgatctccgcaggcctcgactacgcttccgtgggccccgagcacgcatggctcaaggacatcggccgcgtgaactacagctgggccaccgacgaggaggccatgaacgccttccgtgacctgagtcagaccgagggcatcatccccgccatcgaaagctcgcacgccgtggccggcgcgtacaaagccgccgccgatctgaaggccaagggctatgacaaggccgtgatgatcgtgaacatctccggccgaggcgacaaggacatggccaccgccggcaagtggttcggctacctgaccgacgaccaggccgccgcgctcgatgtgaccggcgcccacggcaatactgtcgcctgaaccagaagaggagatttttgattatgaccaacgaagcaaccacgccgtccggccagccgctgggcatcagccacaagcccagcaagtcgggcgctatgttcaccaagttcaaggccgagaacaagcccgccttcatcggctacctgccctacggcttccctaacccggacgtctcgcttgacgccttcaagacgatggtcgagcacggcgtcgacgccgtggaaatcggcctgccgtactccgacccggtcatggacggcccggtcatccaggctgccgcctccatcgccctgaacaacggcgagaccatcaagcgcgtgttcgaggccgtcgaaaccgtggccaacgccggcggcgtgccgctcatcatgagctactggaacctcgtgtaccactacggcgtcgagcgtttcgcccgcgacttcgagaacgccggcggcgccggtctcatcaccccggaccttatcccggacgaggcgggggagtggatcgaagcctccgaccgtcacggactcgaccgcatcttcctggtctccccggactcgtccaccgagcgcctcgaaaccgtggcccgcaacgcacgtggcttcgtgtatgcggccgcccgcatgggcgtcaccggcgaacgcgccaccatcgacgcctcgcccgaactcctcgtggaacgtacccgtcaggccggtgccgagaacgtgtgcgtgggcatcggcgtgtccaccgccgaacagggcgccaaggtcggctcctacgcggacggcgtcatcgtcggctccgcgctcgtgcacaccctgctcgcggacgacaacaagaccgcacgcgacccgaaggaaggcttgaagctgctcgccgccaagagcgaggaactggccgaaggcatccacaacgcccggtaaacacccggtgcgcctcacgcgggttgtgccgtgacacggtagggtagtcacagagcgtcaagcacaacccgcgcgtggacacacaccatgagcaccagcaagtagaggcacgatgaatctggcttatattccctcgccgaccttctccaagttcgagatcggcccgttcactatccacatgtacgcgatctgcatcctgatcggcatctgcgtggccgtatggatcctcgccacacgttggaagcggtacggcggcaccttcgaccagattctcgataccacgctcgtcaccgtgccctgcgcactggtgggcgcgcgcctttaccactgcatcaccacgccggccgactacttcccgcccaccggcaacttggtcaacatcctcaaggtgtgggaaggcggcatggccatcttcggcggcatctccgtcggcaccttggtggcgttcctgtggtgccgtcacaagcactatccgttcgcgatcttcgccgatgccatcgcccccgcgctgcccgtggcccaggccatcggccgactcggcaactggttcaaccaggagctctacggctggcccaccacgttgccgtggggcctgaagctcaacgacgcggacgccatcggcaaatccgaaatctgctattccggcgcgcaatgcccggactacaggaccacgctgttccacccgacgttcctgtacgagatgatctggaacctcattggcgccgcgctcatcatctacctcggccacaagcttgccgaccggctcaaggccggccagcagttcgccatgtacctgatgtggtacggcctgggccgcacctggatcgagaacgtgcgcatcaactattccacggtgatcctgggcctgaggaccaacgtgtggaccgcgatcatcgtcttcgtgctcggctgcatcctgttcgtcgtgctctaccagtacggtccggaccccaaggcgcaggcgcgcgggcttgcggcggtcaccgccgacgagctcgaacgccagagcatcgaagaggaacaacttcgccagaaaaagcaaaccaatcgcactaagtgacaccacgataaacagcgccgaaacagcgcgaaacacggggctccaagtcccattgcacagataaggtaggaaaccatgagcaatatcgcaatcgcacccagcatcctgtccgctgacttctgcaacctcgaacgtgatctcaaggccatcgccaacgccgacctggtccacgtcgatgtcatggaccatcatttcgtgccgaacctgaccctgggcgagccgatcgtcggccgcatctgtcaggtcaccgatctgccggtcgacgtgcacctcatgatcgaggacccggaccgttgggctcccgaatacgccaagctcggcgccgcctccatctccttccacatgggtgccacccacgcccccgtgcgtctggcccgacagctgcgcgagatgggctgcaaggcctgcttcgccgtgcgtccggccgaaccggtcgagccgatcttcgatatcctcgacgagttcgacatggtcctcatcatgaccgttgagcccggcttcggcggccagaagttcctcgacaaccagatggccaaggtccgccgcctgcgcgatgagatcacccgccgtggcttgaagacccgcatccaggtcgatggcggcgtgagccccaagaccgcgcacatcgtggccgaagccggcgccgacgtgctcgttgccggttccgccgtgtacggcgccgagaatcccgcccaagccatcgacgacatccgcaccaaggccgaggccgcgttcaaggcctgagctccaagcctgaaccgcaatccacctttcatccataaccgcaagaaaagaatctgaatcacatgaagacgtttgaatccctgttcgccgaactgtccgaaaaggcccagacccgccccgaaggctccctgactgtcgacgagctcgacaagggcacccacttcatcggcaagaagatcatcgaagaggccggcgagacctggatggccgccgaatacgagggtgcggaccgcaccgccgaggagatgagccagctgctctaccacgtccaggtcatgatgatcaagcacggcctgacgctcgaagacgtctacaagcacctgtgagaggaacgcaaatgctgagaatcgcagtgcccaacaagggcatgctatccgaacccgcgtggaacatgctggccgaggccggctaccgtctgcgcaccaaccctcgccagctggtcgtgcaagatcccgacaatggcatcgagttgttctacctgcgtccgctcgatatcgccgtatacgtgggccgcggcgccatcgacgtcggcgtcaccggccaggatctactcaagaactccggtaccgccgcgctcgagcacatgccgctcggctttggtgcctcgaccttccgtttcgccgcaccgaacgaatccccgatcaccaccctggaggatgttcagggcaagcgcgtggccaccacattcgataagctcgtacacgactatctggtcgagcacggcatccaggccgagaccatccatctggacggtgcggtcgaatcctccgtgcagctgggcgtggccgacctcatcgccgacgtggtctccaccggtaccaccctgcgcaacgccggcctgcgcgtgtttgccgaaccgctcatgcactccgaagcctgcctgattcgttcgccgcgtctgaacgagcaggactcacgtctggccgtgctgacccgccgtctgcaaggcgtgctcactgcacatcagtatgtgctgatggactatgacattccgatcagcaaggtcgccgccgccgtggccgtgacccccggctttgaaagcccgacgatctccccgctgcacgataaacagtggaacgccgtgcgagtcatggttcccaaggccaaggtcaaccagctgatggatgatttgtacgaagtcggcgcacgcggcatcatcgttaccgctctacaagcctcccgcatgtagactgttagtcgatatgaccaaccagaaagtcaacaccagatacagtccggaagcacgtgacatctatttcaccgtgcccaatttgatcagcgcgctgcgaatcatctcgattcctttcatcagcgtgctgatatccaagcacgagatgattgcggcgctagccctgatcgccatttcctcggcttcagacggacttgacggcatcatcgcgcgcagattcaaccaagtgagcaagatcggtcagattcttgatccgatcgccgaccgactgctcattttctgctcgattctggctctcagcgtcgccggcatcatcccatggtggatgctgattatcgtgggactgagggatctgtggatggcgattcaggtgctatggcttgcccagtacggttatggtccgctgcccgtgcatttcgtgggcaaggccggtaccgcgctgctgatgatttccatcgtcggtctgattttcgccgatttgggcaccagtacgtttttccacttgctctacatcgccgcgctggccgccggcatctggggcatcgccatgtattggctcgccggatatatctataccaagcagggcgtcggattgctacgcaaggaactgggggagaagtatggcgcttgaggccacggccccggtctcattccccgtacccaaggagaatgagccggtacgacgccgcgccgtgttctcccactcagtccgaggcgcggaatcacatcatgcgctttccccggatgacgccgccgccatccgcaccagacgtcgccgtaaaaccaacgacgattcgcttcagctcatcgatgatcttgtcaatcgtccgatggatccgatgttctccgactcacgactggtccatgagcatcgttcgaccttctccatctggtttaatcgcatcgtcgtattcatcatctgcgtcggcgttggctttgcctgcagcctattcgtgcaacagttgcaatccgatccgcgtaagcaggtacggcagactttggccacgcaattggagaatcgcaactcgcaaatagacgaactcaccacggacgtcaataatttgcgctcccaagttgacgaacagtccaagaaaatatccggcagcgtgaaaagcgatacgcttatccaagacgaaatggtcaatggtgccacggtggtcgaaggcgaaggaatcaccatgacgctggccgatccaatcgcggcaagccagtcggatcaatcctcctcgacgagagtcggcacctccacgaacatccgagtcatcaccgatctggatctgcagcaactggtctccctgatgttccaaaacggagccgaagccattgccatcaacggtaataggctcggcgcgcaaacctcgatacgcaaggccggcgggcatattctcatcggcatgaccgcgatacaaagcccctataccattgaagccataggcgataagagcgccttggccgaagcgatggggaagaagaaacttgcaagtctttacgattccttcaaggaagccggtatctacccgcaggtgagcaaatccaattcgattacacttgaggcagcagtcactggcgaagtgaagtacgcggaaaggaatgaataatggcagccgttctgggactaatcatcggcgtcgtcatcggcgtgttcgtcaagccggacattccgatcatcgtgcagccttatctgccgattatggtggtcgctgctcttgacgccctgctgggtgccgcgcgagcctatttcgagcgcagcttctccgaccgcgtgtttgtgatctccttcctcgccaacgtggtgacggcaacactgctcgtgttcctcggcaaccagctcggcgtcggttcgcagctgcagacagccgtcatcgtcgtactcggcatccgcatcttctccaacgtgtccgcgatcagacgcttcatcttccgaggctgacaagggtactgacgtatggcacgtaaagcacaatcagacaacatgctggagaaaatgcgcgaccagcatgcacaagacaaggtcaacgaccggatggaaaccgggtcgtttcccacggtgcgtaagaagccccggaaggatctcaaccgtgccagcaacaaatcacggttactatcctcgattctcatcgctctgatgtgcgcgttgttgggtttcgcctacatgagccagatcaataacactaaatccacgtacgaaacgatggacgagagtgaactggtaaggctgctgaacgagtcgaatatgcaaatctccaatctcgagcagcgtaaaacccagttgaacagccagctcaactcgctgaaatcggcggctaacgagcaggagcaggcgcgtaagatcgccaagcaaaacgaggagaccagcggcttgatctccggcagactcccggcaaagggtcaaggcgtgaccatccgaatcggacgaggcttgacgactaaagtggacgcctcaatcatgttcaaccttatcgaggaacttcgcaatgccggtgccgaggtaatcgccatcaataacgtgcgcgtcatcacctccacctacattcaggacgccgaggaaggtttgatcgtggatggcaccaccatcaagcccacatacacggtgaaggccattggcaatccgcaggaactgtccaacgcagtcgatatcgccggcggtgtgggcgctcagctccaggtgaaatacgggtccaacgtcaatgtacagccttctgacagcatcattatcgacgaagtacgcgaagctacgcaaaaccagtatgcaaagacggtagaataggggattatgaccaacccgattcctagcgcaggcgaaaccaccattatcggcctgcccgcgattaatgtactgcccattaccaccaccggcgatcgaccgctgactcaagaggatctggacaccatcaccagattgtccgagggaacggcattgctgatttccgccaggggagcggtctcaggttctcgttacttgcttgacgaggatgaaatcaccgtcggccgtgatccgcgagctgatattctgctcgacgactccaccgtatcccgtcagcatgccgtgttccgcagggtcaacggtcagttctttgtggttgacgcaggaagtctgaacggcacctacgtgaaccgtcagcgtgttgatcaggcgacgctgaagaacggcgacgaaatcatgatcggtaaattccgcctcgtgttcttcacgaaatctgccattatttcccaatagtccacacccagcacggggttagactgattgcagaaattgcaatcatgtgattacaccagtgtgagtcatatgcgagacacgcatgagttaggggagtgccatgggacagaccgggctgcatcttcatgtttcgcttgaggaccgtcagaatctgaacgctgacgcgattcagggggagttgttctccaacgtcgatactgaggagatcaagcgcggctaccgtggcactgtggcctccaaggtggccggcatcacgtaccgacagctcgattattgggcacgcaagcagattgttgagccgtccatcacgccgtctcatggctccggttcacgacgactatactcgtttaaggatgtggtgattctcgctgtatccaagaagttgcttgatgccggtgtgaatctgcagaacgtaacggcggccatcggattcttgactcaacgcagcaccgatcagctggccaatgtgaccatcatgtgcgatggtcaaaacgtacatgaatgcacaaccagcgaacagatgctcgaactgttgcaaagcggtaaggcagtgttcgccgtgtcggtgggttcgttgtggcaccagattgagacggccttggaacaggaagaatatgttgatcttgaggccaagccgctgacgattgccacgggccgtccgattgatgaactgactgccatgaggatgcgcaagaagctcgaggcacagcgcttgcaacgcgcaaccgcctgatacatgtatggttgttggcgacttgccggctttggtcggcaggtcgctttgttgtatgtgttgcttttgttgcctgccatcttatgtttttatatgttgcggtgattattatgactgattggaggaccgggtgaacgggattgttgtcggattgttgccgggcgttctgtggatggtcgccgtcatctttgctgtgtccatcatcactataacggtcagccgaggtcatctgttcacgccgaaacgccggcgaccgccggtcgatccggtcgactggtcgatggtgaaaacgcatttcatgtcgtttgcggcggcgctgatcccgtttcccgtgttgacgtttacagcggatctgatgaacgctcgcatgctcgcgttctacgaccacgcgcaattgcccggagcaatcatcatattcgcgctggtgctgctggaactcatcgccatgtatctgcaggcacgcaacgcttcggaaaccgaaatggacaagcgtttgggcgttgcttctcaccggaataaggatgatgttgcgaagtagccgattctctgcggcgaggctaatccgcaactagatactactggttcggctaaaatcaccacgtactattagccgataatgtacgttatgtcagattagttatccttgacaaggattcggtcgcctgtatcaactagtccacgcataccaaggccgacagccaaaggagcaccggagcataccaggccaacagccaaaggagcaccggagcgaccaccgcaattgcaagaatcgccgtgcctttcagccaatccttgtcatctcgtttccagtggaatgctcgccaaatgaaccatatcagcatgggaatctcatacagcgacagcaatggcaaaccgatgaaaaccaggtcgaagcccgcggcgcaggctccatcgcatcccatcatgaagaagtcctcgccgttgtgtttcagtgcgtttggaaataacggtttacggcttcttcgatctgctcgggcttctcgaggatctcgtacgcgccgtgttcctccatctcaccggccggagcgtagccccagcggcagccgatggcgtccaaattgcaggcgtgggcgccgtcaatgtcggtgtagcggtcgccgatcatcacggccctgtcccccgctgcagcatcaaaaccgattttgtcgaagcagtaccgaatcacctgatctttgtccagacgggaattgtctttggaagcaccatagatgccgtccaacagttcggtcaggtggaaatggtcgcagataggcatgcactggtattcgggcttgcagctggccagtgccaggtagtaaccgtcggcatgcagtttgagcagctgttcacggatgcctgggaatacgacgttcaccagtcgtccgggcaccttgttgccgggctcgttcggatcgtcgaacacggcacggtctccgtagtagctgcggtagatgtccacggcccgatccagatcttccgcaggcacatgattgcgacgcagagattcaataatcgccggtccgatgaagcgtcgcagttcggcggcgtccggaaccggtcgaccgatctcttcgaaggtcttgatgacggagccgataatgccgccgtcggacttggtaagcgtgccgtcgagatccaacaggaccactttcatcggatgctgtgccattgagattccactcccccttgttcatgtcgactgctttgaatggtcgtcaaacaatgcgacttgttccaacaatgattatgcccagtcgggatgactgggcatcaagttcacgtgttgttcagtaggagatcactcgtagtcaggaatccaaccgtcacggtgcatttgcaggcgcttttcgagcagggtggccagttcctcttcgctacggcgttccagcagcatgtcccagtgggtgcgggtgggtttgctgatttcgtcgccctcacggtcggcgtcgccctcacggtgggccacggaaccacaacggcactcccactcgtccgggatttcggcaccctcggcaaacggcaggatggtgcggtggcccttcgggcatacatacgccacatcgtttcgtgcggcgaaatcgacgttgtcgtcggactccagcgatttcgctccgatgctcatgcccctgaggctacgttctgccatatcggcatcctccttgaaagatctttaaccctactaatttacgcaacagttcggacttggccgctattccaagcttccgacgccggctgacaaactcccatcaaacggcccccgtcagtccacgccggagtaggccaccacgccacgattgacccggtcggccgcttcgtgggcgaggcctgccagccgctctcccccgtcgaacggcagcggctgggcgacagcgatctgctgcagcacgtcagccagtcgtttggcagtgcgcacgaagtcgccgccggtcatgtcggtgccgtacaggcacgatcccagcgaaccgccatccgcccattcatacatgacgtcgagaataccgaagtccggccgctgcatctcgtccagaccgtgatcctcgcacaggatatcgatgtcttcacaaatgcccttgagcttggacgaagcgatggcgatgggcccggagatgccgcccgggtagtgcctcggttcgctgtctcccccgcgtctggcctcgtataccagtgaagagagcacagcggccagtccgttggcgtcgagcttgtcgaacgtgccggcgagcagcgcctcgcacagttccaggtcatgttcactgtagatgcggcgcagcagcgagcctttttcggtcaacgtcatgtcaatgtggccggccgcatcttcatgacgttcgaggtaaccaagcccggtgagaatatcgcagatgcaatcgaactgacgtgccacggacccggtacgggagtcgtagcgatcggtgacgcgctgcagttcgcgggtctcgcgggcccagcggtggccccacttgaggtgttgctggaggtccgggcagttgcggcatggatgctcgtgttccgccttgcgcaaatcgcgaatgcgctggtcaaggttctggaaggcgcgtgaacgctcctgatcggtcaggaacacttcgtgcttcagtttgcggcggccttccttttcgatgtcgctcagctccatacgcagggtcatgaactgtttgaagtcgccgtgttcgcatgcgaacgcctgttcgtatccggccagtgcgttcttcagtgtgttgatctgcgattccagctgccaggccgattcgttggcctcccactgggcaaacgactggtccagggtaacgcgcgcggtctcgtagtcgctggagttgagcaggttcacggccatgttgaacgtgggtcggaagctcgagtgcagcgggtagacacgcttggatgacagcgcggcggccgtggcgggtacaaaaccgtgatggtcgaccacgatggcgtggccgatggtgtcgatgccgcgccgaccggcacgaccggtgagctgcgtgaattcgccgggcgtcaggcccacatgaccggtaccgtcgaacttctcgagtttctctaccaccacgcagcgggccggcatattgatgcccaaggccagtgtttccgtggcgaacaccattttgaccagaccttcttcgaacaatcgttcgactatctggcggaacagggcaatcatgccggcatgatgcgaagcgaagccttcttccaacgcaaagcggaacttggagaactgcagggctttcaggtcttcctgagtgagttgcccctccaccatctcatccacgatgcggcgaatcttggtcacttcctcatcggtggtgagctccagtccagcgttgatacactgttccacggcctggtcacaaccgttgcgcgagaagatgaagtagatgccgggcaacattcccagaaagttaagctcgtccaccacggcccagcggcgcggggtgtggcgttccgctttcggggcatggcccttggcgcctttgccgccgcggcctctgctgaagcccttgcgcttatcggggcgttcctcgccgcgccggcgtgcggccttgcggtccaactggtcgagccggttgatgagttcggcgttgagcttggtggtctgctcgccgttgccgtcgcggcgatagagatccagcacctcaggctcggtgtgttcgtccgcctgcacgatgacgtgctgttccaaaggcacggggcggtgttcgctgatcaccagtttggtgtcgcctcgcaccgaggcaatccagttggagaaatcctccacgttggacacggtagcggacaggccgacgatcttgaccgtcttgggcaggtggatgatgacttcctcccacacgggcccgcggaaccggtcggccagatagtgcacttcgtcgagaatcacgtagcgcagtgcgttcagcgtggtggaacgctcgtagagcatgttgcgcaacacttcggtggtcatgaccacgatgtccgcctcggagttgatcgaggtgtcgccggtgagcaggcctaccttgtccgggccgtacacgtcgaccagatcatggtatttctgattgctcagcgctttgatcggtgtggtatagaaggctttgacgttgcgttcctgggcgagataaatggcaaaatccgctactacggttttgccggcaccggttggggccgcgaccagtacgttgctgccggcttcgagcgcgtcattggcttcggtctggaagtcgtccagttcgaagggcagggattcggcgaatcgcgctgctgcggacgcccgatggcgctggactttttggaatgatgcgtaccgctgcgaagggctcagcgtctgggaatcggcattgcccttatggtgttggtgacgtgccattgctgctttccgttagttgttgaatcgcttccagcgggcccatgcctgggtgtggcgttcgcgcttggcggccttgctgcgaatcacgtccgcatgggcctcggcataacgattctgtgccacgctgagcggctgagtgaacagaggcggctcgctggtgtcggcagaggtgccagactcccccatcgcggccacgcgttcaccgagctggccgccgatgtcggacatgtctttcaaggcacggattccatgaagggctgcatagatgagtccggcaacaatcatggccagcatgaacagggccagaatcagccatatccaccaaggcatgaaaggctccttacttgttctcgctgatgctcagttcgcgttcggcgcgtgccacgatcatggtgcgcaacgtttccggggcgaccgccgtgatatgacgcgcgtgtgcgatgcagaaggccacgaaccaggagtcggaggaaacggtcagatgcaccttttcaccggcaccgcattgttcgacggtagcgcccggcaatgtcttgatgaatgccagatcgcgctgatcggtgatgaacaccgcgtcggtaccgttgtcgaaactccacttgcgcagttcgctcaccggcatgttcgggatgttgatctgcttggtgggcttgaccagttccgccttttcgatacgggccaagcgcagcacctgccagatgcgcggcttgccgttcgccttgtcgatggtcttgtctttggagacgtaggccttcttgtccttaggggcggcggaaccgacatccgtgtagacggcggcataatacacgccttcgtcgatgaaaatcttggcgggggccaccagcttgcgacgggtactaccggtaccgtcggagtactccatgtccaacagcgaatcggtgttgatcgcgcgcttgacgatggagaagcttcggggctccagctcatagccggtcaggctcagccacggggtctggcccgggctgacatggcggcgcaaacgctcatacagggattcggcctgcccacgctgcttgtccggcagtaacggcgaatgcgccaagtagctgaccgaggcggtgagcatgctgaggtattgcggcgaaatgccggcaagacgttcaaggcccaacgaattggtggcggaaacaataccctcggcatccagcagcggccagtcgatatcgaagaactggctgccagccatctcaccatcgtcggaaacggtggtcagggtgttgatgtccttatgaatgatgttgacgaatttcttgagctcgtcgtcgttcttcggtttgccgataaagcgctcggccagctcgctcatcgagaattcctcacccaggtgagcggagaggaacagcatcagacgcaggcgacgatccacctcgctgcccgtttggaaagcggggccgttcttcttgttctgggccttgatcgactcgggatcacccggctcacgaacatcgcgactaatcgacggggaaaccaccgaggcgcttacagggctggcggattcgtcagccagagtgaatcggctggcggcgtgcaggcggcgatgataggcgtccacagcctcctgcgggctgacaatcgtggcacccggatgctccagcacaaacatggccaaatcgtcggaatcggtgtaggccacgttcaggtgttcgccgtccacatcaacggtggcggcaaagcgacgcgaatcgataaccttgaccagcgagtccggaatgggctgcgtgcccaagccaggcgcaatcgaatccaaaccgagaccgggaataggggtctgcggcacacgcggcgtggtgcgcgacgcatgttgggcgagctgggactgatccggctcggaggaaatcgacatcgaacgagccagatagttggcggcggcaagcaccggcatatcttccggctcgaacatcaggcggatgcgcggttcgtcgcccaactgcagacgataggacgcgaagtcctggccttcagacttggacgagtactcaggctgccgtgattcgatggcaatgcccatcgcagcgagcttggcgcgatcacgctggaactgcttggcgaacgcggccttggcggcctgatctgccagctctccatacgagtcggcgtaagccttgacgcgctgcgcaatttggcgggatgtgagccattgcgggaacgcggatgacaacacagccagtacgtccagctcgtgcttgccccatttgtcggaaaaacgccgacgtccgcttgtgccctctgccattagtcctcacgtatagttattgtttcgttataagtgcgtatgagtttccccacactcactctatcttagaggctttttccacagttgagcgccatttcacaaaaataatatcttttttatcgttcgaccgtgttgtaaatcacacccaatcgtccggttcgatgccttgcgggccaacgtattcgccgttcggcacgtagctcggctcacccttatcttcaagtttggcgtcggcgaacatcatgacgtcacgtccgaatgtccagtcgccctgaatggaaaccgagttggctgcggccaaagatggcacggcgtaggggaaccgttcgtcgaaatcgcggatgttcttgtagtatcgcggatcaagttcgacgttcgggaagatgtaattgccgtcttccatctcatacgtgtccgtcaggtggaagcgatcggaacgcataatgaacaaatcattggtggttttcaccggaaggaagcgcatacgatccacttggacgcagatggaaccgttgaacagaccgattgcggcacccatggcggtttccagctgaatcacctgttcggagttcgggtccgtgggattcacggtctttttgttacgaatcaccggcaacggcaacacaccatcgcattcggcgagcttgtctttcaaagcgtcgatgcgaatccagatcgagttggtgttgaagtaaggatgcttggcgatgtcttgggccgcttccttatcatccggatggacctggctcatttcacgcaggatcaggcgaccagtggccttgtctcgcacgatatggcctcccttgcgatcggccttggtgcggatagccacttcggccatgaacggggcacctgtgttttcgaagtgctgggccaacgtacgcgaggggcgtgcaccgagattgtcggaattggagatgaacaggtacttgaagccgcgctcctccaatacgtcaagcaggccggactcccagatggtggagaacaggtcgccgtggccgggcgggcaccattccagctccgggttcatggggtagctcaccggttcgccggtggcggccacgagtttgggttcctgatgctggatgatttccatcggcacgtcatgctggctgaacttgcgatgatgcttgagcgccttcatcgtgtccgccgaagtgcggaaagaattcatgaacgtcagcggcagttcgacgttcaggcgggtgcgagcggtaagcacctgaccgatgatgatgtcgatgaagcgcatctgcttggccttgtgcctacgcaccggcaacagcgacttggccttgtccaatcccatggaggtgcccagaccgccattgagcttgaggaatgcggtcttggcgaaggcgtccacggccttgtcgtggttgatggtctcatagacgtcgtggaagctgggcacgtggccaagcggctcgatgtcgtcctcgcgaatccagctggaggcttcttcatggcgccatacgtcatacaaatggtggaactggttgatggcggtttcgctcatgccatgctcgcgcatcttggcggccgaaagctcgaaagtctcatccacttcgggggtgtttacggtttcttcgggggtgtccgaggtaacggcgtcggtgtcgtcagcggcggcgatatccagttgggccttatcgtttatttctgtcaattcgggtccctttcgtcaaatcaataggaaccagtctagcccctgtttggggcaaacgcatacgacgggggtgcggaggcggtgaattgtcggtgataattcattacgaatggcttacaaaggtaagtccgtcgtcatgttgtctcatattgtctgaaaacggaaaaaccccggaagacaaccactcaaaagtggcagaattccggggctaatcggtcgggccggcgggatttgaacccgcgaccccttgacccccagtcaagtgcgctaccaaactgcgctacggcccgatggtgcaaaagcaccgagtagataatttaccagatatttgaaatctggcaaattacgcgcgtgtcacttccgcttcttcttctcgcggatgttcacggagatctgaatcggcgtgccttcgaagccgaattcctcgcgcagggaacgctcgatgtagcggcggtagccgtgctcgaggaagccggtggcgaagatcacgaaacgcggcgggcgcgtggatgcctgcgtggcgaagaggattcgcggctgcttgccaccacgcaacgggtgcgggtgggcggcctgaattttgccgaggaaggcgttgagcttgcctgtaggaatacgctgatcccaggattccaaggccttatccatggctcgcgtcagacggttggtgtgccagccggtcttggcggacagattcacacgctcggcccacatcacacggtcgaattcggtgttccacaggcgttcgagacgctgcttgtcgaactcgtccatcgcatcccacttattgaacacgagcacgatcgcacggcccgcatccacggctgtggacatgaccttcaaatcctgatcggataccggctgcgaagcatcaaacaggatcagcgccaattcacagcgctcgatggcggcctgcgtgcgcagagaggaataatattccgcgcctgtgagcttgtgctggcgtcgcttgatgccggccgtgtcgatgaacagccagtcctcgccatcgatgttgacgatttcgtcgacggggtcgcgcgtagtgccggccaaatcgttgaccacggcacgttcttcgcgcgccagctgattgagcagagacgacttgcccacgttcgggcggcccaccagagccacgcggcgcaggccggaaggcgtgaggtagccggaagtcttctcggcctgcttgagcttgtcgagcgcgacgtccagcaggtcgcccactcccctgccgtgcatggcggaaatcgagtatggttcgccgaggccgagcttccagaattcggcggcaaggtattcgctggcctggtcgtcgatcttgttgacggccagcacgaccggcttgccggcggcacgcagcatcttgacgatgcgctcatcggtggtggtcatgcccacttgaccatcgacaacgaataccacagcatcggccaaggtcacggcaacctgtgcctgtgaggcgatggcggattcaatgccttccacgtcggcttcccagccgcccgtgtccaccagcttaaagtcggtgccggcccattccgcgtcatagctcacacggtctcgcgtaacgcccggcgtgtcttccacaacggcggcacggcggccgaggatacggttgaccagggatgatttgcccacgttcggacggcctacaacagccagcacacccaccggcttggggccggccttgcgcgcgccttccgtgaaaccgcggccggaaatcagatcctcatcgccttcgtccagctcatagccttcgagattggcggcatactgctcgtactcctggttctcgatggcgtcctcgaccagaccgatgagcagatcgagcgtgtgggcgaagtccaaatcggaattgtcgatggtagtaacgccatcggcggcggtcaggaagctggtgaccttggaatcggccttgtcgcgcgcagccacatcctcagcacccacgcccttgacggcttggccggtgcgacgggcctgacggacctcctcacgggcggtcagcagcacgcgcacctcggcgtccggggacaccacggtggtgatatcgcggccctcggccacgatgcccaaacccccggagaaggagtcggccgacgcttcgcgggcgatgtaggcgcgctgggcggcgatgagcacgttgcgcaccgggatgacgttcgacaccttggagacatggctggagacttcggaggaacgaatggcctcggagatgtcctcgtcgtcggcgaatacgcgggggttgtccgggtccacggagatatcgaaatggtcgccggtgaagaactcgcccaccgcttcggtgatgacacgctcatccacggtttcggcgtccagatcgatgccctgcttcaggcaccaccaagcgcaggcacgatacatcgcgcccgtgtcaaggtaggcgtatccgaaatacttggccagcgccttggacgtggacgacttgcccacgccggcggggccgtcgatggcaacgcgaatcacagaccaacctccttggacagcgaacggacttccgtctgggacagcacgcggtaggaaccgggcttcaaatcaccgagcttgatcgggccgatctgggtgcgcaccaagcgcttgaccgggaagccgattgagccgaagatacggcgcacgatgcggttcttgccggagtgcagcacgaccttgaccatcgtgtggtcacgcgaggagtcgatgatcgcgcagtggtcgagcttgatccagccgtcgtcgagctgcacgccggtggtcacgagtcgacggcacacggtgccggagatcttgccttccagcgtagcgacgtaggtcttctcgacctcgtacttggggtgcatgacgtgctgcgagagctcgccgtcgttcgtcatgaggataagaccctcggaatcgtagtcgagacggcccatgtggaagatgcgctcgtacttgtcgcccacgatgtcgcgcagcgtgtagcggcccttcgggtcgtccatggcggagagcaccttgcggggcttgttcagcgccagagtgacgtggttcggattgacgcgtacgcgcgaaccgtctacgcgcacctgctgcttatgagggtcaacgcgagttccgagctcggtgaccagttcaccgtcgacctcgacacggccttcggtgatcatgtcctcgcacttgcggcgggaaccgaatcccgcttgggcaagcagcttctggagtcgaatggaattggaatcgtcttgcgctttcgcagcgcgggaatatgcgtttggcatcgttctcccaacgtggccggacagattctgtcatcgcagagactgtcgatttgtatacatacttcagagttggcggactggaatcccagtcaattccaacctatatatcataccgcaacgtaggactgctgctagactggcaaccgtttgtgcgggttcgcccgttttccaacagatgaaaaggaatgaacaatcatggaagaaaccaagcaacagccgctggctctgcgcgtgtgcgccgaattggccggcagcttcctgctgtgctttgccatttacgccttctccacatggggttcggccgtgtatggcatcaatatcgtgttcttcgcgttggctaccggcttggcatatgccgcagtcaccgccatcttctcccgcgtgtccggtggccagctgaatccggccatcaccgtagcctccgtgctggtttccaagacgaaaatcctggatggcatcctctatgtgatcgctcaggtcatcggtgccatcgccgccggcttcgccgtggtcaagctgctgcccacatccgagcaggtagctgccaaagtgtggctgactccggccgttaacggtttcgaaaacggctccgtgtcttactcgctgctgacccagtatggcattacgttctcgattacgctggcgattgtcgtcgaggtcgttgcctctctgattgtcgttgccaccgccatgtcttctctgggtgatcacggcgagtcctcggaccgtcatgtcattgccatgggtcttgcctatggtctggccaccgccatcagctacccggttaccggtgccggtctcaatcccgcccgttccaccggcatcgcactggccgcgatgaatgagggtcttacgcaaaatccgctgcagcagctgtgggtattctggattagcccggtcttggccgccgctgtggtggcgttggtcatgatcatcgcgcagatgatgaccactcccaaagtgccggctgccgccgatcttccgcagacggatgccgatgcaaacgcggacacgctcgacgatggcgaattcttcgatcaggccgcctcgtctgatggcgattcagcggaaaaagatgttgccgaagagtccaaagaagctgaagtaggtaatcagcaggccgattcccaaggcgatgccgatgaaggagtcgaacgccactgagcgcactttccatgggcttctgtcctgaagaatcaggcgaacaagcccggtgatgatggccgtcacggcaagtatgaccgtggcggccatcgtatatccgaaagcaaccagcagtgtgatgacggcgacgacgccgagtacgcaccattcaaaccatggcttgccctcatgtgcttcggatacatagggatggttgtgcatgttgcgattccttctgtcgaacggttacgtgaccacaatagcaggcgaatagcaaaggtgggattccgcttggacccgttgacgggtcaggcggaatcccacctttgtgcgttttggctgagctgctcccctcagagagtcccgatcagtggaagaagtggcgggtgccggtgaggtacatggtcacgccggccttcttggccgcttcgatgacctcctcatcgcggatggagccgccaggctgcacgatggccttgacgcccgcgtcgataagcacctgggcaccatcggcgaacgggaagaacgcatcggatgccgcgaccgcaccggtggcgcgatcggcaccatcggccagcgtgttggcgcgctcgacggccaaatggcaggagtccacgcggttgacttggcccatgccgatgccaaccgtggcctggtcgtgggccagcaggatggcgttggacttcacgcagcggattgcacgccatgcgaacacgaggtccttcagcgtgtcagcgtcggcggcctcgccggccacgagcttccaggcgtccggatcgtcgccgacggcgttgatcagatcagtgtcctgcacaagcaggccgccatcgatctggcggatggcctcgtgacccttcggcggctcggccacctcgaggatgcgcaggttcttcttcttggtctgcagcagttcgagcgcggccggctcatagtcgggggcgacgatgacttcggtgaaaatcgggcgcacgctttcggccatctcaagggtgaccttggagttgcaggcgatcacaccgccgtaggcgctcatcgggtcgcaggcgtgagccttcttgtgggcctcggccgcggtcgcgccgatggccagaccgcacggattgttgtgcttgactacggccacggcaatggcgggagccatatcccatacggtgcgccaggcggcgtccgcgtccacgtagttgttgtagctcatcggcttgccgccgagctgctcggcgtgggcgaaaccggtctggttgagcgggtcgatgtagagggcggcctgctggtgggagttctcgccgtagcgcagggtgtgcgcacgatcccaggtgcgggtgaactgggccgggaacttggcggaatcgacttcagtgccctgatcgtccttgtccacctcgacggcgtccagagaggccggcttgggccagtgcttggcggtccactcgttgatggtggcgtcataggcggcggtgtgcgcgaaggccttggcggcaagccacttgcgctcgtccaaggagaagccggtgccgtcggccacgcgggaggcgaccagtgcataatcggccgggtcggtgacgatggccacggtggcgtggttcttggccgcgccgcgcaccatggagggaccgccgatgtcgatcttctcgatggtatcggcctcgttggcgccggagcgcacggtgtcggcgaacgggtacaggttgacgaccaccaggtcgaacggcttgatgccgaactcctcgagctgcttggcgtgttcggggttggtcatatcagccagaatgccggcgtgaatgtacgggtgcagcgtcttgacgcggccgtcgaggcattcggggaatccggtgacatcggacacctcggttaccttgacgcccagttcggcaagcttcttggcggtcgaaccagtggaaacaacttcggtgccggccttcacgaacgcttccgcgagtacttcgatgccttccttatgaaagaccgagaccagtgctcgacgtatcggtcggttcgtgtttgtcatcctgttcctccttggattcttgtggttgtgacgctaggaaccgcgcctgatgaacggtggcggtcttcgatgtcgcggcggtggtgcgggaatccttgattctctcaaccaaccagactatcggaaaaacgagcgctatgccaatcagcgcgagcagccatgccgcggtaagtcccagtgcggtcgaatgaccgacgactctggtggaggccatgacgtcgacgcctatgtgagcaagacgatgatcgccaagcgatccattggacagagcgaacagcaatgtggatgccagtgagatcagcatcgcgctcaggcagaatgccccggcggagtagatcagcgaaaccagtaccgggccgcgggtggacgtattccgtacattcaacggtctgcaggcgaatccttgcggtaggaatacagccagcaggcccacgagcgcagcgatggcgagaggcgcgttcaaggcaacggtacgccatagttcactgctgaccggttcgggcagaataccgaataccggaattgcaggaagctctttggattggccgagccataatgtgaaactggccaaatcaccgatggcgaatccgccgccgaagagccaggaaacagcccagagcatgacgttgggtagccagatcagcatggcgacggtggtgagaattcgtgaaccggtttccatcccggacaattcgaacaacgatacgacagcggcatggttgcgtaccgaccatacgatgacggtaatcaatccaattgccagatatatgctcagtatcgcgacggccaaggcgacgccgattttcaggcagtggcgtatgtccgccggcacctgcttgcgagtccagtccctgaatgctcgcattttggctgattccggtacggctgcgcataggaaaccgatcgagaatacgatggctgctttcagcaacaccagccactggtcatcgacaagacctaggtgcacggattgccggaatgcctcgttcaacccgagccaaacaatcaatccggcaacatacgcatgcggcccgtatgctttgattcgcatgatgagtgcattgatcagccatatcagcagtatggtcaacagcaatggcgtaatggtgagggtgaacgaatcggttctaaagcccgatccctcactcagaagcacaacggcctgtgtcagcgaggttgtgccgacggtgagattgtcgccgccctcttccatagagacgaccaataacatcagcgctgtatagcagcctaatgcaacggcatagatggccatggatgcgagggcgactatggctccccgcacccattggcgaatcacggctttcatcacgattggttggaaccgatcagtcgatgttggccttggcgagtacgtcacgcatgatttcggcggcctggcccggggtcttgcccacggggatgcccgccgcctcgagcgcgttcttcttgtcctgggcggtgcccttgcctccggagacgatggcgccggcgtggcccatctgcttgccttcgggggcggtgaaaccggcgatgtaggcgacaaccggcttggtcatgtgctccttggcccatgcggcggcgtcctgttcggcgaagccgccgatttcgccgatcatcatgacagccttggtgtcggggtcggcttcgaatgcctgcagggcttccagcagcgtcgtgccgacgatcgggtcgccgccggcgccgagacatgcggtgaagccgatatcggacaattcgcccatgagctggtaggtgagggtgccggatttggagaccagtccgagcgggccgcggccgacgatgccgtcggggatgatgcccagattgacgccggggttgccgagcgtgatgagaccagggcagttcggtccgatgatgcgcacgcccttcttgagcgccagttcgacgaagtatgcggaatcggccaccggaatgccttcagtgatgaccacgatgagttcgatgccggcttcgacggcttcgaccacggcggacttggcgaacttcggcggcacgaacaccacgctggccttggcgccggtggcttcacgtgcttcgccgcaggtggcgaacacggggatgtccgcgtcggcaccgttcttggcaccggggaaggtgacggatgtgccggccttgcgcgggttcacgccgccgacgatattggtgccggccttgagcatgcgagccgtatgggtcatgccctgatggccggtcatgccctggacgataacgggagcgccgtcttcgatgaacagcatcagcgaacctccttggactgggtcgcctcaccggcgagctgcgcggccttggctgccgcgccttccatggtttcggacacatggatattcgggttattggcggaggcgaggatatgcagaccctcggcggcggcgttgccatcgaagcgcacaacgatcggcttggaaccgccgagcttggcgaccgcttcgaggatgccgttggcgacttccacgcaggaggtgatgcctccatagacattgatgaacacggattcgacctgagggtcggacagtacgatctccaggctttcggccatgacggctgcggaggcgccgccgccgatgtccaggaagttggcgggcttgatgttggtgccctgttcctcgccagcgccggagacggcatccagggaactcatgacgagtcctgcaccgttgccgatcacaccgacctcgccgtgcaggtgcacgtagtgcaggccgtgttcgcgggcgcgctgttcgaaggggtcgggaacgatgggatccacgaaacgcgcccagccgtcatggcggaaggaggcgttgtcatccaaggagatcttggcgtccaaggcgctcagctgcttggtggattcgtcatccgggtcgccgatcttggcgagcggattgatttccacgagcgtggcgtcgttgtctttgaagcagcgccacatcttgagcagaatctgtgcggcctgatcgacgtccgcgtggtagaagccgatgctctgtgccatttcggtggcagcggccaggtcgaagtcaccgagcgcatcgatgtgcaggcgcttgacggcctccggatgttccttggcgatttcctcgacttcggtgccgccgttagcggtggccagcacgtcgaagtcgcgcgaggtgcggtccacggagatggacacgtagtattcgtgcaggatgttcttggcttcggctacaagcacgccggaaaccttgtgcccgtggatggtcatcggcaggatggactcggattcaagaatcgcctcgtcgcggttatgggcgatcttgacgccgccggcctgaccacgatgaccgatcttgacctgcgccttgattacgcagggatagccgattttgtccgccgcttcagcgacttcatgggagttctgggcaaagatggcgtccggggtgggaatgtcctgttcctcgagcagctgacgcgcctggtattcgtaaagatccatcgatccttccctgactatgtaattggtccggcatgtaactgtacacagtacatgccggaccttgaaaactgactgtacgttgggtgagacgaaatctcaggccggcatcgcgatcagcgagctgctgggcttgccgtcgagcttatccagaccgtcgaggccatcgagccgcatcacgaaactgaagcccaccacggtgccaccggccttttcgataaggtcggtggcggctttggcggtgccgcccgtggcgatgaggtcatcgacgatgagcactcgcttccctgcctgtacggcgtcggtttcgatttcgacactggccgtgccgtattcgaggtcataggattcaccgatggtttcaggcggcaacttgccggccttacgcacggcgatgaaacccttgcccaaatgggcggccatggccgggccgaacaggaacccgcgcgattcgagaccggcaatggagtcgaattcgctcggggacaccggcagggcctcttcaagtgctttgagcagaatcttcaagcccttggggtcggcgagcactggcatgaaatcacggaagatgatgccttccttgggaaaccccggtacggaacgcaccaaggacaccagatattcggcgtcctgttgccctaccttgctcaatgcgtcgatggtgatgtccgactgtgccatagtgctcgccccttttatgcctttgcgatgcgatacgcggatggtgctaccgaatcgaacagcttacttcgtcttggtttcgttgtcgtcaccggtctcgtcagcggtgtcttcctcggacacgacggacgcctcgatcggaacctgaccagcctcatcgttagccggagcctcggtgtcttcgtcgggcagcgggttgccgttctcgtcgacctcatcatcggacacataggccgggcgggtgtactcacgggcgatggcgttgaagccgaaacgcagcttggagccttcggagtcgatgacgatctcctcatactgctcgtcgacttcgacgaccttgccgatcacctggccgatggtgatgacctcggtgccgggctgcaggttgcgacggaagtcctgcttctcctgctgttgctgcttggccttcttggactgccaccacatcatgccgccgaacacgacgacgatcacgatgagcataatgtactgttgttccacgaaacaactccttcaaacgagcgacattgacgaaacgctgccgagtgtgcaaacaggagaaagtctagaagagcttgctgacatcatctttgggcgtaattcccaaatgctgccatgccttctcggtagccacgcggcctttgggcgtgcgaatcataaaaccttcgcgcacgagatacggctcgcacacggtttccacggtttccgattcctcgcccaccatggccgccagattgttcaggcccacgggtccaccgttgaagttgcgcacgatggcattgagcacggcgatgtccagccggtcgaggccttcggagtcgatctggtacagggccagcgcctccttgacgtcgtccggccgcaccacgatcaggtcgtggacgatggcccagtcgcgtacacggcgtagcaatcggttggcgatacgcggcgtgccgcgcgaacgcaacgcaagctcatgagcggaacccgtatcaaggtttacgcccagtacgttggccgaacgttcgatgagcttttccaactcctcatgcggatagaagtcgagatgtgcggtgaagccaaagcgtgcgcgcaacgggcttggcagcataccttcgcgcgtggtggcaccgatgacggtgaatcgcggcagggtcaacgggatggagcttgcgcccgggcctttgccgaccatcacatcgacgcggaagtcctccatcgcgatatacagcagctcttcggcggcgcgcggcagacgatggatctcgtcgatgaacagcacttcgccgacgtcgagggagctcagaatcgaagcaagatcaccggcatgttgaaccgcagggccggaagtcacgcgaatcggcacttcaagctcattggcaacgatcatggccaacgtggttttgcccaagccaggagggccggcaagcagaatatggtccggtggcacatcgcgtttgcgggccgcgtccaggaacagttgcagctgggccttgagccgtggctgtccgataaagccttcgagaacatgggggcgcagctcctcgtcgctgaccggctcgttgccgatcggctgggaggagaccatgcgcaacgactcttcgttggcaccggtgttggaggctccgtaatccgttgtctcgctcatcagcggcccctatccatcagcgccaaagccagacgtagcacacgcggcacatcgtcggtggcaagcggcgtgggaatatcgttttcggcgcaagcctcggcaacggcctgttgggcgtcctgctgacgccagccaagtgaaatcagtccttcgacaacctgttccgtaccggtatccaccggagacttggatattgccgcctgagcggaagcaccctcgatctgactcaaatcaatagagcccttaagctcgaggatgattttctgtgcgcccttcttgcccagccccggagccttggccagcgcggtggcgtcgttgtcggcgatggcgtgggccagctgactcggcgtcagtgtggagagtaacgattgggccactttaggtccaatgccggagaccttgatgagttgtaggaaggttttcttggcgtcccgatccaggaatccatgcagggtaatggcatcctgagagaggttcatataggtgaagacgcgggtgtcttgcccggcgtgcagacggctcaggtcggtggcggacatgcgcacttcgtagcccactcccccaacatcaatcaatgcggtatcggtttcgaccgattcaacccgcccggtcagcatgccgatcatacaggtactccttcagggctccaggattcaagactcgaacaactgttcgaaagtatactacatgcctcggtcgtggttgatgcggcggcgcgtggatttctgtgcggcctcagcccactggcgttgcgcggcggtcagatgttgttcgcgttcgccgccctgcaatgcgcctgccgggcgcagcgcatggcaaatggccaaagccaaggcatcggcggcatcggcgggagtcggcattttggtgaggttcaaaatacgtgtcaccatacgctccacctgaatcttctgcgcctgcccgttaccggtgatagccagcttggcttcggtaggcgtatgcaacgccacgggaatattgcgttgcgcggcggcgagcatggcgaggccggcggcctgtgcggtaccgagtacggtgttgcggttggattgtgcgaacactcgttcgatggatacggcatcgggtgcgaagcgatccattttctcggacaggccgttgtagatggccagtagacgcagatcctgggtgatatccggtgaggaccgcaccacgtccacgtgaataaacgaaagccggcggtgctcgccggcttcgatcacgccgaccccgcaacgtgtgagcccggggtcgacgccaaggataatcacgaggattactcctcgtcgagctgggccatcacctcgtcggaagcggtccagttggagtagatgttctgcacatcgtcgaggtcatcgaggttgtcgatgagcttggacaccttgcgggcatcgtcgaggctcaactcgacctcgttcttcggctgcatgacctggtcggcggaatcgtagtcgaagccggcgtcctgcagagccttgcgcacggtgaacaggtcggacggaccggtcacaacggtgaacacctcaccgtcatcggtaacgtcctcggcaccggcttcggcggcggtttcgaacagcttgtcgaagtccacgccctcggacggcaccacgatctggcccttgcgctcgaagttgaaggacacggagccggaggtggccagggagccgttgcccttggtcagggtggaacggacttcggcggccgcacggttgcggttgtcggtaaggcattcgatgatgaggccaacgccggcaggagcgtagccctcgtagacgatgtcttcgtagttggcggcgccgtcttcagcaccggcaccacgcttgacggcacgagcgatgttgtcggccggcatggaggccttcttggccttgtagatggcatcgtacagggacgggttgccgtccgggtcgccgccgccgaggcgggcggcgatttcgatgttcttgatgagcttggcgaagagcttgccgcgcttggcgtcgatggcggccttcttgtgcttggtggtcgcccacttggaatgacctgacataatgctcctagcaattattgaaacggatgatgtcaaacgaaacgattgtaggccgttaatcagacatacccgtaatgtttccgatgattgtcttattgcgcgtaccgataaaaccggttgcgcgggtgccgcacccggtcaggcaagcggcaaatgatactgcggggccagctgttcgaatgcctgggcataggcatctcgctggtcggacagcagaatcggcatggtacgcgtctgggcgacgatgggcatgaagttcgcatcgccattccaacgcggcaccacatgctggtgcaggtgcgcggcgactccggcacccgcgacctcgccctgattgatgccgatgttgtatccgtccggacgggagacggtctccatcaccttcatggcgagggtggtggccttctcgaattcgaacagttcggcatcgtcgagttcggtgatgaatccgacgtgacggtacgggcaaatcatgagatgcccgacattgtatgggtagaggttcatgatggcgaacacgtgcgtgccacgccaggcgatgaggccgtcttcgtcggattttttgggtccgacgcagaacgggcattccttcgtcttgggcttggttgggcgatcctcgctgttgcgcagcacataggtcatgcgctgcggagtccacagtcgttcgaccgtgtcctcctgaggcggaaagtccgccggattatcgacacgcacgtcagtcattttcgcgccctttcttggctcccctcagagaggggagccagtaccattcacatcactcagccacagcagcgttgaagtcgtcggcggagttcacctggacgcgcttcttgatgacggtgagaatctgctcgcgagcagtgtccaccggcacaccgttgagctggctaccgtcgcggaagcggaagctgaccgcgttgttgttcatgtcttcctcaccgacgatgaggatgaacggcaccttggacttggaggcgttgcgaatcttcttgccgaagcgatcgtcggagtagtcgatctcgcaacggaccatctcatcttcaagggacttgacgaagccggccagatgcggggcaaactcgtcggcaaccggcacgccgagcacctgcacgggggccagccacgccgggaaggcacctgcgtagtgctcgagcagcacggcgaagaagcgttcgatggagccgaacagggcgcggtgaatcatcaccgggcgctggtgggtgccgtccttcgcgatgtactcgagctggaagcgctccggcaggttgaagtcgagctggatggtcgagacctgccaggtgcggccgatggcgtcgcgggcctgcacggagatcttcgggccgtagaaggcggcgccgcacggatcgtcgacgagctcgaggttggattccttggcgacctcggcgagcgtgttggtggcctcctcccagatctcgtcggagccgacgtacttgttcgggtccttggtggacagctcgaggtagaagtcggtcaggccaaagtccttgagcaggttcagcacgaaggtgagcaggctggtgagctcgtccttcatctgctcgcgggtgcagtagatgtgggagtcgtcctgggtgaggccgcgcacgcgggtcaggccgtggacctcgccggacttctcgtagcggtacacggtgccgaactcgaagaggcgcagcggcagctcacggtaggagcgctgacgcgacttgaagatgaggttgtgcatcgggcagttcatcggcttgaggtagtagtcggcgcccggcttggtgatgttgccgtccgcgtccttctcctcgtcgaggtgcatgggcgggtacatgccgtccttgtaccagtgcaggtggccggaggtctcgtacaggccgcccttggtgatgtgcggggtctgcacgaagctgtagtggtgcttgcggtgcatctcacgggagtagtcctccatagcgttgatcacggcggcacccttcgggtggaacacggccaggccggggccaatttcatccgggaaggagaacaggtccatctcggcgccgagcttgcggtgatcgcgtttggcggcttcttccaggcgggtctggtaggccttgaggtcttccttggtggcccacgcggtgccgtagacgcgctgcatggtcgggttcttctcggaaccacgccagtaggcggcggcggaacgctcgatcttgaaggccttgatgtagcgggtgttcggcaggtgcgggccgcggcacaggtccttccaaaccacattgccatcacagtctacgttgtcgtagaagctgagctccttttcggagatctcggtggcggcggccgggtcgaggtgtgcttccttgtcttcgatcagttcgatcttaaagggctggtcggcctcttccttcagagcctcttcctcggtcacggaacgacggcggaaggactgggaggacttgatgatgcgctgcatgcgcttctcgatgtccttgaggtcgttcggggtgaagggctggtcgacctggaagtcgtagtagaagccgtccttgatgacggggccgacgccgagcttggcgttcgggtagacttcctgcacggcctgggccatgacgtgggtggccgagtgacgcatgattgcgaggccgtcttcggagtcgagggcgatggggtcgacggtgtcgccatcgttcagcggcgtgtacaggtcacggttctcgccgttgatcttgaccgcgatgatgttcttgtcttccgcgaacagttctacgccggtggtggttgcttccacctccttcgcttcgccgttgacggttatggagatggtagcttgcgccatgatttgtcctttgctatcggggcccacggtactaatgtgcaggcctggactggttaatcaacgtaggacacgataggttgggcgtgcgacaaataccaccagcatctgaaccaatacgaaaaaacctcgccgaagcgaggtttcgttgtggagcggacaacgggactcgaacccgcggtctcaaccttggcaaggttgcgctttaccaactaagctatgtccgcaaaggaatccgccgtgagaagcggaatccagtgggcgatgtaggaatcgaacctacgaccccttcggtgtgaacgaagtgcgctagccgctgcgccaatcgcccgaacctgtgatgaaaaaaccggcaacattctgccggcgattcatcgcgtgggcgatacaagattcgaacttgtgaccccttccgtgtcagggaagtgcgctaccactgcgccaaccgcccgggtcatatttcatcccattgaattgcttcgctggtctgagaggtgggtacgagagtcgaactcgtctatacggctttgcaggccgctgcctaaccgcttggctaacccaccgtaaggtctgtcaactcacggacctagagcggacaacgggactcgaacccgcggtctcaaccttggcaaggttgcgctttaccaactaagctatgtccgcgtgtgtttccttggcgaggtctccctgccgaagcacgagtgtttactatacacacatgcgtgtagttcgtccagctgcggcgtgtcgcctgtaattgcatactctcgcttatggctaaagcgtgcgcttcgggcaatgaactccagttactctagaggtatgagtgaagcagcgaaggacaccggcgcagtattgatcgccgcattcgagggatggaatgatgcctgtcaggcggcgacgaacgcggtgcgccatctggtcaagcgatatgagtcccgcgagattcgtcatattaaatgtgatgatttctatgactatcaggttgcccgtcctatgctgtgccatgtttcgggacgcaccaatcttatctggccgcagaccacgttctacgacatcacgttggacgcaggcaagcatatctatgcgcagatcgcccccgaaccaaactatcggtggaaggaatactgtagccagagtctggccattgccgatgagctggatgtcaatcggatcattacgttaggttcgatgttctccgattgcccgcatacccgtccgttgcccatcgccgtcagcgacggagactgtcaatgcgaaggagaccggtcgtataacggcccggtaggcattcctactgttctggatgtagctgccgcacaacaaggatttgctcattcctcgatgtgggtgtccatcccccaatatttgggcagcgacgaatgctctgccggcactatgcgattgctggatgcgttgggcaagcatatcggcttcaccttcgatacggcagatctgaagcagaaagccgaacagtggaaggcgcaggcatcgatactggttcgttgcaatgaccagcttcacgattacgtggagcatttggagcacgactacgacttgcagcagaaagccgaggcggaggcttccttgggagcgccccaggctgaacaactggtcaaagaagcggaagcgtttctacgccagatgggcaattagcccatatatggtgtgctcccgctggatgaacagccctgtgggctgttcatagcagtgcaccatgtgcacgtcgcacaaaatgtcgggagctggctcgcgtagcgagactgagggtggttctgctggcatattccagtgaccacccccagtcagcttcgctgacggctcccgccagcgggagcaccattatattggagtcgtctatcgacccgtcttatgccgcagccgccacggagggatcgatggccggcagcacgcccacaatcagcagcaaggcgacgaccacagccaaaccgatgcggtagatggcgaaggccttataggagaagttcgatacgaacttcaggaatccgatgatcacgatgtagccgagtacgaagctgatgaccatggctacgagggtcggcccccagccggggaacatcgcatcggttttgtagttcttcacggccttgatggcttcgagcaaacctgagccgaacaccgcggggatggccatcaggaagctcagacgtacagcggcctcacgcgtgtagcccagtgcgcgaccgacggtgatggtgccgccggagcgggacacaccaggaatcagcgccatggactggcccaaaccgaagaggaacgcatcacgatacgtcatatcattcatggttttgttctggcgagccttggcatccaccatccacagcagaatgccgaataccaacagcacggttaccgtaatccacaggttgcgcaacgaggtctcgatgacgttctgcagagtgaagccgaggatgataatcggaatcgagccgacgataatgttccagccgagtgtggcgtaattgtcgccgcggcccatgcgggccttccaatccttgccgttcttgccgaacaggcagctgaaccagtgagtaaggatattgatgatgtcgtgacggaaatacagaatcaccgcaagttcggtgccgatttggatgatggcggtaaacgccgcaccgggatcagagcccagcatcaaatcgccgaaaatacggatatgcgcgctggaggataccgggagatactcggtcagcgcctgaacgatgccgagaatgatcgcttggaaaaaattcatgacccctcgtgatttctaagtatttgatgtgttatgacgatgaacaccctatccaagggggtgtagaacaacactaagaatcggtaacatccacggcttctacaatgaaagtggatatagtacgtaagcgacgaagggagcattatggccacgtatcgcaaaagcagggcattcgcaccggaaggattcttcgaatgcgagggtcgaggactcgaatggttgggagcggctcatgcgcagggcggcccgcgcgtggtgcaggtatacggctggggcaaggattatctggatatcgaacgtgtgggcagcgcgtcccccacgcctcaggcggcacgagcttttggtgcggctctggcccatatgcatgatgtgggtgccgaatatttcgggtctgcgcctgacggatataacggcacatgctatttcggaccattgcaggacccagtgaaaatggataccggcgagtggaccgacccgatcagctatttcgctgatggacgtctgcgcccgatggtcaaccttggtgtgaggcgtggcgagctggataagcgcgatgtcgaactgaccgagcgcgtgattgaagcgttgccggatctgatgggccgagccgcgtccgacaagccggcgcgcatccacggtgatctgtggagcggcaatgtgatgtggaccgccgattccgggcagcccgaggctgtgctcatcgacccggcggcacatggcggtcatcgcgaggaggatctggctatgctgcacctgttcggcatgagctatctgagcgaaatcaccgagggctaccagtccgtgcatccgttgaaggccggatggcaggagcgtatcacgctctggcagctctaccccatcgccggccactgtgtcttcttcggcggcggctacgtcaacgaataccgctccatgtgccgctccatgctgaagtaacagacttggctcccctctctgaggggagccaagaacgcatccactctcagctcagcgcgtccttcaacttgctgaagaaacctttcttttgaccggcctgtggacgggatgcctgggagacgtgcgtggcgcctgaatcgtgcgaggcggcgaactgttcgatgaggccacgctcggtttcgttgagcttggtggggataagcacattgacgtgggcgatgaggttgccgcgctcgtccttgttgcggatgttcgtgacgcccagtcccttaagcgtcaccgtgtcctcagtctggcagccggccgggatggacacggtcttctcaccatcgaacgtatcaatggacagatcgtggccaagcacggcccagctcatcggcacctgaatccagcagtgcaggtcgtcgccatcgcgggtgaactgcttatccgccttgatgcggatgtcgatgtacaggtcgccggcagcgccgccgccctcacccacttcgccctggttggccaaccgcagacgcgcgttgtcgttgatgccggcgggcacggtaacgcccacggtacgcgtggtgcgcacacggccgtggcccatgcagctggggcacgggttctggatgatggtaccgtggccctcgcaacgttcacagggggcggaggtcatcatctggccgagcatggtgcgcacgaccttctgcatgaatccctgtccgtggcagtcggggcaggtgaccggctgtgcgccgccctgggcaccggagccaccgcactcctggcacagggagaacgtattgatcttgacatgcgcggtgccgccgaacaccgccgtcttcaaatcgatggacgccgaggccaaggcatcgcggccgggctgggtacgcggcaccgggccctgtgagccaccgccgaacgcggaaccgaagaacgtggagaacacgtcgctcatatcgccgaagcccgccccggagaagccgccggcaccggcgttcgggttgttcgggtcgactcccgaatcatacatacggcgtttgtccggattggacagcacatcgtaggcgttgttcacttccttgaacttgtcctcgaactcagggcccgcgatgtcggggtggtacttacggctgagcttgcggtatgccttcttgatctcgtcgtcactggcgccgcgttccacacccagcgtctcgtaataatctgccacttgattgatcctttgtgttcgtttggtctgcgggtcattgtgccacagacggcggtcagtcttgagtccggccctcggagaggaaggcggtcaaatatctggctacggccctgacggcggccatagtggccgcgtagtccatgtgggtcggccctatggagccaacgaaggcgatgggttccgtgtcgttcgtctggctctccgtctcggattcggtttcgggttcgcctacgggatcgttccccgccggttcgcccgccgctccgctgcgcccatagccactgctgaccacggaagcatgcagtagtccgggggtgtgcatttcggagccgatggccacgcccacgccggatgcattcgtctcctcgctcaggttgctcatgagcttcatcagcacgacctgttcttccagcgcgtcgaagagcggggccagatcggccagggaccgggagtgggccaggtgcgaggtgccggacatgtacagttcgttcgcgcgttcgtccaatgccatcgattcgaaggcgtcggccagcgcgtcggccacgccgcgcaccgactcgtagccggcgctggcggcgatggatcgcacggtctccgcggatttcgatagggacagtccgacacattgttcgttgacggtgttggagagccggttgatctcgtccacggcgggcatggatgcgatggtcaggccgtgctgggccacgcggccggtgtcagtaatcaccaccgcgagcaacgtggtcatggcaacgggcaccatctccacgtgccgcaatgtggccttggccagcgatggcgaggtgactatggccacttgaccggtgatttcggacaacagtcgtgccgaacgctgcagcgcgtccttgagactcaccgatccggacaggaagctgttgatgccgcggcgctgcgcctcgctgagcggcaccacggtagcaagtcggtccacaaagtatcgatagcccttttcggtgggcacacgaccggccgaagtgtgcggctgaatcagatatccttcatcctccagagcggacatgtcgttacggatggtggccgaactgacgccgagatcatggtcgcgcgtcagcgaagtggagcccacgggctcctgagaacggatgtaatcctccaccacggcgcgcagcaccagcatgcgtcttgattgcgtcatgcgcgcctccttatacatacatacatattcatatcagtcacggttcactcagggcgtaccccgacggtcggttcgccacgccgcgacacgcgggaacccagaaatattgcctctttcttggctccgccacgtgcaggtggcgcacttcaccctagaacattgtattagcactccttaggcttgagtgctaatgcgttcgtttgcagcgtagcaatgttcactgtgaacgctaacagaacacaaactaccaaaacacgccaaaactgcaccacaacgtcgcaaaccgacgctagcatggtaatcgcaatgtgagggcgtcaagcgcccggcacaagccggatacgcggcccgaccaattggaaggaaagtaatccatgaccgaattcaaggagaccgagctcgacgagcgcgccatcaagatggcgaaggtcctttcggctgacgcggttgagaaggcaggctccggccaccccggctcccccatctccctggcgcccgtcgcctacacgctgtaccagcacttcatcaagcacgatccgaatgatcccaactgggaaggccgcgatcgcttcatcctttccggtggccacgcctccctcacccagtacgtccagctgtacttctctggctacggcgtgaccttggacgaccttaagaacttccgtggcggcgctgccacccgcaccccgggccacccggagtacggcctgaccccgggcatcgaaatgaccaccggccctctgggccaaggcttcgcctccgccatcggctttgcctacggcgagcgtttccagcgcggtctgcttgacccggagaccccgaaggaagattccccgttctaccacaagatctgggccatctgcggtgaaggcgacatcgaggagggcatctccggcgaggccgcttccctggccgccaaccagaagctcggcaacctgaccgtgatcttcgacgccaaccgcatccagatcgaaggcgacaccaacctggtgctggccgaggacgtgctcaagcgcttccaggcctacggctggtacaccgacgagttcagcttcatccagcccgacggctcctacaaggaggacatcgagggcctggctgacgtcatcgccaaggccgagaaggccgctccggaccagccgaagctcatcaaggttcactccctgatcgcttggccgaccccgggcaagaccaacgacccgtcctcccacggttccaagctgggtaccgaggctgttgccggcctcaaggaagccctcggctacgatccggaagagaacttccacgttgacgaagaggctctggctcacgctcgcaaggttgccgagcgcggtctcgaagcccacaaggaatgggacgagaagttcgacgcttggcgcaaggccaacccggacaaggctgccctgtacgaccgtctgaaggccggtgaactgccggaaggcttcgacaaggctcttgacgaccttgaggccaccttcgaagtcggcaagggtgtcgccactcgtggcgcctccggctccgtgctcaacgccatcgccgctgtcatgccggaactctggggcggctccgccgacctcggtggctccaacaagaccgatctcaaaggcgctgccaccttcgccccggccgagtgcgccaccaagcagtggccgaactgcaacgagttcggtcgccagctgcacttcggcgtgcgcgagttcaccatgggctgcatcaccaacggcatcctgctgggctcccacacccgtccgttcggcggcaccttcttcatgttctccgactacgagcgttccgccgttcgtctggccgccctcatggagattccgaacctgtacatctggtcccacgactccgtcgccgtcggcgaggatggcccgacccaccagccggttgagcaccttgcttccttccgcgcgattcctcagcttgaggtcattcgcccggccgacgccttcgagaccgccgaggcttaccgttacttcttcgagaagaagaacaccctgcctggtgccatggttctgacccgtcagggtgtcccggttcttgccgagaccgccgccaaggccaaggacggtgtcaagaagggcgcttacgttctggtcgacaccgagggcactccggacgtcatcctcatggcttccggttccgaggtccagtgggctgtggctgccgccaagaccctggccggcgagggcgtcaaggctcgcgtcgtgtccgtgccgtccatggaatggttcgaggagcaggacgccgagtacaaggaggccgtgcttccggccgctgtcaaggctcgtgtctccgtcgaggccggcgttgccatgccgtggtacaagtacctcggttcctacggcaagcctgtctccatcgagcagttcggcctgcagggtgacggcgctcagaacatgatcgacctcggcatcaccgccgagcacgtggtggaagccgccaaggcctccatcgccgaagtcgaagccgccaagtgagcaactaagcaataattcaataattgttggctcccctccctgaggggagctgtcaggcgaaagcttgactgaggggagcaatgcttgagcccactcccctcagtccgcgttgcggacagctcccctctcccaggagaggggagcctagggcttgaatccaaggagaaaataaatgactgaagcaactcagcgtacgtccgacaacggcgtttccatctggctggacgacctgtcccgctcccgcattgagtccggctccctgcaggacctcatcgccaacaagaacgtggtcggcgttaccaccaacccatccatcttccagaaggccctgagccaggtcggcccgtacgacgctcagctcaaggagctcggcaaggttgacgttgagaccgctgtccgcgagctcaccaccaccgacgtgcgcaacgccaccgacatcttccgcgagatcgctgaggctaccgacttcgtcgacggccgcgtctccatcgaggtcgacccgcgtctggcccacgacaccgagaacaccgccaagcaggctgtggaactctgggagaaggtcaaccgtccgaacgccatgatcaagattccggcaaccctcgaaggcctgccggccatcaccgccaccctggccaagggtatctccgtcaacgtcaccctgatcttctcgctcgagcgctacgagcaggtcatcgacgccttcatcgagggcatcgcccaggctgacgccaacggccacgacctgaagcacatcggctccgtcgcttccttcttcgtctcccgcgtggacaccgctgtcgacaagctgctggaagccaacggctccgacgaggccaaggctctggagggcaaggccgctgtggccaacgctcgcctggcttacgagctcttcgagaagaagtttgccgaggatccgcgttgggccgacctggctgccaagggtgccaaggttcagcgtccgctgtgggcctccaccggtaccaagaacgccgcctactccgactgcaagtacgttgacgagctcgttgccaagcacatcgtcaacaccatgccggagaagaccctgaacgctctggccgaccacggcaacggcgctccgtccatcgagggcacctacgaggagtcccacgccgtcatcaacaagctggctgagctgggtatcaacctcaaggacgtcactgacaagctggaggccgacggtgtcgccgccttcatcaagtcctgggattccgtgctggctgacgtccagtccggcatcgaccgcgtgaacgcctgagattattagctgatgcgcatttcgcgcattaactgattagctcacagaagctccgaccccaaccggtcggggcttcttacgtttgttgctacagtagtacgagcacatgagagaacggccgaaccgtaatgaacaaacttgtcgcacgccagcggttggtgatgacctttaccttcttttcgatgttcttcggagcgggcaacctgatcttcccgccgtttgtcggagctcaggccggttccgcgaccataccggcggccatcggcttcatcgtctccgcggtcggcctgccgattctcggcgtgctggcggtcaccttcgccggtggcttcgacaaactcgccggccgggtctcccccaaattcgccctgttcctcggcttggcgatcatgctcaccatcggcccctgctttgcgattccgcgtacggcgaccacctcgttcgaaatgatggtggcgcctttcgtgccgtcctcctacggctggctggcccaactcatctactcgctcgtgttcttcacactggcgttcctgttcgcccagcatcccgaaaaactctccaaagtgctcggccgattcatgggaccgttgctgctggtgctgattgccgtcctgttcatcgcctgcctaatccacggtatcggtaccccggccaaaccgatgggcgactactccacaaaccagattgcacgtggcttcctcgacggctaccagaccatggatctgctcgccgcgctctatttcggcatcgtgatttccgcgaatatccgcacccagcaggtcgatgacgaatcgcaagtgcagaaggagaccgcgtatgccggactcggcaccggtgtgctgctgatcgtgatctacggcgcactgagctacgtgggcgtggtgtccggcgccatcgccaccatcgatcccgccaaagacacgggcgcgaccgtgctcaccaatctcacctcgtccctgttcggcgcgttcggtaccgcgttcctcggtatcgtcttcgtcatcgcctgcctcaacgtatgcaccggactgatcggtacctgcgccacctacttccacactcggttccagaccgttgcagggagaacgttgagctaccgcacctggcaggtcatcttcaccgtgttcagtttcatcgtgtccaacgccgggctaagcgcgatcatcaaggtttccgtgccggtgttgtccgcactgtatccgatcgccatcgtgctggtgctgctggcgctgacccacaagtcgctcggcgcgcgattcccgcatgtctacttctggaccgtgctgctggtgggcatcgactccttcgccagctgcatctccagcctaatcaccgtcttcggcggctccatcggctggctggacacgacgctggccatgctgcccttgcagcaataccagctcggctgggtggtcccggctatcctcggtgttgccattggtatcgccgatgctccgcgacggtagttcttcccggtctgtgccggagtctggcggtcggtcggtgatggcggttgttgcgacgctcagcggtgccggtgtatcgttcgcaccactatatgagcgcatttggggcggcatgatgctgcatccgaactgtccggcgattggcagaatgccctactatctctcgggccaagcaactgacgattatggagtctgcgtcacctcaccactgtggtttatgacggtgactgcgctgagtgttgtcgcgattctctgtctgaccgttgcgggagtacagggcttttcgcgccatcggctctgttcccgttgccctgttctggtcaggtctcacgttctttacctacagctacaacactggtagacacaccgatttctgcccagcgctatcggcaactgacaatgcaggtcttgtcgcttattgcatcggccgtgaagctttgggactgctgaccgtcgtgttgtgcgtgctgccattgttctccctgctttcggcgattatggccatcacgttggctgcgcacgacgcgacaccaccggcataaaatctccttcatatcacgaaacaacgggcacccgttttgcgaggcattctatccgtcccgtgtttcgcaacgcatgagacggcacatccattgaatcaggagtctagaccatatctcgccgaatcttgcggtaggtggcatagaacaggaagccggccacgatgccggaggtggcgtcggagatgggttcggcgatgaagatgccgttgacgccgatccagtgcggcagcagcagcgcgagcggcacgagcaggatgatcttgcggaagatggccaagaacaccgactgtttggcctggcccatgccgacgagtgcgcattgcgcgcccatctggatgccgaagataccccagccgcagacgaaaatcggcatcatgcgggtcacgatgtcgatgacagtctgttccgaggtgaaccatgaggcgaaaaagccggggaatgtggcgagtaccgacaccagcgccgtggcggagacgatctgcgtgacgaaggccatgcggaccgcctggcggacgcgctccatatgccgggcaccgaagttgaacccgatgatcggctggatgccttgctggaagccgctggtcaggacgctcacgatctgcatcagcgaagtgatgatggtgatcgacgtgacgtaatcgtcgccgccgtagcgttgcagccccacgttgaacaccacgttgatcaggcattcggtgatctgcatgatgaagggtgccagaccgagcgccagcacggggatgatgatccgatcgaaccggatgttcaacggccgcaggcgaatcgcgctgcgcccggaggagaggaacagtacgatccatatggtcgagaccagttgggcgagcacgttcgcggcggccgctcccctgacgccccatccgaacacgaaaatgaacacggggtcaagaaggatggatatgccggtgccgatgagtacggagaccatggccacagtggttttgccctgcgccgaaatgaagttgttgagtccgagcgtgagttgcacgaatacggtgccgatcaggtagatggtgatgaagtcgaccgcatattcgatggtcgcatcgctggcgccgaaggcgtagagaatcgaccgtttcgccaactgcagcagcacggtgagggtcagggctatggcgatgaggaacgcggcgctggtgccgaggatgcgttcggctttcttgaagttgccgcgcccaagttcaatggaggcgcgcggcgcgccgcctgcgccgatcagcgaggcgaaggcggtgacggccagcagaatcgggaagcagatgcccacgccggtcatcgccgcgttgcccacttcggggatgtgcccgatgaacagtcggtcgatgatcgtgtacgaggcgttcgccgcctgcgccacgatggtggggaccgacatggtcagggccagacggggcaccggtttggtgcccagcccggcatcgatcgtgttcgcctgtaccaaggatcagctctgccagtagtagctgaagaagtcggagatctcccccatggtttcgcgcagcatgcccatgcgcggcaggtacaccacgcggaagtggtcggggcgatgccagttgaacgcgccgccgtggctgatgaggatgtgcttgtcatgcagcaggtcgagcgcgaactgctcgtccgagtggatgttgaagcgtttgacgtcgatcttcgggaagatgtagaacgcggccttcggcttgacggcggtgatgccggggatctggttgagcatgtcgtagacgaggtcgcgctggtcgtgcacgcggccgcccggcacgatgtagtcgttgacgctctggtggccgccgagcgcggtctgcaccacggactgggcgggcacgttcgaacacatgcgcatgttggcgagcatgttgaggccctcgatgtagtccttggcaatgcgcttgttgccggacagaatcatccagccgatgcggtagccggcgatcatgtgcgatttcgacaggccggagaaggtcacgcagaacaggtccggggccatcgaggcgatggagatgtgctgcaggccgtccatgacgaggcgatcgtagatttcgtcggagaagatgatgagctggtgttcgcgcgcgatgtcgacgatctgctggagcacttcctttgggtaaagtgcgccggtggggttgttcgggttgatgatgacaatcgccttggtgttgctggtgatcttggagcggatgtcgtcgatgtccggataccattcggactgttcgtcgcacaggtagtgcacggcggtgccgccggctaggttcacgcaggcggtccacagcgggtagtccggggatggcacgagcacttcgtcgccggtgtcgagtagcgcggacatggacaggttgatgagctcgctgacgccgttgccggtgtagatgtcgtcgatggtgacgttcgggatgttcttcagctgcgcgtactgcatgatggccttgcgcgcggagaacaggcccttggacggcgagtagccttcggtgtcggtgagctggtgggccatgtcgtagacgacttcgtccggcgtgcggaagccgaagggtgccgggttgccgatgttcaatttcaggatgtgggtgccgttggcctccatgcgcatcgcctcgtcggcgaccgggccgcgcacgtcgtagagcacgttgtcgagcttgtgcgatttgccgaaggtgcggcggcggcccacgggaatctcgctgtccgtctggggcttggaggcacccgtggcaagcggtgtggcggcgtgttcgccgtccgtgacgctgttggaggcgtccgagttcaattgcgtggtggattcctcgccgcgcagccagttcatgtcgacgtccagttcgctggccaggaattcgagcacgtcctcgcggggcatggtcttgccggccacgtattggctgatgtggctcttgcccatctttacaccacgatgttcggcggcgtgcaccaaatcgacctgcttcagtcccctgctgttcatcgcattgcgcagacgttccgcaaacaccgatacgctcatatccttatgcctccaaccgggagttcaatttatcttttgaacaacggttcaaagcatacccccggttcaacacaagttcaattttggcgtgttctcgagtctcgaccggttcagcccaactgcgcttcaatccattgggcgacgccgtcctcgttgttggacgggcagatctcgtcggcgatggacaacaccttggggttcgcgttggccacggccacgccccggccggattcgctcatcatgttgatatcgatgaggtcgtcgccgaaggcggctgtctgttcaagcggcacgtccagtcgctcgcacagcaggtgcagcgcgtgctccttgttggcctgcgggttcatgagcatccacatcacgccttcgctgatggagatgtcgaagtccggcggaatcagcgcacgcagctcgttccactgttcaggctcggggaagatggtgatcttgtccgccacgccttcgggcacgtcgtggaagttcgtgtattggaaggcctgagttttccaatacacgcgcacatcgaagttggtgtagcgcacgtcgttcatcacgatgccgagcttcaggccgggcatgcgatcgagcaggaacagacagacttcgcaggcacgccgtgaggagaagccaatcttgatcaaatggttctcatcggccggcgtggcacctgaggtgagcaggtcgaagtcggagtgggccgggtcgaaatcgatgagggcgccgttcagatagattacggcgtccaccggcagtttttcggcgaactggagaccggtactcaccggccgcgcggtggcgatggcgaattgcattccggcatcgtgcgcgcggttgatggtgtcgatgctgcgctgggtgatgaaccggtcctcgaatacctcggcgtcgtgcagcaacgtgccgtcgaggtcggcgaccagcagtcggggttgtttcggcgtgatggcgtcgagaatcacagcagcccctcgcagtgttcacgcacgagttcggcggaatggtgcagtttggcccgctcgtcctcgctcagatcgagttcgacgatctcgttggcaccattggcgcgcagttcagtggggacgccgaggaacacgtcatgttcgccgtattcgccgtccaacagggtggagacgggcacgatgcggcgttcgtcccacaggatggtctgtacgatgccggccacggtggaggcgatgccgaagttggtgccgcccttggccgcgacgatctcattgccacgggtgcgggtcttctcttcgatttcggtggtggacacagaggcgaaacggtcttggttgtcggccaggaagcgggcgaatggcttgccgccgagcgagacggtggaccatgcggtgaactgggagtcgccgtgctcgcccatcacgaagccgcccacgttgcgcgggtcgaggccggtctcttcgccgatgatggtcttgagacgcgaggtgtcgagcgcggtgccggtaccgagcacctgggtgcgaggcagaccggaacgtttccaggcataccaagccatcacgtcgaccgggttggagaccatgacgatcacgccgtcaaaaccggaggccatgacgttgtcgaccacttcgcccacaagacccacggtgaagccgagttcggccatgcggttggagttggccggcggcttgcggcccacggtgatgacgacgatgtccgcatccttgcagtcggcgtagtcgccggcgcgcaccttgacgtggcggtcctggaattcgctgccatcatcgaggtcgcgggcctcccccagggccttggcggcggaacagtcgatgagcacaagctcattgcacaggccgtgcgtgacgatgccgaaggcggcggtggcaccgacctggccggtgccgacgataacgactttgttgcggttcatagtgaccatggtgatgtcctttcgtaatactcgatagaacgcatacgacccatgaccgacggtaacggtcatgggtcgcgagcgacaagtctatatggcgtgcaagccaatcagccgaggttgaacttggtcatcatgtcgaggccgatgatcaaggccacccacaccagagcgatgataacggtccaacggttcaggttcttttcggcgacaccggaagtaccggcgttctgggtcagaccgccgccgaacatgtcggacaaaccgccgcccttgcccttgtgcataagaatgagcagggtcagcacgaagctgagcagcacgacgatgacttgcagcgtgatcttaagagcggtcacagggtacctccggattgattggactgttgaccagcatagcgcacacacaggaaaaccgtggtattagttccgtgatttcgtggatttcagtgccagtcgagcgattttggcgagttcctcaacgtccagggccgcccccccgatcaggaagccgtcaacgtcgggctgggaaatgagttccgccgcatttttcgaggtgaccgatccgccgtacaggatacgtacgctatcggataccttcgtgccaaaagtggtcttcaaatcgttgcggatggcgtttgcggcatcctgggcggattgcggagtggccaccatgccggtgccaatggcccagacaggttcgtaggccacgatgagtttggcggcttgttcttcgttgagatcgcgggtgacgtctcgtacctggcccacggcgaaatcgagttcaatgccttgacgtcgttcctcgaagctttcgccgacgcacaaaatcggctgcatgccggcggcgagcacggcacgtacctgatcgacgatattggcgtcatcttcaggatggtatttgcggcgttcggagtggccgacgatgacgtatgagcagccgagatgggcgatcatgtccgcggacacatcgccggtgaaggcaccttgggtggtcacggaaacggattgtgcgccgtaggcgacatggagcttgtcggcttcgaccagcacctgcacgctgcgcaatgacgtgaacgaggggaaaagcgagacttcgcagcgtttaaagtcgaagtgagcgtcacgcaacagccataccagcttctgcacgaagtaagtggcttcaagatggtcgaaattcatcttccagttgccggccaccaacggaatgcgtttggacgccatatgtttcccttctaaaaaaacgtagctcccctcaaggaggggagctagaaaatggattactcaagcaccttcaggccagggagctccttgccttcgaggaactcgagggaagcgccaccaccggtggagatgtgggagaagccgtcctccgggaagccgaggttgcgcacggcggaggcggagtcgccgccaccgacgatggtgaacgcaccggctgcggtggcgtcgaccagaccctgggccacggccttggtgccggcggcgaactcaggaacctcgaacacgcccatcgggccgttccacacgacggtcttggagtcgacgatcttgtcgtggaagagcttctgggactccgggccgatgtccagacccatcttgtcggccgggatggcgccggcggcaacgacttccggagcaaccggggtgtcaccggccgggaagccggcgttcacgacgacgtcggtcggcagcacgagctcaacgccgttcttctcggcggtctcgatgtagcccttgaccttctcaagctggtcctcttcaagcagggaggtgccgacctcgtagcccttggccttgaggaaggtgaacaccatgccaccgccgatgaccagacggttggccttgtcgagcaggttctcaatgacaccgagcttgtcggagaccttggaaccgccgagcaccacggtgaacggacgctccgggttctcggtggccttagacagggccttgacttccttctcgaccagcaggcctgcggcggccggcagatcggcggcaacgtcgtagttggagccctgagcgcggtggaccacgccgaagccatcggaaacgaaggcctcgccgagggcggcgatcttcttggcgtaagcggcgcgttcgtcggcgtccttagaggtctcctccgggttgaaacgaacgttctcaagcagcacaacgtcgccatcgttcatggcggcgaccttggcctgagcgtcctcgccgtaggtgtccttggccagcggcacgttggtgccgagcagctcgccgaggcgggcggcaaccggggccaggctcagctcaggaacgaccttgcccttcgggcggccaaggtgggccatgaggatgaccttggcgccttcttcgcgcagggtcttgatggtcggcagagcagccttgattcgaccgtcatcggtgatggtggtgccgtccagcggaacattgaaatcagcgcgaaccagaacgcgcttgcccttgagatctccaaggtccttgagtgtcttcatgaatatcctttccttgacgaatcgcacgtcaaagtggccaattttgccactttgcatattacaggcattccggaacaaaacaccgcattcgtctactgactgaatgcggtgttttgttacatcgttgtcgcgttttgccgaataggcacggcaaatcggattgtcgggttacttgccttcggctgcgcgagccttctccgtcttctcggcaagctgaagcagtcggcgaattcggccggcaatcgcatccttggtgatttgcggttcggcgatcttgccgagctcctcgaggctcttgtccacgtgatcgatgcgcagctggccggcctgacggaggttgtccggaatgttatcgccgagtacttcgaaagcatgctgcactttttcgctggcttcggcggcggccttggcggaacggcgcatattggcgtcatcgaagttggccagacggttggccttgccgcgggcctcgccgtcggagcgcttgccggtccattcgcgggccgaacgggtggcgcccatgagcttgagcatgcgttcgatggcgtcgggatccttgagtgtcacgcgctcggagctacgcagcgtgcgatgcttggcctggatgcctagacgacgggccacgccacacagggccatggcggcctcttccgtggggcaagcgatttccaggaagctggccttaccgggatcggacaggaagccacgggccatgaaggcgccgcgccatgccgctttgatttgggcgatggatccgttgaccacttcagacggcagtccacggacctgctgcttgcggcggtcgaccagtccggtctgcaaagccaaggccactacgttgcgggtgacgagcaccacataggtctcgacagggccgttcggggtctgacgtgtgaggtgattgacctcggcttcgtgcccgaacgtgttcctcaacgtgttcttcagccattctgcaacgtcaagcgaggtgaatacggcttggataacgtatgtattctgtaccggtcgaagaccgccgccaaaacggatcatggccgcagcttgggccttgatcgcggctggcgaatcgccttcaaaggctgccaactcgcttttgacatcgtccagaagagccaagatctacctcctacagtcccgttcttctcaatgcttcaggcgcttcgtgccgttatctgctgtcacacggtcggaagccatcggctttctgtgatacctaatctggtggacaagcgaacccgtttgatacgtattatgggctctgctttctcgcagtgtggtcaccgaacgcttgcccgatgaccgctcgacgcctgcttacgatgagtgacgcttgtgctgttctctcgcggaaacggttacgttgagcccatgtgcgcgtaagcggcgagccagctcttcgctcatcgccaccgaccggtgctgaccaccggtgcagccgacggcgatggttacgtagtgcttgtcttcctgggcgtatccttccaacgcaatctcgatagctttctcataagcgtcgagaaattccttggctcccttgctggaaagcacgtagtcggcgaccggcttgtcgtgcccggtaagctcgcgcaggttgggcacccagaacgggttgggcagaaaacgcacgtcggccacgaaatcggcgtcgatgggcataccgtatttgaagccgaagctgaagatgtgtactgccacggtggtggggccggagccgagcatcgcctcgtagagtttggtggacagctggtggatgctcagggagctggtgtcgatgacccagtcggctcgttccttgaggtcttccagcaggtgacgttcctcaaggatgccgtcgatcagtcggttgccgtgctgcagcgggtgcgggcggcgcacggattcatagcgcttgatgagcacttcgttgctggcgtcgaggaacagaatacgggttttgacgccgagatcatccagatggccgagcacggcggccagctcgtcgaaatagctggagcgcacgtcgatgacggcggcaagcttgtggacgcctgactccgatccggaaccggaggtggtcatcatgtcgacaagcgggataagcagtttgggaggcaggttgtcgaccacataccatcccatgtcttccacgcagtcagcggcatgagagcggcctgcgccggacataccggtgatgagcagcacttcgaaggcatcaagcggggtcggctggttgtccggagtcgatgtggatgtcgcggaattcgccggcgcattcgtggcggccgcctcgccggtatcgcggttcgttgtctgttgattcattacagcgcctcctcaagagctttgcgcatcgcgatctccagctggtcgtcttcggtggtggtgtcctgcagacgctggtcggcatcgctgggcgggtcgtcatcccagataccggtcatcagcaatacctgtacgagagcttggtacagcagcatttcttcgccgccgatggcgtgaccgccatgagcgcgccaggcttccatgagcttggtggggcgtggatcgtagatcacgtccaacagcagtccggagaatggctcggttccggcatcgacgagggcatccgcgacgttgtcggccgcgtgtccgggaatcgtgttgatgacataggtggcgttgcgggctgcctcgagcagggcctgatcgtcgcctaattcgatttcgttgtacgggttatgcacgttgacgaacttttcggccactggtttaagcccggtgttttttccggggtggcgggcggcgacgacgatatggccgatttcgggcatcatgcagcatgcggccaacgccgaagtggcggtgttgccattgccgatgatcagcgcggtgccgcttctcgacgcggtgtggtgttcgccgagttcgcgattggcatggtcgaaggcgagttggatgccgatgacatcggtgttgtatagcttgatgcccggcttgccgttcggccaagcgggatcatcggcagccacgctccagtcgaataccgcggtattcgccaccttcagttccttggcccacaaattttccggaacaccgtacggttggatggtcttcttcaacggcatggtcaggctcaggccagcccacgtcgagtcaaggcctttgaggaaagcgtcgaggtcgtcttcccccacctcgtgcttgtcgtacagccaatcgtcgagtttcagcgaacggtaggccgcgttgtgaagcacgggtgacaatgagtgtgcgacgggtttgccgagtacagcgcaacgatgattggccatatcccctccttgatgtctgttcccatgctagccgacactttgcttcgaatatgtcaaccacaggccccgcaaccgaaaatttactctgggctgctggaccgggccggctcactgctcgtgcagcgcgttgtacagcgcttcggctttggcgtggccgatgcctttgaccttctcgaagtcctcgacactggcttcgcgcatggctttgaccgagccgaagtggttgagcagccgcttctggtagctttcgccgatgccgggaatctcgtcgagcgcgctgcgcagggcgcctttgcgccgctgctggcggtggtaggtgatggcgaagcggtgggattcgtcgcgtacacgctgcagcagatacatgccttcggactggcgtttgaggatgatcggatagtcgtcgtccggcacccacacctcttccaagcgtttggccagtccgcagacggccacgtcgttcacgccacagtcctcaagcgccttggcggcggccatgacctgcggcttgccgccatcgaccaccaccaggttcggcttgtaggcaaagtgatgccggtttgtgttctgctggacgatgtcgggcggggactcccgcgcatcgttctgcactccgaccggcaccgcgtgccccttgccactgatgtcggaaccgccctcaccattgtcgttaccgttcgcagcgattgtctccgccgccacggcagtggtcatcttgccggcggccgaggccacacgctgttccgcgtcgatgctttcgccggagtcgccggcgatgttgccgtgcttgaagcggcgggtgagcgtctcgtaaagcgcggacagatcatccaccgcgcctttgccgtccttgcctcggatggcgaagcgtcggtattcggatttcttggcgatcgcgtcttcgaacaccaccatggaggccacctggaaggcaccgcccacagtgttcgaaatgtcgtagcattcgatgcgcagcggggcttccgcgagtcccaatgccttggccacatcgttcatggcctgggtgcgtgcgcccatgtcggagatgcggctcatcttgctgcgttgcagtgcttggctggcgttctcgttggcgcggtccataagctgcttcttgtcgcctcgcgaggccacacggatggtcaccgctcccccgcgcagattggtcagccagccttcgagttcctcacggcgggccggttcgacgggcacgatgatttcgcgcggtaccggtgcgatgggcgccagcaggtccgcgcgcccggtggtctcctgacgggtgttgcgttctcgggtggcctgggcgcgtgccacagcgtccgtggccgtgatggtttgcgtggagccgatggcctcgcgattggtggagatggtcgcggccgactgggggtgattgtccccggcggcgtccgaatacacctgcaccagaaggtcggccatcaagtcggcgtcatcgatgtcctcaactcgttcgacgctccagttgcgttcgccgcgaatcgagccggcgcgcacataaaaagcgtgcacggaggcttcgagctcgtcgctggcgaagccgaacacgtccgcgtccacatcctggtcgaagacgacggcgttctgttgcaccacggtttccagcatttggatctggtcgcgcagtcgggcggctttctcgaattcgagttcggcgctggcctctttcatgtcgcgggtcaactgggcgatgtatggccgtccgagtcgtccggtcatcacgccgaccagctgttcgcacagcctccggtgttcgtccgcttcaatgcggttcacgcagggtgcggagcatttgccgatggaagcgaacaggcatggccgtccggtcagttgcgccttatggaacacgttggtggtgcaggtgcgtaccgggaacgtgcgcagcaaccggtcaagactgtgccgcaattcccacactttggcataggggccgaaataccgggtatcccgccgtttgcgcgaccgcgtgacccacacgcgcggaattcgctcccccgtgctgaccgcgagatacggataggtcttgtcgtcgcggaactgcacgttgaaccgtgggtcgaattccttgatccacgtgtattccaacgtcagtgattccagttcggtggcgacgaccgtccactccaggctgcgtgcggtcagcaccatggtctgcgtgcgcggatgcagcagatacagcggctggaaataattggtgagcctgttgcgcaggttctttgccttgcccacataaatgacgcgcccttccccgtcgcgccatttgtacacaccgggtttggcgggaatatccgaggtcttgggtcggaacaggtcgcgagaatcccccagcaaaggtgccccattcgcattcaccttcgccgtcgtttccccggcacccacagctatgctttccgacattaacgccgccgcagtcttccgccactcatccggactatgccgctcaatatcgttcgtcataatcctcctcgctattaagcaaaccaatcatcagggattgggtgggttggggtgtgtgttgctggaccgtaaagacttgacctgagcggcccggagcatgtccagcaacaaacaccccaacccacccgaggtcagctgcaatggaaggctaaagcatgggtttcaggaacttgccggtccatgaggcttcgcattcggcaacctgttcgggcgtgccctgcgtgacgatggtgccgcctccgtcgccgccctccggaccgagatcgatcagccagtcggcctccttgatcacatccagattatgttcgatgacgatgaccgtattgcccttgtccaccagggactgcagcaccttgagcagcttgttcacgtcttcgaagtgcaggccggtggtcggctcgtcgaggatgtacacggttttgccgtcggatcggcgctgcagctcggtggcaagcttgacgcgctgcgattcgccgccggacagggtgggtgcgggctggccgagtcggatgtagccgaggccgacgtccacgagggtcttcaggtatcgggagatgccggtgtacgccttgaagaagtcggcggcctcctcgatgggcatgttgaggatgtcggccacggtcttgccgttgtacgtgacttcgagggtctcgcggttgtatcgtttgccgtggcagacctcgcagtccacgtagacgtcgggcaggaagttcatttcgatcttcagcgtgccgtcaccgtggcaggcctcgcatcggccgcctttgacgttgaaactgaagcggccggggccgtagccgcgcacctgggcttcgggagtcttggcgaacagggtgcggatcttgtcccacacaccggtgtaggtggcggggttggatcgcggcgtgcggccgatcgggttctggtcgacgtggatcaccttgcgcacctggtccacgccttccacgcgcgtgtggcggccgggtacgatgcgtgcaccgttgagcttgtcggcgagcaccgggtagaggatcgtgttgaccagcgaggatttgccggagccggagacgccggtgaccacggtgagcacgccgagcgggaagctcacgtcgatgttcttgaggttgttctcgcgggcacccacgactttgagcacctgggtcttgtggatcttgcggcgcttggcgggcacggcgatctctcgccggtgggcgatgtagtcgccggtgatggagcgcttggcttctatgaggtgcttggcggggccggagtagatgacttcgccgccgtgttcgccggcgccggggccgatgtcgaccacccagtcggcgcggcgtatcgtgtcctcgtcgtgttcgacgacaatcagcgtgttgccgagatcgcgcaggtggtgcagggtttcgatgaggcgttcgttgtcacgctggtgcaggccgatggacggctcgtcgagcacgtacatgacgccgaccagaccggagccgatctgcgtggcgagtcggatgcgctgcgcttctccgccggacagggtggcggccgcgcgcgagagggtcaggtagtcgaggccgacgtcgttcaggaagccgagtcgggccttgatctccttgagcacttcgccggcgatcagctgtgccgagccttcgagtttcaggccgttgatccaggcgagttcgcgtacgacgggcatgtcgcacacgtcgaagatggattttccgtccacagtgacagcgagcacttcgggcttcagacggcgtccgtggcagacctggcagggcacttcgcgcatgtacgactcgtagtattcgcgcatggactgcgaatcggtttcgtcgtggcgtcgcatgagcgtgcggatcacgccttcgaagccggtggagtattcgcgcaggcgtccccagcgattgcggtaggagacgttgaccttgaagtcgtggccgtagaggatgtcgtgcttgacgtcgtccggcaggcccttccaaggggtcttcatggagaagcccatttccttggccagaccttcgaggatgtggccgtagtactgggaggtcatcttggtgccgctccacggttcgatgacgccgtcggccagtgacctgtccgggtcggagatgatgaggtccgggtcgatttccagtttgaagccgagaccggtgcaggcggggcaggcaccgtagggggcgttgaaggagaaggtgcgcggctcgacctcgtcgagttcgagcgtgtgcccgttcgggcagctgcggtgttcggagaacggctggcggcggaccgggctgccttcctcctcgtccacgaagtcgatgatgatgctgccgttggcgagcttgagggcggtttccaccgagtcggtcaggcgttggcggatgccgtccttgaccacgagtcggtcgaccacgacctcgatggtgtgcttcttctgcttggtgagtttgatgtcgtcggacagctgcgtcatctcgccgtcgatgagcgcgcgggcgtagccgtcggagcgcagcagctcgatcatatccacgaactcgcccttgcggcccttgaccacgggcgcgagaatctggaatcgcgtgcgctccgggtagccgagcagtgtgtcgacgatctgctgcggggtctgggaggcgacgggctcgccgcattcagggcagtgagggatgccggtgcgggcgaagagcagtcgcaggtaatcgtagatttcggtgatggtgccgacggtagaacgcgggttgcggttggtggtcttctggtcgatggagacggccgggctcaggccctcgatgaagtcaacgtcgggcttgtccatctgacccaggaactggcgggcgtaggcggatagggattcgacgtagcgtcgctggccttcggcgaacagggtgtcaaacgcgagcgaggatttgcccgaaccggacaggcctgtgaacacgaccatgcgattgcgcggaatcgccaggtcgacgttcttgaggttgtgttcgcgcgcaccctgaatcgtgatcttgagatcgttcgggatgtgcgagatatcagctaccagcgaaccatcgtgttcgatcagcggcgcctttttgatctcccggctcaggaaggagtcgctggtcatcaccttttcgacgatgacctcaccgttcttgcccttgccggttttcgcgcccgttgcgcttgttgcgcgccttgcgccagtctgcattgccgccacagccacaccccaccttccatctcaccgttcccgcgcgcacggtcatgcgcgcgccaaatctgtcccaaggatacccgaacacacgaccaaattcgaacgcttgttcgatggcgtgtcaggccggaaaactgaaccagagtatgcaaaattccggaccatcagtggaccgaaacgcaagagccggcccccaagatactcggggcgtccggctctcacttccatttccccagcggggttggcttaccatgaagtatacacggttttaggacatcaatcactgtcgatgaacactgttcgaacatggccgaggaattcatcgtatcttccagtaccggcctgggcatcaccgtacgctcctagcagctgatcagggagccatagccttgcatcagtctcccctgcacagagttcgacacgaattggcccgataaatctgcggcttctcaatccatcgatgaaacggatatcgttcctgtcctgtgaaatctcgcgccgttcaagcacaagcgtgtccacgttgtattctgtttccagcagaggcagaagacgttccaaacatttacggcgagcgcgttcggcggtattccactggctcattggtaccgcagccacaatgacatgatcaatgtccattgcagccatggcatcaacgactttgccacgcaatgatggccgcatgtctcgccagtgcaatttccttgctcctttgggcttaagcaacgccaatctttgccttgtttcggtttccgtatcatcacatacgcatgcgcccatcaagtacataggcgagggaactccggttttccgcacactctcgtcaccccaagcggttgccatgtttgtcccttctcgcgcaacgcaaaacaacagttcgatagtatcggatagcagtgccggaccttgcagctatgcaatgccgttgcattattaatcggaaggcataatgtgagacgagaaaaagctaagccgttctagctcttggcaacatccccaatcactcagcctaaatcggcaaatcctgattttcaatggactccacggggatgccaagcttgcgtaattcgtcaactgcatcacgcatgggaatgcgttcctgttcgatgcgccgataagcgattgttttgtcagcacacagtcgttcataaagacgtcgctccgccgattgaaggccgggcgtcggcttaggctcccgcatagcaatcttcgcgctgcgttcagtacgatcggtaccaaatctgtggtaccgatcgtatgcatcgcaatccatcaggatggagtcgcattcgatacctgattcacgtaatgtcgaaagtatttccagtccatccgcatccatatcaccccaatacacgatacgcatgtcacgcagtgcaggaaccgcaggtacagcatcgcttacagcgcgaccagaaccccatatgcagatgccctgcgcaatcggcggcatagtctgatacgtgtctttgttctcaacgatgacagcatatttaatgccggataacgcttcgccttcccacggacaccatatgatgcgttcgagctcagcatcgtcgcggaccggatcgagataacggaaccgcagttcggtcggccgttttgacagacccaacgtttcgacaccgagcagtcggcaaatggccttacgacgattggtttttgactcattcagccatttgccgctgaatcctgtcagtggaatctgtcgcggcgtcataccggtcacgtcatgatgcctgaaatatcgaactgcgctgacaagcagatcgaagtcgtcaggctgttcatggcctgtcatgcgagcggccgattcgattgtttccggagcaacgtcacaagcagcaaccagacatgctatgcggcggcgcgcttcgcgacattccgccgccagcgtacgaccaaccacacgcatggctattgattcgtcaggaacgacgactttggagatcagctcgacagaggtgcctatggtgcgatgcttggttatgatttcgcaaccattcttgcttgcccattgccgtatctcattgttgttgtcatgcaccgcaatcgcattggtttccaaaaatgcttggtccggcaatcccaccggcacgggaaatggccatgccggttcgatgtcgtacatatgtgaacgcatatgtttcttcacgcatgtggtgatcgcagcgatgtctttcatgccggccacagttcccatcacctgctttcgaacatcgtcgagtcgaaccgaatcgtcttaataccggcgacgccaggactgctcattcggcaaccccgtcatccttcaatatatccgacgatgattcatcgtccatgtcattctgatgcagcacggcctcgcgcagggaggtgaggccggtgtcagggtccttgtaggtcacgtaggccttggtggagacctcgaggatttcgccggtcttgctttccggggcggagacgatgatctggaatccgaggcgcggcagcaccgtgagggcgcgctgcgtgtaacggccgtcggccttgatgagcgcctcgtcgaggaacagcgtggtgtacgagggctcgctggtcaggccgccgccgagcaggtagatgagcgccgcgccgtatacgaatgaggtgagctcctgcaaggcgccgcccgaacggccgccggtggaggtgatgcgttcatccgggccgtcggcatgatgcacgatggcgtagaaggacgagcggcaacgcgggtcgaggttgcgggcgccgtagcttttcacgccgttcgcgtccttgacctgcgcgagttcggcgcgcagcagcccgaccatcggcgcgcaggccgcgaaagccttgcgcgaggcgtcggaatcgttgacgtcggcggatttccaatcgttcagggtgccgatgacgcggatgaactgcgcccagaaggtgcgctcgggacggcgcacgtccgcgtgcagggacaggctgccgtgcttgggaccgaactgctggcctttgagcatggcgttgatgcggtcaagctggtcgtggatgtcgctggcatccgtgtcgatggcgcgtttgatggtcaggaagctcctgagcagctgttcgaggcagcgccggtattcggcgtcggtggcggcaaccgcggccagctgggtgaggctggcgagttcgtcgagatagtaccggtagtcctccacgctggcggtcagcgaatcatcgtcggccgcgtagagcgcgatgtaggtgctcattttcgattcgacgccggtgcgtgcggcatcggcctggccgttcagcaggttgatgcgggaggccatgtccttgccgatgccggcgatggtgcgttcggggaagctctcccccggcgcctgcgttcctgccgcgcccgcgccgatgatcatgtgcgcgcgcatggcggcgtccgccagtccggcgaatcggttgtcgtaggattcggcgagcgccgccgtgacttcgtccggcagcgggccggacgcggcgtcatcgtcattgtcggcggtggcaccggcggcgtccgtcgtgccggtgtcggcatggtcgcgcagccagatgagcgccgcttcgacggcgctgccggcgcgggccgcggcctggtcggattcgatgcgctggcgttccacacggtcgagttcggcgttcagttcgtcgcgctgtttggcgagttcggcgagcttgggatcgtttttgatggatgcgatggcgtcctgcgtgtccgtgatggtccgttgcgcgccggcgatgtcgatgcgctcccaggacgtgtaggcgagctggttggccagttcgagttcgcggtggaggttatcggactgtgttttggcggccgtgtagtcggtgtcggcttggctgagcgcgttgcgggcggcgtcgacctgcgctgcgagcgcgttgaggtaggtttcgttgacgaatccgatgacctgggcgcggtctttggtgccgtgctggccgcgtgcgccggatttgatctgaccgtcggcctgcacctgacggttggtgcggtcggtgtcgtcgatggcggtgacgcatagggcgtcgaatcgttcgtcctgggtctgcgagcgcagccagtcggcgaagggcgagtcgtcgcggtagcgcagtttgccggacagccagtcgccgtcctgttctccggtgagtatgttcgcgtgcgcgccggtgtcgtcgtagtggcgtgcggtgtccacgaactgccaggtgcgtcggggcatggtgcgcgggtcgatggtgctgactttggcggcgaagccctgttcgtggcgcttgtcgacgaggatggtctgggcgatgggcgcgtaggcgacgttcatggcgagacgccagtcttcctcgtgttcgttcacgtccatgagttcggccacgtacggcagttcggcgggggtgagtccggtggcgcgacagagcatggcgcgggtttcgtccatctgctgggagatgcgggtgcgctgggagcgttgccggtcgaagtcgcgttgcagtcgttcgaggtcgccgcgtgcgccggcccgcgcgttgatggcggcggtgagggcttcctcgcattcgccgtctcgtttgttgtattcgcgtttgaagttcacggcgttgatgcggcgttcgttccaggcctgttcgtcgccgggcagcgtctcgccgatggatgcgaacgtttgttcgattcgtgttcggttggcttgcacgtcttcgagggtgcggcgggcctggtcgagttcgagttcgagtcgggtcaggttgccgccgtccagaccctgcatctggccgcggatcatgtcgagacgggtgcgcaggtcttcggttcggcggcgcagcagcttggcttccgcctcgctgttctgttgttcggcgcggtcggcgggcagttggacggcgacttcgccgcgcatgcgggccaatgcccagtcgcgcagcacggccggtaccgtgccgtcgacggccggcttgaccggttcgaaggcgcgggccttgccgcgtgcggcggcgtattcgccgtaggcctgttggatgccgcgcagcgtgtccatgcggcgggtcttctcgtccatggcgtggaagttctcgtcgtaacgttcgtagtcctcgaccgtggtgcgggccaggtccagggcttcgggcacgccgagcacgccttgtttgaagatgtcgtcgagccgggagggcgcgtcggcggactggatcttgtgcagcagtcgacaggcggcctcgctcaggcccattgcgctccagatgtgtgtgtggaacgcttcggcgctggggaatgtgaggcagtcggggtaggtggctttgagctgggccggcgtgaacggggcgtcacggtattggtccatgcgcctggggtccacgggcttgccccagaccacgtactgtcggcgcacgtcgccgcggccgtcgccgggcatcaggtagaggaatttggcgcaggagagcacctggccggtggtctggttgcgataggtgtccacgatggcgccccacacgggttgcggtgcgccgttctcgtcgcggccgcgcaggtagagcggctcgtcgccggtttcggtgctgcccacgccgaccatgccgcgcaggtaggtgtagtcgctgcgttcggagcggccggagttcgaggccttgttgaacggcgtaccggttgggtacagcagggagatctgcgcgtcgaccagcgtggatttgccggattcgctggcgccggcgagcagggtcaccggcagcttgtggtccgtggaggggcggaattcgtggtagccctcataggagccccagttgatgagtcggcgggattccagcatccaccggtccgcgatcatctgcacgtctgtcgcctgcatcattcggctcccttctcgtcgtcatcgtcatcttccgtgtcgccgtcgccgtgttccgcgacgtcgagccaggtgtcggccagttcgcggtcgagcaccacgggcacgagcggcgtgatctggtacatggcttcgtcgtccaggcgcaccaaatacccgtaggtgatcatcgcggagacgatggcgccgatctgctttgccacgccttcctcgtcgttgcgggcggccagatagccggcgccggtggcgagcgcggcgcggatctcctcaaagctgacgagccagtcggcggggtcggcgtgcacgttctcgtattcgaggacgcggatgcgcaggaaggcgagcagcgcggcctcctcgcgtttgaggctgacacgggttttgagcgagcgcagggtcacgtcgtcgccggccacgggcgtggcgtacatgatgcggtagcgttcgttgatcaccaagtcgagcaggtcgttgttcagggagcgtacgacggcgtcgcggttgtcgagcacggtgtcgtaggtgggcccgctgatatagcggtcgcgtttaagggcgatggcggccatgcgtgcctcggccggcatgtcgccggtgtcgccttcgaacagggcgtacgggttggcgttgtccatatgctcctcgtgttcctcgtgttcctcggccacggtcatccttcctccacaatgatgctcagctcgtccatgtcggccagcaccggtctagtgatccagttccggggctcgccgtcgatcgatacgcaatgccaggtcgcggtatcgccgcgctgcgccggagccggctcggtggcgatgtcgctgtcgaccccgacgccgacgccgtcagtggacggctcgtcggcgatggcgttgccgcttacggctcccagcccgcccaggaagccgacgatctcgctttcgcggcgttcgctttcgggcagccggttgaagctggcggcgatgtccacgagggttgcgccgggcctgtcatcggacctgtcaacggtcaccgggttgcgccggatgaggctgaccatgcgcaggagtcgggggccgccgctgttgaccatgtcccgcagatcggccaccggagtcgactgcggggcttcggcggcgaggtcgctcaggccgggtgcggtggcgcgggtcatggatttggccgggcgcatcggcaatggcgcgaacagcgcgtccgaggtggccgtgtcgtacgggcgcgaggcgtctcccatatgggttttcgcatccgcgttgaggcgcgcgtacagtcggttcaagcgggtgagcatcgtacggtagcgagtgtcggtttgctggcgcacgagccggctgatcgcctcgtcggagacgcgcatctggcggcgcacggcttcgatgccgtcgtagatgcgggccagttcgtcgcggatctggccgagcagcacgccggattcgccggccagatacggggttttggcgatagcgcgcagggcttcgtcgatttgctggcggccctcgtcggtgatgatcacctggaaggcgtcctcgaagcggcggccgctgtctgattcgcggaacgagcggcggtattcatcgtggtagcgggtcaggttctcgtccacgctgatgtcgccggcctgcatgcgccgacgcaaggcgtcgccgttgtcccgctcgtcgagcacgagttcgcgcaggtcgatgggcacgccgcgcagcgtgttgtggatcacggcgatcacgtcctccacctgggcttcgctcagcgtggcatgctgcttgccctgttggatgcgtttgatctcgtgcttgcgttccttgatttcacggttgaggagtttgatgcgctcgccggggtcggcggtcagctgcatgcgcgcgtgctcgatttccatgatgatgctgttggcctgcgcgccggacagggcgcgtgattcgtcttcgagcctgctcagcgcctcgatggcgcggtgggcgcgggccgtcaaacggtagaggaatcggtgtgaggccgcatcatgcgagttggcgagccaggcgtagtcgccttcgccttcacgggtcaggtcggcgaggatctgatgggcggcctcggcgaaggtctggtcctcgcgcggcgcatattcgccggcgtcggccagagcgttcagactttgcgcgaaccgctcctccacggtctcgcgcggcagctcgccggtgagcgggtcgaacgtggaacgcagcagcgacacgtacagcatcgcgttctggcgcaacagcaaccgcaggacgcccgtctcatacaccggtcgcagccgttccagctcccgcatcacatcggccacagcatgcctccctctgtcgtgaccgcaccatactagccgatagccgcgaaccacaccccgcccgcgccacgtccttcgccccccacagggaggggcgccaagccatgctaaaaatcacagacagactattgcctttgcgggaaatcatcgttagattggcgagaggaatattgtcaatgcatacgaaacggaaaacatcgtgaccgcaccgaacacgcccgccgaaacctctgaccagctcaacaagcccgccaaatccggcaaactggaggtctccgacctcatcaccatcggcgtgtttgcggccctgtacttcgtgatggtgtgcatcgccacactggtgagcaccctgttcaccggcggcttcggctccatcttcctgcccgccatcacggccctcatctccggctgcgtgtacatgctgctggccgcacgcctcggcaaattcggcggcatcaccgtcatgggcgtgatcatcggactgttcctgttcatctccgggcatttcgtgctttcgttcatcgccagcatcgtgttcccggtggcggccgacctcatcgcgcgcgccggcaagtataagagcaaggcgctactgctcgtcagctacgtggtgttctcctacggcctgaccggcccgatcctgcccctgtggttcatgaaggacgcctacgtggcgagcctgcaggcgcgcggcaaggacgcagcctacatcgacggcgtattcgtcaacatcaacaccggcacgttcttcatctcgatgatcgcgattctggtgtgcgcggttctcggcggctggttcggccagcgcatgatgaagaagcacttcatcaaggccggtatcgcctgatgaatcctgcccgccggacgctcgatccgcgcgcgaaactctaccttctgctggtggcgaacctcatgctgttcttccacgtagggctcgccacgcaaatcgtcatggtcgtgctgttcctgctgcccctgctggcggccgcccgatggcgaaccgcgttgaacttcggcgtgacctatgcagtactcaccgcgctgggaatgctcgaccccgatgccctgggactgccgtggctgcatgtggtctccgcgctggccgtgggcgtcacgatgatgctgccctgtttcatcaccggcgcgtatacgttcaccaccacgtccgcgagcgcgttcatctgcgcgatgcggcgtatgcgcgtgcctgaggccgtggtgattccctgtgtggtggtcatccgcttcttcccgaccatcgccgaggattaccggcagattcgcaatgcgatggcgttgcgcggcatcgcctccggcggctgggggctggttcgtcacccggcccaatcgttggaatacattctgattccgctgctgatgaacgccaccaatgtggcacaggacctgtcggtggcggcactgaccaaggggctcgggcgtgagggcgagcacacctcgcgcacgctgatccgtatgaccgtggtcgactggctggtcatgattgtggtcactttgccgctcgcgctcgatatcgcgggggtgatctgatgggtggcaaccaatcgcagccgaatgcaactgccattattgggaccggcaagggtggcccactcgacacgtctgcgggaaccatcgcctcccgtggcatctcctttacctatgaccatgccgcagagccggcattgcgcgacatcacgttgaccgtgcccgcaggcgagtgcatcgtgctgtgcggggcgagcggctgcggcaaaaccagctatacgcgcgttgccaacgggctcatcccctcattcttccatggtgcgttcgccggcaaccagaccacgtgcgggctggatgtggagaccgtgccgatcgaccggctcaccccgctggtcggcagcgtgttccaaaacccgaaaacccagtatttcaacgcgaacgtcaccgacgagctcgccttcccggccgaaaacatagggctgccggccgaggacatcaatcgtcgtatcacggccgtggctgagcgctttggcattgggcatctgctgcatcgcagcatcttccacctgtcaggcggccaaaagcagcgcatcgccgtggcggcggccaccatgctggggcccaggctcgtggtattggatgagccgaccagcaatctcgacgcgaacgccatcgcggacatgcgcgccatgatcgagcagatgaaggacgaagggctcaccatcgtaatcgccgaacaccgactcgcatggctcaacggcgtggccgaccggtacgtggtattcgacggcgggcatatcgtgcaggattacgaggccgatgaattcctgtccctctcccccggctgcgtggccgccatgggattgcgggcgttggacctgcaaccgtatcggcaccggattgcgacgctggcttcaagcccggccgcggatgagtgcacttcggcattgctcggcacccataacctcaccatcggatacaaaggcaaggacggcttcacccgcgccatcccggacctgcggttccgtgccggcgaaatcaccgggctcatgggcaacaacggctgcggcaagaccacgctcgtgcgcacgttgaccggactcatcaagcctgtttcgggccgcatcgagctcaacggcgtgcccgcgaaaccgcgcgacctgacccgcgccggattcctggtcatgcaagatgtcaactaccaactgttctccgacagcgtgcgcgaggaactgctcatcggactcgacgagacggatgccggcatcaccgctcaagccaatcaggtcatggccgatcttgaccttgcagcgttcgtcgaacggcatccgatgagcctgtccggcgggcagaagcagcgggttgccatcggctcggcattgatgtgcggcaaggacctcatcatccttgacgagcccaccagcggactcgaccgctaccacatggagcaggtcggcgaactgctgcggcaactggcgagccaaggcaaggcgattctcgtggtcacccacgatgaggagctcgccgccggctggtgcgaccgcattgtcaatcttggcgccgacgattccgggaacaacggctcgcatgccagtaacccagatgccagcagccccaaccctaatgcctctaccaatttcgccaccgcatccacccatgaaaggaacgcgcaatgaccgccagcaacaccacggattccacggccttcgacatcaccgactggctcggtgaatgggaaagcttcgagcattacattgattcggatgacgccgccatccagcagacctgggaagccgccgagcaggcggtgctcgccaacccgaagatggccccgatggccgcgcgcggcatcaggacgttctggtcgatggcttgctccaccaccagcccggagaacatcatccatatcggctactggcgtgtgaacgagccggccgccgaatccggctccacggacgatgccgcgctcgccatcgaatggttcgccgaggacgacaccagcctcgacacctacgaatacaccatcgaccatgtcatcgagcacggtctcgaaggctcccccaccttcgtgttccacaccaccgatccggccgccgaagacagcccgttccgctggctacttgccatcaatccgctgccttcgcgcaaggcgttcgccgagggcgggctgctcaggccacctgcatttccagtacgccaacgatctgcacacgctcgtcgccacggatgaggccaccggcgtcgagaccttgcgcaatccgcgttggtacgccaccatgtgcgccaacgagggaaccgtcgaggaccgttgcgccatcatccgcgcgttgcaccacttgcagtagacctggcaacatacggcagtgacggctccccactagtgaaactagcatcgcttcagtagccgtgcgagtgcagatactcgtcatcgaagccgaaaaaatggccgatctcgtgcaacacggttttgcggatccgttggcgcagctcggcctgcgttgagcatacgcgttcatgcggccccttgaacagggtgatgacgtccggcatcacgccgctgtagcccgtagttcgcttcgtgacgggtatgccctcatacagtccgagcagctcaccgcacggattgctcattgtagccagttcgcgctcattgggttcgtccgcaacgacgatgccgacattctccagcacccgcgcaaaccgttcaggcaaatcatccaacacctgttcaatggcccgttcaaactcatcgtcactgatgtgcattcgctctccacacgcgaaatgccttggcaccaagtatgtaccaaggcgctgaaatctcagactagcaggctcagctgttgcggttgatctcgatgtcggtgacggtgaggttggcctcgttgatcaggttgaagaggatgacttcggccagcgggccgggctgcatgaaggtgtgctgcttggcctcggagacgtagtcgcgactgtcacggtagaaagcggtatcaatgccgcccggatagacggcgaccaccttgacactggtgcccttgtatgcggcctgcaggctcttggtgtagcctttctcaccccacttggtggcgcagtacacgctttcgttcgcgttgccgcgtgtggcggcggtgctcataatctgggcgattttcacgttctgctcgccgcaggccttgagggtttccaccgtccacagaatcatgcctttgagtcccttgagacatttgtcgacgtcggcggcctcgtaggcggtgggcaccttgaacgaaggctggccggcgttgttgatgagcaaatcgatgtggccgagcgtggcgatatccgccacggattccttcacgaacgcttcgtcggtgatgtcgccgacgtaggcgcggtaggagtcatcgggccactgcgcggtcagttcggcctgacgttcggcattgaagtcgacaccggccaccagccagccgttggcgatgagctggctggcgagctcgtagcccaagcccagcgcgctgccggtgacgatggcgattttcttacctgttgtggttggcatggcagacctctcctactactattcttcggctacgagtttactactattcttcagctacgagttcgagatacgaatcattccagaggtcttcgtcgccgtcgggcatgaggagcacgcgctcggggttgagcgcctcgacggcgccctcatcgtgggtgacgagcacgatggcgccctcatacttggcaatggccttcagaatctcctcacgggaagcggggtcgaggttgttggtgggctcgtcgagcagcagcacgttggctcgcgaggtgaccagcgtggccagagccagacgggtcttctcaccgccggaaagcacgtgagccggtttcatcgcgtcgtcaccggagaacaggaacgagccgagaatcgaacgggcctgcgtgttatcgagctcgggcgccacatgctgcaggttctccaacacggtggcgttcagatccaaggtgtcgtgctcctgcgcgaagtagccgatcttgcagccgtgaccgtattccacggaaccggtgtccggctcctcgatgtgggccagcaggcgcagcgtggtggtcttgccggcaccgttgtagccgaggatcaccacacgcgagcccttgtcgatggccaggttcacgccggcgaacacgatgttggaaccgtaggccttggaaatatccttggccatgatcggcgtgcggccgcagggcgcgggctcggggaaacggatgtccgccaccttctcggccttctgcgcctcggaggtgttttccagcagcttttcggcacggcgcatcatgttctgcgccgccacggccttggtggccttggcgtgcagtcgaatgccttgcttcatgagacggtcggccttcttctcggccacttcgcgttcgcggcggcggcgctcctcgtccaccacgcgctggtgcaggtaggccttccagccaagcgaatacatgtcgatctggccgagctgcgcgtccagatgccagaccttgttcaccacttcgtccagcagttcggtggagtgggagatgaccaggaagccgccctcgtacttcttcaagtagccgcgcagccattcgatggaatcggcatccaagtggttggtcggctcgtcgaggatcagggtgtcggcattggagaacaggatgcgcgccagctcgatgcggcggcgctggccaccggagagcgtgccgagctgctgctccatgacctcctgcggcaggccgagcgaggcggccatggagatcgcctcggactgggccgcgtagccgccagccttgtcgaagtcctgcatggccttgtcgtaccgggtcatggccttgctcatcacgtccggatccgggtcggtcatatccttttcggccttgcggatgcggttgatgatggtggcgatgtcgcgcgcgctcatcatgcggtcgagcgcggtctgtgtgggatcggaggcatgcgtgtcctgcggcaggtagccgagcttgccggagacgcgcaccttgccggcggtgggcagcatgtcgccggtgatcacgcgggtcagcgtggtcttgccggcgccgttgcggcccaccagaccgatcttgtctcccttggccacatggaagttggtggggtgaagcagcgtgcgcgcgccgatctgaatttcaagtccctgcacctcaatagccatgaataacctacttgcctgttacgaatactgtctcttaccaaagtccgactgtccatcatagcgaacaccatgccgaccgggctcagccgacgctcatgcgtccatacgcagccgcgcaactgatcggcaaggtgaagaatgcgacgcccggtatggtgatcgcgaccatggcgcacggtatcgaagctgccatcgaagccgctgtgagcaccgaaaccgacgccaccgacatcatgggcgaaacccactaacgtacagacagcgatgcccccgccgacaacttctgtcagcggggggcatcgctatgcgttgaacgttacagttcgcgcaactgggcggcgatctggatggattcgacgctggcctcggccttgttgcgcgtctcctgccattcggtggcgggcacggagtcgagcacaatgccggcaccggcctgcacgctcgcctcatggtcgcgcaggaacgcggtgcggatggcgatggccatgtccatgttgccggagaaatcgaagtagccgacggtgccgccgtagatgccgcggtcggccggttccaactcgtcgatgatttcgactgcgcgcggcttaggcgcgccagacagcgtgccggccgggaacgcggacttgaacacatcgaatgcggtcagcgaggggtcgaccttgccggtgaccgtcgagcagatgtgcatgatgtggctgaaacgcttgatgtccatgagctgcacgacttccacggactgcggcacgcacaccttactcaggtcgttgcgagacaggtcgacgagcatgatgtgctcgctgcattccttcggatcggcaagcagctccttggcgaatttctcgtcttcctcaggggtggcgccgcgagggcgggatccagcaatcgggaaggtcatcgcgtggccgttgtccaccttgatgagggtttccgggctggagccgatcacgttgaagtcgcggccctgagcgtcggtcaacgccatgaaatacatgtacgggctcgggttcagcgtgcgcaacacacggtacacgtcgaacgggtcagcaggcgaatcgatgtcgaggcgctgggagatgaccacctggaacacgtcgccgtcgacgatgtactgcttggctcgttcgacggcctgctcgtagtggctcttctcggtgcggaagcgcagctcgggttgggcgaccgtttcgtccaggatgttgacgcgggactcgtccggagccggggtggcggcatcgcgctgcatctggtcgagtcgagcgacggcctcgttgtaggcagcgtcggcgcgagtggatttatcatccacattcaccgcattggcgatgagccataccgaaccggatacgtggtcgaccacggcgatatcggtggccagggcaagcacggtctcaggctggccggtctcgtccggagcttcggcgcgcagggtcggttcccagtggcggatggcatcccagccgaccgtgccgaccagaccgctggtcaggttcggcaggccttccacatgcggggccttcagagtcttcaacgtggcgtgagcgacttcgactacgtcaccggtgacgggcacgccgaccgggaccttgcccagccagtcggcctgaccgttgttggagcgcagctgggccatcgagttgacgccgataaaactgtaacggctccacgtgccgccgtattccgccgattcgaggatgaaggtgccggatcggccgccggcgagacgctcgtagaagccgaccggggtgagcgagtcggcgagcagacggcgcacaatcggaatcacacggtatccggcgtcggccagttcgtggaactgttcgcgactgggccaggtggcgccccacttcaggtgtttgacgctgcattcgctcatattcgctcctttgcttacaactcgatgtcttgtttcatagtacgcggtcgctcggcttcccccagtcaggaaagcccgttctactgctcggccgggcgatggccttcgaccacgggcagggggccgccttcgaggaagcagctgcgcttgccggtgtggcaggcggcaccgacttggtcgacttcgacgagcagtgcgtcgccgtcgcaatccagggacacgcccttgacgtattgcacatggccggaggtatcacccttgcgccagtattcctgacgggaccgggaccagaaggtcacgcggccggtggtcagcgtacggcgtaatgcctcgtcgttcatgtagccgaccatcagcacctcgcgtgtgtcgtactgctggatgacggcggcgaccagccccttggcatcacgcttcaggcgtgcggcaatacggggatcgagttcagtggaattgtcgtatgtagtgtctgtcatacctatcttctttttgtggaccaccctcagtcagcttcgctgacagctcccggattatgtgcgacgtgcgcatagcgcattgccacgaacaattcactggattgttcgcccagcgggagcaaggtgtattcgtttagcgaacggtgtagccgtgcttcttgagttccgccttgacatcggcgatagtcaggatgccgtaatggaacacggatgcagccagcaccgcgtcggcacctgcttcgatggcgggcgggaagtcctcgaccttgccggcaccgccggaggcgatgatcggaatcttgacttccttgcgcacggcgcgaatcatctcgaggtcaaagccttccttggtgccgtcggcgtccatcgagttaagcagaatctcgccggcgccaagctgctcggcgcgcttgacccaccagatggcatcaataccggtggatttgcggccacccatcgtggtgacctcaaaaccggactgcgtatgctgctcacccttttcgcggcgggcatccacggagagcaccagcacctggttgccgaaacgatcggccacacggctgataagcgacgggtcgttgatggccgccgtgttgacaccgaccttgtctgcaccgcagcgcagcagtgagtcgacgtcctcgggcgtgcgtacgccgccgcccacagtcattgggatgaacacctgttcggcggtgcgggagaccacgtcaatcatcgtgttgcggtgggagctggatgcggtcacatccaggaaggtgatctcgtcggctccctgacggtagtattcggccgccagctccaccgggtcacccgcgtccttgaggttctcgaaatgcacacccttcaccacgcgaccggcgtcaacgtccaggcacgggatgactcgtaccgccaacgacatgcttcactcccctgttcggctttgcattacagtccttcagactacctaccgcccgttacatgcgccgcacctgtttctggaatatgagaatcatcatattgagcaccgacatggcagccgctcggcgtgagagaatggctcgtggaagttgtccgccgaatcaaggagattggcatggctgtcgaaaacagcaaggtactgatcatcgtcaacaactggggtatcgaggagaccgagctgacgcgcccgctgcgcgatctcaaggccgccggcgccaaggtgacgcttgccgccactaccttggacccgtgtgagacggtgcagcacgaccgctacgaaggtgaaacgctgaccccggacgcgcgcctgtccgacgtgcaggctgccgactacgacctgctggtggtgcccggcggcacctgcaatgtggatcgtatccgcgtcaatgaggatgcgatcacgctggcgcaggagttcgcgcacgaaggtaagccgatcgccgcgatctgccatggcgcgtggctgctggtcaacgcgggtctggtggctggcaagaccgccgcgccctgccgctatatcgccgctgatatcgagaacgcgggcggccattacgtcgacgagcagctgcacgtggacgacgccaacggcttcaagctcatcacgtcccgcaagcccgacgatctggactacttcgtgggcgcaatcaaggatgcgctgaagtagctaccgctccttggcagcgagctggccgcaggcgccgtcaatatcctgaccgcgggtgtcacgcagtgtggcggtgatgcccgcgcggtgcaggatctccaggaaccgctgttcgtcttccggcttggaggcggtccacttcgagccctcgatggggttgagcggaatcgggttgacgtgggcccagttgtcgccgtaatggttaagcctcttggccagcaactgcgcatgctcggcctggtcgttgatgccgcgcatcaacgcgtattcgatactgacgcggcgcttggaggccagccaataatcgtgcgcggcatccaacacctgcttggtattgaaacgcttgttcatcggcaccagctcatcacgcagttcgtcgctgggggcatgcagggaaacggccagacgcacgggaatgccttcggcagtgagcttcttgatgccggggaccacgcccaccgtggatacggtgatgttgcgcgcggaaatgccgaagccttcgggaggcatggcggaaatctgtcgtacggcggacagcacggagttgtagttgcccatcggctcgcccatgcccatgaacacgatgttgctcaggcggccctctcccccggccacttcgccgtcgcgcatcatcttggcggccacacgcacctgttcgattatttcaccggtggacatgttacgggtcaggccaagcttgccggtggcgcagaacgggcagtccatgccgcagccgacctgcgaggagatgcacagcgtggtgcgggtcgggtatcgcataagcaccgattcgatgagggagccgtcgaacagcttccacaaggtcttgatggtggtgccttcgtccgccacttggcgggtcacctcggtgatgagctgcgggaaaaacgcggcggcggcctcgctgcgcttggctgccggaaaatcagtgaattcggcggcattcacatcgaaatggccaaagtaatggttggcgagctgcttgactcggaacttcggcaatccgagttctgccgctttctcgacgcgctgctcgggcgtcatatccacaaagtgcagcggcggcttaccacggcgggcatggtccttggatagcacgtcacggaaggcacctgatgtgccgccgggagtaatgccggtttccggagtgtcaggatgctgtgtggtcatgatgggttcgcttcgctctcaatatcagaaaatagtcaaacatgcaatagtaatatcagaatccaccatacggcgtgccgcatacgaatcagatggcccatgtcttagcccatagcgaacgcatattgaacgatgatttccccatatatggtatgtggcaccgtgcgatatacacacgatgccacattgttcatgcacgagacatgcgaatcacagtccggtgatccacagcaaggcgcaggtgaacggtgcactcatcaaaatggaatccacacgatccatcacaccgccgtgccccttgagcagatggcccatgtctttgataccgatatcgcgcttgagcatggaagcacacaaatcaccgaacgtgcccacggcaccgatgagaatacccgccacgatcggcacccaccaacgagtggcccatttcgaggcatcatacgtgcatgcgaatacggcaaatgcgccagccatggcgaagagcatcgagccgacaaggccctcaacggacttcttcggcgagatgcgcgggctgagcttgtgtttgccgagccaggcaccggcaaacaaaccgcccgtatcggatagggcgggtaggaacaccagcatgatggcgtgtgcaatcggatgcccattaaaagtcagtgagatgatgacgcagctggccaacaacggaatatacaacacggtaagcacggacacagccacatggctgagccgggaatgatgctgttccccgccctcatgattaaacgaggattcgaggcgcgcgctggcatccgtgttggacagtttgccggcaaccgccagagataggcggttgccgacgctgatttttgcgctggccgcgatggcgaccagaataatcgacacgatgatactcagcgacatcgtgatgagatggtacggggaatagtaggtggcaatgagggtgaaggacgagcacagccacagcataaacaccgggaggtgcaggcctacggtggcgaagtccaccctgagctcccacagcgccagaatcatgaacacgactaccagcagcacgaagaggtcgacgctgagcagcaggcacgcgacaataaggatgaccagtgccgcgcctgtggcgatggcctgcggcatgttgcggccggtcttcttgttgatctggtcgagcgtctcctcggcctcttcatggggttgttcgttgcgttccataattctccggacctggtctgaatcagacctccatgatctccttctgcttggtctccagcagagtatcgatctcgtcggtaacggacttggtgaccttgtcaagatccttcagcaggcgatcgccttcgtcctcacccatctcgccgtccttgacggccttgtcgatggtttccttggtcttacggcgaatgttgcgcacggcgaccttgccatcctcggccttgcccttggcgagcttgacgtattccttacgacgatcctcggtgagttccggcatggtcagacggatgacgttgccatcacggttcgggctgatgccgagatcggagttgcgcagggccttttcgacggcaccggcctgggaagcgtcaaacggggtgacggacagggtgcgcggttcgggaacgccgatggaggcgacggccttaatcggggtgggggcaccatagtagtccacggtgatgccgttgagcagggccgggtttgcgcgaccggtgcggatgccggagaagttttccttggtgttttccacggtcttggccatctgttccttggcctggtcgataagagacatattcactccttgtgtgttggtgttcgtcagtgttgttcgtctatgaacgcttgattcgattgtgggcgtttgcggcttactcggccacgcgcgattcggcggtggagaccagcgtgccgatttcatcgccgacgagggcgcgggtcacgttgcccggctcttcgaggccgaagacgcggatgcgcttcttgttgtcgcgggccatggacagtgcggaggcgtccatgacggccagattgtccacgagggcgcgattgtagctcagggtttcaaaacgcttggcgttctcgtccttgcgcgggtcggcggtgtagacgccgtcgacgccgttcttacccataagtacctcgtcgcagtggatttcgagggaacgctggatggaaaccgtgtcggtggagaagtacggcatgccggcaccggcgccgaaaatcaccacgcgacccttttcaaggtgacggatggccttgagcggaatatacggctcggcgacctgtcccatggtgatggcggtctgcacgcgggtggcctgcccctcctgctccagaaagtcctgtagagcgaggcagttcatcaccgtgccgagcatacccatgtagtcgccacgggaacgatcgataccggcctgctgcagttcggcaccgcggaagaagttgccgccgccgaccacgatggccacctgcacaccctgttgtacggccggaacgatctcctcggcaatgcgacgaatcacctgggtatcgatgccgaccttgccaccaccgaatgcttcgccggacagcttgagcagaactctgcgcggattgtcgctatcagtcatattgtgcctttctcaaaaccgaaagtgcgaaattatccgtagacaagcgtatcggtttacgacgacaccccctagcaacgacacccttggaatagcgaaacgccatccgattattgaataaccggatggcgtttcgttgaaattacgctaagcgcgtggagtaagccttaggctcactcctcttcgcccttgccgacctcgacacgagcgaatgcggtggcgttgccaccgacttccttgaacaggtcgccgacggtcttggacgggtccttgacgaacggctgctcaagcagcacgacttccttgaagaaagcgttgagacggccttcgacgatcttcggaacgatcttctccggcttgccctcggccagggacttctcggtggccacgcgacgctcggactcgaccacatcggccggaacgtcctcgcgggtcagccacttggcgcccatggcggagatctgcagagcagcttcgtgagccacggcggcgccggccttgtcggtggcgatcatggcgacgatgctcggcggcatctcggcggacttcttgtgagcgtagacttcgacgtgctcgccggagatcttggcgaactggccgaccttgacgtgctcaccgaacagggcggcggcctcttcgacagccagcttgacggtggtgtcgccagccttggcctcgagcagctcgtcagcggagttggcgtcggcgtccacggcgtagccgagaacttcctcggtgaactcgacgaacttcggggtcttggccacgaagtcggtctcggagttcagctcgacggcgtagccggtctcgccattggcggtctcgacgaccttggaggcgatggtgccttcctgagccttgcggccttcacgcttgccggctgcggcgatacccttggcgcggatgatttccttggcgcgggcgacgtcgccttcggcttcggtcagagccttcttgacgtcgagcatgccggcgccggtgtcttcacgaacctgcttgatcagtgcggcggtaattgctgccattgattattctccttgagaaattttgcttacccgtgaacgatgggaagcgcttattcaggcacttcccatcgtagagcatcactcggccttgggggcctcggcggtttcgccctcggcggcagccggagcggcggcttcagcggaagcctcggcaggagcctcgttggtcaggagttccttctcccaagcggccatcggctgctcggcggcttcgccctcggccttgttggcgccggagcgctccagcagaccttcggcgacggcgtcagccatcaggctggtcagcagttcgatgccgcggatggcgtcatcgttggccgggatcgggtactcaacggtgtccgggtcggcgttggtgtcgacgatggcgacaaccgggatacccagcttgtgagcttcctcaacagccagggcttccttggtgatgtcgacgacgaacatcgcggacggggtgcggttcatgttgcggataccgcccagctgcttgttgagcttgtccttctcgcgctcgagcaggaggagctccttcttggtcaggccggagccgtgcacgtcggtgaagtccatttcctcaagttccttgaggcggttgacgcgcttggagacggtctggaagttggtcagcatgccgccgagccaacgctcggagacgtagggcatgttcacgcgggtggcctggttggcgatagcttcctgagcctgcttcttggtgccgacgaagagcacggtgccgttgtgggccacggtggtcttgatgaagtcatacgccttgtcgatcatgtcgagcgacttgaacaggttgatgatgtggatgccgttgcgctgggtgaggatgaactgcttcatcttcgggttccaacgacgggtctggtggccgaagtgcaggccagccttcagcatatcgctcatagtgatctgagccatggtattactacctttcattgtcggttcttgcctggccatgcgcacctgcgtgcagctgctcccccggtttcacgagttgtgcagccgaccgacacaagccgtcgcgagcatgacgcgaatttgttgtgtgccggttgacaatattgggtggctctggacaccagcgactgcgtccgttgccgggtggcacacgagtttcgagaatagcacggagccggtactaaaaaaaaacaggctcccctctctgaggggagctgtcgccgtaggcgactgaggggagtcacgggcggtaccggcagaaccaccctcagtctcactacgttcgacggctccagccagcgggagccgagtatggactacttcgcctgacgattgcgcatgtagcgcagggcttcgcggcgttcttccttttccaggcgatccaaatacacgtggccatcgaggtggtcgcattcgtgctgaagcatacggcccatcagcccggagccctcgagcacgacctcgttgccgtccaagtcgatgccacgcacgcgagcgtagtcggcacgacgggtcttgtaccacaagccgggcacggacagacaaccttcatcgccatactgctcgccggacttctcctcgagtacggggttcagaacgtagccgaccttgccgtcgatgttgtaggagaaggccctcaggctcacgccgatctggttggcggacaggcccgctcggcccggatcgtccacggtttccaacaggtcgtcaaccaggcggcgcacggccggggtgatttccttgatctcatcgcagggggtgcgcaggactgggtcgggcacgaccctgatctcacggatggccacttctcgttactcctcattcttctcgtcagccggctggtccggcttgctgccggtgtcagcggcattgtcagcggaatcgccggtctcgccctcttcgggttcggccttcgacttcttgatcttctccgacacgctagcaatcgaatcagacacgctggttttcatctgttccgaggcctgtttgacctgttcggacgcctgcttgaccgattcggaggatttcttgacggtctccagcgtgctgtcgatgatcttggcagtggcgggcagcggcttgttggatggcttgggcgcgtacagatcctcctcgatgacggtggcgtagcgctgcaataccttgggacgcaccactttcatgctcggggtgagtgtgccgtgctcctgactgaattcctcatccagcaccgcgaatttgcgcacggactcagcgcgggagacattggcgttggcctggtcgatgtactgctggataaaggcgcgcaccgcgtcgttgtcgctggcctcggcgagtgtcatgtcggcattgaggccctgaccttccagccaggaatgcagcatttcggggtcgagctcgataagtgcggacacgaacggcttgccgtcgccgactactactgcatgagccacgatcgggcaggtgtcgatgacatcctccatcggggcggggctgatgttcttgccgccggcggtgatgatgatgtccttcttgcgtccggtaatgaaggtgaagccgcggtcgccgatacgacccagatcgccggttttgatccagccgtcggcagtcatcgtctgtgcggtgagttcgggctgcttgtagtagccaaggaacacgttcgggccggtcagctcaatttcatcgtcttcgccaagacgcacgcccatgccaggcccaggcttgccgaccgaaccgatctcgttgtcgtcctcccaattgacgagcatcggagcggcggtttcggtcatgccataaccctggatgaaggtgatgtcattcatgccgttgaaaaagtgggccaaatccacgttgagcggcgcaccaccgcaggccagccatttgaggttcggtccgagagcggaacgaatggatttgcccaccgtggccatgtagaacgaatggcgcatgcgctcgatgaacgaatggccgcgaccggcctgctcatccttgctccacttgacgaagtgcttgaccgactgggcgaagatatgcccctggatgccggcaccagccttctgcgaggccgcgttatacaccttctcgaacacacgtggcacgcccagcaggtaggtgggcttgaagctgcggatatcggcgagcagtcgcttggcgtcgggaatgtatccgaccacgccgcagccaccgatgcacacgtactggatgtagcgggcgaagcagtgcgccagcggcaggaacagcagcagacggttgtcgtcgtacagcatgccacgcagaatctcgtagccgttaagcacgatgtgcgtgtaattgcggttggagagcatcgcgcccttgggcttgccggtggaaccggaggtgtagaccacggtgagcagatcatcggctttgatacgagcgatagccgcatccaacgtctcatcggatacgccatgcccgaagtcaacgacagcgtcaaggccatcggccttgaaattgaacacgtatttcatgcccggatgattgacacggatctgctcaagcgtctgtgcgcgctggaagtcgccggcaaaggcgatggcgggatcgacttcctcgacgatgcccgcggtctgacgggcggaatcggtctcatagacgggcacaaccacagcgccgattgccgcgcaagcgaaatcagccacaccccactcatagcaggtaggcgagtaaatcagcaccatggtgccggctttgacgccaagtcccaacaggcccttggccacctcgcgtacgcgggacagcatttcagtagctgtggcgctgcgccattggtgggtgttgtcatcctgccattccgcgatgatgtcatccggcgtgcgagctgctcgtttggacagcagcgagtagacggtgtcgtcatcggtggtgacatatctgggttcttctacatgttcacgcatggtcactactataggcgaaccagcctatgacacggcagaaccgtcttccgctaccagcgtaggaatcggtgtgcgggcggggccgtctggtcagcccaaatcggcatagatgcacatccatcgagaaccgatgtacttcagtttgaggttgactcgcagattttcctggccgatggtcatgaataccgccatttccagcgtgtccttgccggtgatcatgccgtcgatcaatgtggggacagtgggcagatagcagaatttcgctttgagctccggatgagtgaccatgtggatgccgagcaggtattgcatggtttgcagccggtccaggcatggttttgtcatggctctgttgagatgtgcgacgctgagtttgccacgtatcgcgtccgccgatgtgcaggcgatgcggcatgcagccatggccatggaatgacattccttcgcattcagcccgcctatgaatgtgggttggatgtgataccgcaccgggcgatccgacagctccacaacgatgaatccgtcataactcggcaacggcccgtactgatatgtgccgtggaaaaatcccgaatactccatgatgacccccttcaagcccccttgcaactcaccatcatcggcgagcgtctgtgctacaacatcacgaaaggcgcgccaagtcaaactacttgagcgcgccttcgggcaagttaagcctcctgcatggagggcaaacccccattttcagggggcaatcgggattatcgtgcggaatacgggttgaccaccatgccgcaacgctggaagttcttcacgtcgacgtagccggtggaggccatcgcgcgcttgagggcgccgatgaagttggtcttgccgtccgcctggtggctcggtccgaacagcacctgttcgagcgggccgaccgtgccgaccgtggtgcggtagccacgcggcagcgtctggtggcgggcttcggaaccccagtgggtgcccttgccgggggcctcggtggcgcgggccagcggcgcgccgagcatgaccgcgtcggcgccgagggccagggccttgacgaagctgccggagtcgcccatgccgccgtcggcgatgacctgcacgtagcggccgccggattcgtccatgtagtcgcggcgggcctcggccacgtcggcgatggcggtggccatcggggcctgcacgccgatggtctggcgggtggcggagaccgcgccgccgccgaagccgacgagcacgccggccgcgccggtgcgcatcaggtgcagggcagcggtgtagttggatgcgccgccgacgatgacaggcacgtcaaggtcgtagatgaacttcttgaggttcagcggttcctggccggaggagacgtgctcggcggagaccacagtgccgcggatcacgaacaggtccacgcccgcgtccaccacggtggagtagaactgctgggtgcgctgcggggagagcgcgccggccacggtgacaccggcggcgcgaatctcgtgcagacgttgcgtgatgagctccggcttgaccggctcggcatagatctgctggatacgctcggtggcctgatcggccggcagtccggcgatttcgtccaacagcggggtcggatcctcgtaacgggtccacagaccttccagatcgagcacgccgagcgcacccatcttgcccatggcgatggcggtggccgggctggtcaccgaatccatgggggcgccgatcaccggcacatcgaactcataggcgtcgatctgccaagaggtggagacgtcctcggggtcgcgggtgcgacgggaggggacgattgccacatcgtcgagtgcgtagccgagacggccttttttgcccaaaccgatttcaatttcctgagacatggtttccagcctattgcccgggtgggacgccaacaaggccgttcccacggaccggacgactgcttcaagtcgttacaaacatgcgctatgactaaatcatcttcacaccatctatcaggaggaagcatggccaaaatcaaggtcgaaggcactgtcgtcgaactcgacggcgacgagatgacccgcgtgatctggaaggacatcaaggatcgtctgatcctgccgtacctcgacgtgaacctcgactactacgatctgggcatcgagcaccgcgacgagaccgatgaccaggtgaccatcgacgccgcccacgccatccagaagcaccatgtcggtgtcaagtgcgccaccatcacccccgatgaggcccgagtcaaggaattcggtctcaagaagatgtggaagtcccccaacggcaccatccgcaacatcctgggcggcacgatcttccgcgagccgattgtgatgagcaacgtgcctcgtctggtgcccggctggaccaagccgatcgtcgtagcccgtcacgcattcggcgaccagtacaaggccaccgatttcaaggttccgggagccggccagctgaccgtcaccttcactccggacgatggctccgagccgattcagcacgtggtctacaactacggcgaagacggcggcgtggcccaggtgcagtacaacgtcaacgattcgatccgcggtttcgctcgcgcctgcttcaactacggcctgatgcgtcattacccggtgtacttgtccaccaagaacacgattttgaaggcctacgacggccagttcaaggacatctttgccgaggtgttcgagaccgaatacaaggacaggtacgccgaggccggcctgacttacgagcaccgcctgatcgacgacatggtggccagctccctgaagtggcacggcggttacatctgggcctgcaagaactacgatggcgatgtgcagtccgactccgtggcccagggcttcggttcgctgggcctcatgacctccgtgctcatgaccccggacggccagaccgtcgaggccgaagcggcgcacggcaccgtgacccgtcactaccgccgctggcagaagggcgagaagacctccaccaacccaatcgcatccatcttcgcgtggaccggcggccttaagcaccgcgccgatctggacggcacgcccgaagtccgtcacttcgccaagacgctggagaaggtcatcgtcgacaccgttgaaggcggtcagatgaccaaggatctggccatgctcatcggcccggacgaaccgtggctcgacaccgacggcttcatgaatgcgctggacgagaacctggccaaggctctggccgagtaaatcatcgaacacatcgtgcggacctacatgggtcatgtcatgtcgcaaactgtcatgattgtcgtgcttcatctggaatgttcctcagcacgataatcatgacagttgttcgatgcacgcacgtaatacctctaattgttcccggatatgtggcgatttgtccactggtccgggactttttcgtatacggcctactagaatcgtgattcagcttgttttcacgcccgcttgaggaggtttcgccgcttatggtgttcgcacgccgctcaaccaccctgctcgccgccattatcgcatcctgcgcgatggtgctgtcactgaccgcgtgcacctcagacaataagaccgttgtagatggtcaaaccacggtgacgtccaattctgccggcggcgtggccgtgttcacaccttcggacggcattacgctgaaccagcagacgccactgaacaaatgggcgaagctggtgcctgacctagccaaggctctggccgacgccggtttcaagaaaggcgatatcgatcatacgacgtccgactcgttggccaagcaaagccgcgccatccaagactttgtggtcgatcatctttcgaataacaccacggacgattccggcattgccatcgcgcccgacaacatgacattgctcgtggctccagtagtcgaggccgacgcttccactcgccaatacggcgattacgtgagccagaacctgagcaccaacgatgccacggatggggaagctacttctgacggtgaatcttccgaagacgactcgtccaaagacgattcgtccaacactgagagcgacagcactgcatcggacgagcaggcgcaggccgtggaccggctggtctcatcgctcaagctggccaaggaatccggcatgcatgtggtattgctcggcaacagtatcgagggatataagccggacgccttcgtcaagttctcggacgcccagaccatcggcaagctacaggcggaaaagatggtgtccaaactcaagttggataaggccagtaaagacaaccccaaatacattgaggtgctgctgccatacaccgccgtggacgaaaaaggcaacgccaacgattccacgttcgcccaagaggcgttccgtggtatctggcaggtactgggctcctactatcagaagggcgttgtggaaagcccttcaggcaccttggacggcaaatccacggaaaacgattggcaagccgtggcctacgatgccgctaaggaaggctccactgcgaaagtgcttgacaagcgtctggcaaaaaccgacggacagtccacactcacccgtattgacggcatcatcacgatgaacgactacatcgcctccgaggtcgtcaaggaattggacgatctgggatacaccggctctgccgccgatatcaatccgcagatcaccatctcgggcattgtcggcaatatcaccggcaagaaggatctcagccgcgacgccgtgccggacccgatcaaatcccctgaaaacgacaacgcaaacgactcatccagttccgatgacgatgcggacgaggacacctccgcttccgacaaggaccgtgactcgcagtggcctctagtaaccggatacggcgcgtatgtctcgaacatcccatccatcgtcaatggcaagcaatggatgaccggcatggaagacagacagaccatcgccacggatatcgctcaggcctgcgccaagctcaacaaggacgaagcgctgaattccatgccttcaatcaggaactccgaggtaggcggcgtgaagaagatcccgaccatcagcgaaccgttgctggctgtcagcgccagcaatctcaagtccgcgctgatcgaccccggatatatttccttggccgatgccggtctgtgattcatactcgtcacgccgctagccgcctgcgatgtctcttccgtacggccctgttccggccgacaatcaccgttaaatcatgacggtttcagtacgatttttcgactccccgcatattgctgtggatcaagataatcggccgttcctcgcttgaggccccaatgcaggcaacggtcttcgcaatggtccgagctgccttcaacgatgcctacgggctgtctgcgggagatcgtatcccccactgagagctcggtaacggccggttcgaatgtcgacgtgacacctccacgatgccgtacactcaccacatctttgccagctactttgccagcaaaactcacggtccctgcctgtggtgacagaattacggtaccttgctccgcaacaagatccactccacgatgacctggtgcccacgggttgatcggccgctcgaactgttgttcgacctgtggatcgtcgaccggccagtcgaatcgggattcgcactgattgccattgcgccacgccaaatcagacatatcggtgaaatcctccaccgtgtatgccgcatctccggtcaccgcagtatccgcatacgcaacatgctgaggcgtggatgccagccctactcccaaggcaagcagcaggccgataacggcggccaacgcgattatggcatccatacgccgttgccgttcctgagcccgctgacgcgcctgctgacgccgccggctggcacgtcgggcttcgtcgcgacgccaatcaaacaacagtggtgcattcatgagattcctccccatagtgtgagtgtgatgtgattccggcttctttgccggtgatacccaccttgaggggtccgaaacaggatgtccagccaaaacgacctatgtggttctagcttccgaagttatccacaatgaaatttcgcgtgacagtatcgccgcatcgtcatgttgttcgaccttcagccgcggccgatccatgtcacaaccgctgccatgcagtgacagcggaacatcagaactcttgtgattgttcccactgggttcgcatactcagacggttgttccgtttcaccgattccagtatttgccaagcagacaccagctcctcccgggggctgagcatttcatcagtattcgccgttccatagccagctcctctaccgttagtcgctagtgtatatccgtgttcggtttttggctgtatgagatagtattcgatgagtccgattctgcggaattcagcgcgacatgccctacacgcatgtaatttgctttttcgtggcaggcatgtaagatatgtgacttgtgcgcgagagaaatctcaaacacagctgacattcctgcgtagctcagttggcagagcatccgactgttaatcggacggtcactggttcaagcccagtcgcaggagctcacctgaacgggtaactccggccgggatgaaaattgaatattcctgcgtagctcagttggcagagcatccgactgttaatcggacggtcactggttcaagcccagtcgcaggagctcacctgaacgggtaactccggacgggatgaaaattgaatattcctgcgtagctcagttggcagagcatccgactgttaatcggacggtcactggttcaagcccagtcgcaggagcttccaaggccctcgcttcgacgggggtttttttgtatcccgcctcagcgcgaatgaggacggagtcgtccatgagtgcgtccggggttacgccaaggaaatcagcggtgccaatcaggtctgtgactgaccaaccagttcgccccaccattttctgagacattgagcctcgtgtgattcccagtgcgtttcccaggtccgtctggctttttccggatagaccaagataaacgcgaacgttcgatgcgatggcggcttcgatgcgctttccgtgctcttggctgaacggaaaagggcgcggccaggcaatacaagatcgtctcccggctgttgcgccgcaacgacgtggacctgctggtcaacgcatgcgacccggaccgcgagggcgaggccatcttccgccgcatcatccaccatgccggcgtcaacaagcccacacgccgcctgtgggtggcctcccttgaggaagaggccatccgccaggcattggccgccatgaaacccgaaggcgactaccgtggactcgctgactcggccatgatccgcgcgaaggccgactggctgatcgacatgaacgcctcccgcgcctacagcctcgtctacaacaccaggttcaccgtcggacgcgtgcagacgcccacattggcgatgatcgtggaacgcgaccggcagatcgaatcgcacaagcccacgccattctggaaggtcgtcgccccgatggggagctggaccctgaccggaacccatctcgaaaaccacgggaccgccgaagcattgctcgaaatcgtgaaccagccggacttcgccttcggaatctatgccgtgaaacgccaccgccagcacgacgcgccgccacgcctctacgacctgaccaacttacagaaggacatgtcgaaactgcacggcctgaccgcagcccacacactgacggcattgcaaagcctctacgaacagcgtctgacgacctaccctcgcaccgactcgcgattcatcacgcacgacgacctggacgccctacgcaaactcaccaacggggaccggctggcctccgggttccttgatcccgccgtccgtcccgctcagccccgactggagctgacggtgaacgacgcgaaggtcacgggccacaccgcgatcctgcccacgctccaggcaagcggggaaacactcggccaactcggtgatgacaaacgcctggtgctgacgcgcgtggttcgccgcatgtgggaggcggtggccgacgaccatgtgcatgacgtgaccctcgtcgtcgccaacatcgaccccgattacgatgaaagccatccgaacctcctacggatcagcgaagcggattcccgtttcaccagctgctccgaccagaccatctccctcggatggaagggcatcgaacccacgaagacccaagagcatgacggcggggaagacgaggaggacgccccggcgggcaacctcattcccgtcaacctcgccaccggagcgaacgccatgccgatgccacgcagcggagcccgactcgtggaggggaagataaaacctccgaagccctacaccgaggcgacgctgctcgccgcgatggaacacgccagccgcctcctggacgacgcgggtctcaaggccgcgctggacgacgacgaatcccattccggcggcatcggcatgccggccaccagggcagacgtgatcgagaaactgatccgatccgcatacgtggagcgcaagggcaagcaactacgctcaaccgaacaggggcggaatctgatcaacgtagtggcgctccgcctgaaggacgtggctctcaccgccgagatggaacaggtcctctccgacgtggaacacgggaacgccgacccaacgcagaccgaatccagattccgggcattcgccgccggtatccccgccgacgcgcagtccacggcagagcccgagctcgtgcaagcgaggcgaagccgcgtgacggaatcgttcggcccgtgcccgcgctgcggccagcccgtcgtcaagaccggcaaggtctggcaatgctcgaccaacaaacgagagaaacaaccggacggcacatggaaggatgcgggcggctgtggctggaaactattctccaccatcgcgggcaagaccctcaccgacgcgaacgcgcgccgtttcctggccgacggacggatccgccttaagggattcatatcgaaagctggccggaaattcgacgccatgctcatcctcgacaaggaaggcggcgctcggttcaagttcaatgacaaataacagagggacagccatgtctggtcaagcagagtatgaccggggtcgtctatgtgactgatgaaatcaacatcatcgggtgagtttcgtcgtatggttgctgcttcatggagtcaaccggcgcgggcaagcatagtgtgccactggtcggaatggtgatcggcgtggctgtctctatagtgcctaagcattgggatttcaggtcatgcggctgcctttggaataggtgatttgccgaccttgaaggttataattcccctcatgggtaagaggagcaaaatcgcagctattgatctgttctgcggaacgggaggcctgtccctaggcttgaagcagggcgggatacgagtcgtcgcgggaatcgacaacgcttcagcctgctcatacccgtatagccataacatcaaggcgaagttcatcgagcgttccgtctgcgatgtgaccggcgaggatctgaagcgcctgtgggggcaagcggatgttcgtctcttggccggctgtgcgccctgtcagcctttttcctcgcagcgacgtggcgcggacacatcccatgagaaaagctggccgctgctaaatgagtttgcgcggctcgtgcaggagaccatgccggatttcgtgacgatggagaacgtcccgcgcgtccagtattcgccgatcttcgatgaattcgtagcacgcctgaaacaggccggctacgatgtcacgtatcgtgtcctgttcggccccgactacgggcttccgcagcgccgtcggaggctggtgctgctggccgcattaaacgatcatattgagatgcctgagccgacggtgggagcggaccggtacagaaccgtgtatgacgccatccacgacctgccgtccttggaagcagggcagaaagacgatgacgactccctgcatttcgctcggaatctttccccgaccaatctgaaacgcgctcatgcctccaagccgggtggaacatgggaagactggccggaggagttgagagcgccctgccagacccgtgattcaggcaaatccttcaaatcgttctatgggcgaatggaatggaacaagccctctcccacgatcacgacgcaatcctataatcccggagccgggagattcacccacccggcgcaggaccgtgcgctcacgcttcgggaggcgtcccgccttcaaggctttccggattcattcgtgttcaccggaccttcggagaagatcacgttgagcaccgttgggcgtctgatcggtaatgcggtgcctccggtgtttggcaaggccatagctcggcagttcatcaagacattggatgataggaaatagtgataatgagtgacgaatacactttgacggtcgatatggcgaccgtggactcactgggacgaaacctgtattccaatgcggcggccgtgttgtccgaattcgtggccaacgcttgggacgcggacgcgaacaacgtgagcattgactacaagccggatgaaggctctggcagcatcaccatcactgatgacgggtgcgggatggacaccgatacgctcaattctcgtttcctgaccgtcggctatcaaaaaagaaaacgggaaggcgatgaatcgttccgtttccacagaaaatacatgggacgtaagggcatcggcaagctgtcagccttctcccttgccgatatcatgcaggttgaatccaaaagagaaggcgcggaggccaggggattcacgattgacgttgcccgattggatgaagcgatcaaaagctcggatccaaacgaacgccaataccacccggctcctatcagtcgggacggattgacgttgaacgactgtgagcatggcacgaagatagtcctgacgagtcttcgacgtaaacggatcggcctgaccttggaagcgttgcggcggcgtatcgctcgtcgcttcgacgtgcttgatctcgctgataaaagcgaggaagagggggcgtttcgtatcgtcatcaatggaaaacccgtcacgtatgaggatcgcggagatctgcagcggcttgagcacatctggtatctgggcaatttctccccctcgaaagagcagcagaacagcataaaagccgaacatcaccgtgtcgaggatgtgtcgttcgacggacatcctggctggaagttgtcaggatggattggaacggtccgtagaccgtctgacagagccttcagcgacgacacggaaagcatgaagaacattatcgtcatggcgcgtaaacgtcccatccaggagggactgctggatcatctggacttcaatagaaattttgccagctatgtcacaggtcaggtgcaggcggattttctcgatgactcccagcaggatgacatcgcaacatctgataggcagcgattggtcgagtcagacgagcgagtcaaggctttcaacgagaagatgaaagacatattcaatcgggcctctgatgaatggtcccgtgcgaggagtgacgccaacaccaagaagttgatggctgatatcccagaggttgccgcttgggtcgactctttgacagaggggctgaggaagccggcacgagatttgattgatcgggtttcgcgtatcaacggcattccagaagccgaccgccgttcactgtatcagtcatcaatcatggccttcacccgactggttcaacgggacgacatcgagaaactgtaccatgtaggcgagctttcgacagaacagctgcttgctatattgacgtcttacaaagactacgaaaacatggaatacgcgcaggtcgtgcgtacgcgcctcgaagtgatagacaagttggaatccatgttgaaagccaatgagcttgaaaacgccacgcgtgacttcgtttcggacaatccttggcttctcgatccagcatgggagcgcgcaacgcgcaacgctgagaaggaaaaagcgttccggacaataggcgaagaagaatacaaactggacttttcgtcggattcggagtcgaacagccgcgtggatatcaaatatctgacggctcctgaccgtgagaccattgtggaattcaaacgctatggtcgtgatatcaagatagaggagatacgagagcaggtatggcgttatgcggaggcgatgactcggattctggaaaaggacgatgcccggaccgaccgagccgagggaagaaagaatgcgtccggcattgacgagagagtcaacgttctcatcatcgtcagacgggtgcttgacaaccgtggcaagccgatgtctccgggagcggcgaacgcgcaagtcgaaatgttccgggcaaaattcctgtatttcagtgacatgctcgctcagagtcgtgaacgctatcaggaatttgtcaagggcgtttcccaaaaagactatgccggagaagcgatccaagccattgaatcctccggtagcgctggcaacgccgagaatatctagcgatgccggctcattgggcatagctgcgcttttcccataagaaggaagagctcgtggcatatgccgagagtagagcgatggctaatctttcccacgcgcagtgagcataggacagaactcgtattagtcttgtagatatgagcaagtccatcgcgcagatccgtaacgaggctgctgccgctctttccccggagcggaagcagcagtgggagcagtttctgacgcccgcccctgttgccgagcaggcggccggactgttcactcctgccgttgagcccgtgcgtatccttgatctcggttcgggcacggggatcctagctgcaatggtcgccgcgcatgcgccagccggcagtggcgtcacagccatcgaacaggacaccgatcttgccaaggcgtccgaggtttcgatccgacaggtctgtgatgatgtcgaggtcatcgccaaatcggtgttcgatgtgttgctcgatgacagattcgatcgcgtgattctcaacccgccgtataagaagatcagtcccgtaaccattcccactgccagcggcggcgtgaagatcaccaacctgtacaccgcttttttggtgatcgctatccaggcattggccgaaagaggggaatgcgtggccatcattcctcgttcatggatgaacggcgagtatttcaaggacttccgcaaatggttgctcgacgaatgcagccttgacgttctggccgtttacggctcgcggcaggaccacttcaaggacatggacatcctccaggagatcatgctgctcaaagtgtccaagcgaaagcaaatcggttcaatcgccgtttatgacgggatctccccggagattccgttgggccggcagccgcacgagcttattccgttggaggcgctgaccatgggtagggaccgcatcctgcgcgtcgaacgtcaggatcctcggctctcccgattcaagaccttgtccgagcaaggtatgtgggtgtccaccggcaagctcgtgtggttccgcaaccgcgacctgctgtcggccaccgagaagccgggaagccaccctttgtattggtccgacaaccagcggggcatgacgaccgtgcatccggtcaagtgcgacagagaacagtgggtcacgggcaaggcggattcacgcaacgttgtgctgccctcgggcagctactgcctggtcaacaggttctccgccaaggaacaacggcaccgcatctacgcctcgtatctgcgcagcgatacggagtacgtggcggacaacaagctgaactacgtccaccagggcacctcccgccggacggtgccgttgaacgacaaggtcgcgcgaggcctgaccctttggctgacgtcaagcatcgttgatgaatggtaccgccaggtgtcgggcagcacacaggtcaacgccaccgacctacgccagctgccgtgcccatcaccggggcagctggcagaactatccgacctgctgcccgtgaacgacgcggtggaccagcaaagcattgaccataccttggagggaatgttctcatggacaaaagccagctgatcgaggaagccatcgaagcattgcgtgacttcgaggtcggcagggaacaacttaacgagcgaagcgccatgacattgctcgcgctcctacaactcaagcccggcgacgactgggcccgggccactaatcccatgctgggaacccgtgccatcatggactggatccgcgaccagtacggtgttgaatacgcagcgaacacgcgagagaccatccgacgcttcacactgcaccagttcgtcatcgcgcaactggtcgaggagaacgccgaccgaccggaccgacccatcaactccccgaaatggaactaccgcgtgaccgacgaagccttggaagtgcttcgtcattatcgcgaaccgagatttgaatccgagatcgaacggttcctctccgaccacctgtcctaccgttccttggtcgaggagcgacgccacatgcccaagaccccggtgcatcttccctcgggacaggaacttgaactgtctccgagcggccagtcggtgctgatcaagtcgatggtcgaggaaatgctgccacgattcgctcccggatgccaagtggcattcattgatgacaccgaccacaagcacggcgtcattgacgcagatctcctcgacgacctcggcatcagtctcaaggcaagggagaaggccccggatgtcatcgcatgggacgagcgcaggagatggctgttcctcatggaagccgccagcacgcacggaccggtggacgtgacccgcaagaacgagctgcatgatctgttcgcggaccagtggaacgatgcagtgctcgtctcctgcttcccagaccgacgcaccatgcaacgctacctcgcccaactcgcatgggagaccgaggcttggtgcgccgacaccccggatcatatgatgcacttcaacggatccaggttcatgggcccatacggacgctgatcaggaggggagcaaggcgtggcaatgatcatgtgtccggattgcggaaccagtatctccgacaaggccttaacatgcccgtattgcggttatgcggggaacgatccggccacgccgatagcggaccaatccatcggatacgaagtggtcccgcgcatcaagatgagcatagaacgctgggatcccaagtctcgttctctgacggaggaaacgtcggagatgccaatccaggcaagaagggccgtggcaagatggctggggtctttgaaggactgggagtctctgcaagtcgtcgctcccgccctagtgggcttcgtcaaggaattcctcggcgatgacaaagtgcggatggtcgccgatctgccagcggagatcatgaggatggtcaaggagggcagactgcgcttccgtccggactccgagggacgcatcatgccatttgtctacgatgacaagggcatatacaagcaggttcgtctcaatatggagaccgtgccgccggacgtgaccaatgccatgcgtcaattggagacgcaggcggcgctttccatggtccttgccgaggttcgaagcttgcgtgatcagttggagggcatcaggatcgggctgcagaatgatcggcttgctttggccgagggcgcgtgggacaagctcatgcaggccagggaggtcgaggattcgcggctgagggatgctttgatcatgcaggctctttcctccgccaccgatgcaaagcgcacattgatgcgtaacttcacccagaacgccaattacctgattgagcagtcggacatcgatctgaatcggaacccgctggcgcttgtgagacgtctgggagaatctctcaatggcaacgaacatatacatcaggcggctgccgatgcgttcgatgacctcgtgcagatcacgaatgtagtgcgtgtggagggcgagggatattcgatgcttggccaggaacgtgccgcccgtgcctgcctggatcagttcagcgaattcatcaaagcgaacggactcgatgaggatacccttctcgtcatcgacggcggacttccatccgagaggaagatgccggaacttgtggaccagttcgcagagctttccaagagaatctcgctccttggcggcatgtctttggagcaaggcattccgtcgggattgctcgaaccctataggcctcgaccggatggggcctctgcgatcaccgataaggaaacggaagatgaacccattcaagaagaagactgacgtggaatcccgagccgcttcgtcatccgagcaagctctttgctccgtgtgcaggcacgcgataccggagtcccgcagggaattgggactgtgcctggattgctccacgaaaaaggatcgaaacaaggcggtcctggccgttggccttgccggcggtgcccttgccgtcgccaagaaatatggtcctaaggtcgtcagcaaggtggggccgttggttgtcaacgcggtgaagaagatattttgacaccaaatgaactgtcggttttcggtatgccggtatttacctcatatccggcatgccgaaaactgcggtgagggtcatcaggatgtctagcccccgaacgtgaggccctgcatggttttggccggcatgaacgcggtcacggcctccctctgtcggcattccgacacgtcggcccttgtcgtggcttccacggcgtcgcgcatgaggtcggtgttgatcccgatgtagcgcatggtcgtgctgacgctggaatggccgagcagttgggacaccagcagcatgtcgcagccggtgcggtagtaggcgaaggtggcgaacctacgccgcaggctgtggctggggaacgatgtggcctccttgatgcgggtaccgacgtaatcccgcaggcgtggccgtcgaagcgtccggggaagatccagtcgccgccgcgccggcgtatcgctcgggcgagttcacccggcacaggtaacacccgctccttgatgtgtatttcgtcaagtcggtgtttcgtgtttagtcatgtatttttttcgggtttagaactgttagaattacaggaccaacaagggtgttgcacttctaaatagacatcggggaaagatgtgagacctgcattgcgacaatcgaacagacgccgagcggctatgccgcgaggtaatacgaacggcatgagcgcgacacgcgcgaactccactgtcccacctcaatgcttgaataaacaagttgcctgatttgggctcgcaaattggaattaaaaaagcgagcgcgggccgggagccacttcaagtgaagtgacagccggaaaccgcgcactgatgtcggatgaccgccagaggacgtatgtccaagggaggccatgcgcgccggtgccctagaagcaggttggtaaacagtacaacgaacatcgctagaaagggcggacggcaatggcgggacagaaaatccgcatcaggcttaagtcctatgaccacgaggtcatcgaccaatcggcgaagaagatcgtcgaaacggtgacgaacgcgggcgcaactgttgttggccccgttccgctgccgaccgagaagaacgtcttctgtgttatccgttctcctcacaagtacaaggattctcgcgagcacttcgagatgcgcactcacaagcgcctcatcgacatcgtggacccgacccccaaggccgtggactccctgatgcacatcgatctgcctgcggacgtcaacatcgaaatcaagctgtaagggaggaggaagcattatgtctaatcgcaaggctctgctgggcaagaagctcggcatgtcccaggtgtgggacgagaacggcttcttcgtgcccgtcactcttgtcgacgtgtccaccaacgtggtgaccgctgtgaagaccgaggaatctgacggctacaaggctgtccagctcggctacggcgccatcgatcccaccaaggtgaccaagccgctggctggccactttgccaaggccggtgtcaccccgcgtcgccacctcgtcgaggtgcgcaccgacgacgtcgatcagttcgaggccggccaggaactggccgctgacctgttcgaagagggtgctgaggtcgacgtgaccggcaccaccaagggtaagggcttcgccggtaccatcaagcgttggggcttcaagtcctaccgccgtactcacggttctcacaagaacgagcgccgtcccggttctgtgggcgcatgcgccactccgagccgtattctcaagggcaagcgtatggccggccgcatgggtcatgtgaccgccactacccagaacctgaccgtcgtctccgctgatgtcgagaacggcatcctcgccatcaagggcgccattcctggccccaagggcggcatcgttctcgtccgctcggctgtgaagggagcctgataaaccatggcaaacgttactctgaacgtcaccgacgccaagggccaggccaccggcaccgttgaagctcctgaggctctcttcggcgtttccgccgaggatgtccaggctcacatcccgctgatccaccaggttgtcaccgctcagctcgctgctgctcgtcagggcacccacgccaccaagactcgtggcatggtttccggcggcggcaagaagccgtggaagcagaagggcaccggtcgtgctcgtcagggctccatccgtgcaccgcagtggtaccacggcggcaccgtgttcggcccgcagccgcgtgactactctcagcgcacccccaagaagatgaaggccgcagctctgcgctacgccctgtccgatcgcgccaacgccggtcgcgttgccgtggtggagttcggtatcaccgagccgtccaccaaggccgctgtcgccgctctggccccgattaccgcggacaagttcaccacggtcgtcttcactcgcgacaacatcaacgagtggctctccgtgcgcaacatcccgaccgttcacccgattttcgtcgatcagctcaacacgtacgacgtgattacctcgcagtacgtggtcttcaccaaggaagccttcgaggctttcgtggctgccaagaccgagccgaaggaggcctgatttagatggtcgctattcacaagcccgctcacgacgtgattcttaagcccgtcgtctccgagaagagctacgccgcttccgaccgtggccagtacaccttcgtggtggctccggatgcgaacaaggtgcagatcaagcaggcaatcgaagagatcttcaaggtcaaggtgacgaacgtcaacaccctcaaccgcgctggcaagaagcagcgcactcgcaccggtttcggccagcgcgcttcccagaagcgtgcgatcgtgaccgtcgccgagggccagacgatcgacatctttggtaactgaaggttagccgagaaaagttaaaggaagaactacattatggctatccgcgtttataagccgacgaccgcaggccgccgcaacgcgtccgtctcggatttctccgagctgactcgttctacgcctgagaagtcgctggttcgcaagaagtccaagaccggcggtcgtaactcttacggccgtatcacctcccgtcatcgcggcggcggccacaagcgtcagtaccgtctcatcgatttcaagcgttgggacaaggacggcgtgcccgccaaggttgccgagatcgagtacgatccgaaccgctccgcccgtatcgccctcctgcacttcgcagatggcgagaagcgctacatcatcgcgccgaagggcatcaagcagggcgacgtcatcgagaccggtgctcaggctgatatcaagccgggcaacaacctgccgctgaagaacatcccgaccggtaccgtggttcatgccatcgagctccgcccgctgggcggcgctaagatcgctcgttccgctggtgctgccgttcagctcgtcgccaaggatggcgcctacgctcagctgcgtatgccgtccggcgaaatccgcaacgtcgacgcgcgctgccgcgctaccgtcggcgaggtcggcaacgaggaccacgccaacattcagctcggcaaggctggccgcgcccgctggatcggccgccgtccgatcacccgtggtgagtccatgaacccggtcgaccacccgcacggcggtcgtacccgcggtggtaagccgccggtctccccgtggggcaagggcgaggttcgtactcgtcgtccgaagaaggcttcgaacaagatgattgttcgtcgccgtccgtccggcaagaaccgcaagtaagggagtatcgagaagatgactcgtagcatcaagaagggccccttcgtcgacgcccacttgcagaagaaagtcgacgagcagaacgagaagggcaccaagaacgtcatcaagacgtggtcccgtcgttcgatgatcacccctgatttcatcggacacaccttcgccgttcatgatggtcgcaagcatgtcccggtgttcgtcaccgaggccatggttggtcacaagctgggtgagttcgcccccacgaagaccttcaagggtcacgtgaaggacgacaagaaggcccgtcgctaaggataaggaatagaacatggaagctaaagcaatcgctcgtcacgtccgcgtgacgccgcgcaaggctcgccgcatggtcgacctcatccgcggcaagaaggcgaccgaagccgtcaccattttgaagttcgcccctcaggctgcggccctgccggtccgcaagaccctggagagcgccatcgccaacgctcgtgtgaaggccgacaaggccggcgagccgttccgcgagaacgacctgtacatcaaggagacctacgttgacgaaggtgtgaccctcaagcgcttccgcgctcgtgcccagggccgcgctgctcgcatcaacaagcgcacctcccacatcacggtcgtcgtggctaacaaggaaggagcccgctaaagatgggtcagaagatcaatccgtttggctaccgtctgggcatcactgagaaccaccgctccaagtggttctccgactccaacaaggccggcgaacgctaccgcgacttcgtgcttgaggatgatcagatccgcaaggagatgagcaaggacctcgagcgcgctggcgtgtcccgcatcgtcatcgagcgcacccgcgaccgcgttcgcgtcgacattcacaccgcccgtccgggcatcgtgatcggtcgtcgtggcgccgaggctgaacgcgtccgcgccaagctcgagaagctgaccggcaagcaggtccagctcaacatcttcgaagtcaagaacgccgcgctggacgcccagctcgtcgctcagggcatcgctgagcagctgaccaaccgcgtcaccttccgtcgtgccatgcgtaaggcccagcaggacgccatgcgcgccggtgccaagggtatccgcatcaagctctccggccgcctcggcggtgcggaaatgagccgttccgagttctaccgtgagggccgcgttccgctgcagaccctccgcgccctcatcgattacggcttcttcgaggccaagaccacgtacggccgtatcggcgtcaaggtctggatctacaagggcgacatgaccgaatccgagttcgaagagcagcaggctcagcagaacaaccgtccgggccgtcgtggtggcgatcgccgcccgcgccgtggcaaccgttccgccgccccgcaggccgccgaagcccccaaggctgaggctcccgccgaggccgctccggctgcagaaacgaaggagtgagcaagaatgcttatccccaagaggactaagtaccgcaagcagcaccgccctgtgcgttctggcatgtccaagggcggcaacgagatcaacttcggtgatttcgccatccagtccctcgccccggcctacgtgaccaaccgtcagatcgaagccgcgcgtatcgccatgacccgctacatcaagcgtggtggccgcgtgtggatcacgatcttcccggatcgtccgctgaccaagcacccgctcggtgcccgaatgggttccggtaagggtgccccggagttctggattgcgaacgtgcgccctggtcgcgtgatgttcgaaatcggtggtgtgtccgaggacatcgctaaggaagccctccgccgcgctatcgacaagctcccgatgaagtgccgcattatcgcacgtgaaggtggtgatatctgatggcagtcggtaccgctgattactccatcaagaatctcaacgagaagaccaacgcggaaatcgaaggcttcttgaagaagtccaaggaagagctgttcaacctgcgcttccagcacgccaccggtcagctcgagaacaccgcccgtctcaaggctgtcaagagcgacatcgcccgcatgtacaccgtgcttcgcgagcgtgagcttggcatcagccaggagccggccgctaccgaatccaaggagaagtgattatggctgaagagcgtaacttccgtaaggttcgccgcggctacgtcgtgtccgacaagatggacaagacgattaccgtcgagctcgagcagcgttcgacccacccgctgtacggcaaggtcgttcgttccaccagcaaggtcaaggcccatgatgaacacaacgacgcccacattggcgacctcgtgagtattatggaaactcggcctctgagcaagaccaagcgctggcgtctcgaatccattatcgagcgcgccaagtaagtaaagttcggcaaggctcgccatttaccggggcattatgggcaaccacgatgccccggtaaatggggagaaccagctcggctaaggagaatcaatgattcagcaggaaacgcggcttcatgtcgccgacaacacgggtgcgaaggaactcctcgccatccgcgtgctcggcggatcgaagcgacgctatgccggcatcggcgacgtgatcgtcgcctccgtcaaggacgccattcctggcgggtcggtcaagaagggcgacgtggttaaggccgttgtcgtccgtaccgtcaaggaatcccgccgtgcggatggttcctacatcaagttcgacgagaacgccgccgtcattctcggctccggccgtgaaccgaagggcactcgtatcttcggaccggtcggtcgtgaactgcgcgagcacaagttcatgaagatcgtgtccctcgccccggaggtgatctgacatggcagccaagatcaagagcggcgacctggtcaaggtcatccgcggcaaggaccgcggcaaggaaggcaccgtcaagcaggtgctctccaacgatcgactaatcgtcgaaggcgtgcagatcgtcaagaagcacgtgcgtgcaacgcagcagggccagcaggctggcatcgtctccactgaggctccgatccatcgctccaacgtgatggtcatcgacccggagaccaagcagccgacccgcgttggcatcaccgttaaggaagaggcgcgtgacggcaaggtgaagaccgtgcgcgtgcgcgtcgccaagaagtccggaaaggagctggcatgaccgatactactgtcgaagcgccggccaccccgcgcttgaaggtcaagtacaacgagcagatcattcctgagctcgagaaggagttcaagtactccaacccgatgcaggttgctcgtgtccagaaggtcgtcgtctccatgggtgttggtgccgctgcccgcgactccaagctcatcgaaggtgccgtcaaggacctcaccctgatcaccggccagaagccgaagatcaccaaggccaagaagtccgtcgcgcagttccacctgcgtgaaggccaggccatcggtgcgtacgtcaccctgcgtggcgaccgcatgtgggagttcctggaccgtctgctgaccctcgcgctgccccgtatccgcgacttccgcggcatcaacggccaccagttcgatggccagggcaactacaactttggtctcaccgagcagtccatgttccacgagatcgatcctgattcgatcgatcacgtgcgcggtatggacatcactgtggtgacctccaccaaggacgacaaggaagcttacgcgctgctgaagcacctcggcttccccttcaaggagaactgatatggcaaaaaccgctcttaagaacaaggcggccggcaagccgaagttcaaggtccgcgcttacacgcgctgccaggtctgcggtcgtccccactccgtctaccgcaagttcggcctgtgccgcatctgccttcgtgagaaggctcaccgcggtgaactgcccggcgttacgaagtccagttggtaaacatcgacgctgaaggtccgcggcccgaacgcttctagaagaagcgtgagggcggcggaaaccatagcgagaaagggcaacaagcccaaatgacaatgacagatccgatcgcagacatgcttacgcgtctgcgtaatgcgagcgcggccaagcacgaaaccgtggatatgccgtactccaagttcaaggcgaacatcgccgagatcctgaagcgtgaaggctacatcaaggacttcaccgctaaggaagccaaggtcggccagactcttgaggtcaccctcaagtacggtccgaacggtgagcgttccattcagggtatcaagcgcatctccaagccgggccttcgtcgttacgcgaagtccgactccctgccgatgccgctcggtggcctgggtatcgccatcatctcgacttcttcgggactgctgactcagaaggaatgcctcgaccgaggcattggcggcgaaattgtcgccttcgtgtggtgagaaaggagagctgaaacatggcatcgcatattggtaagctccccatcgccatccctgctggcgttgaagtcaagattgaaggccagaacttctccgccaagggcgctaagggttctgactcctacgtggttccggaaggcatcaccgctgccgttgaaggcaacgagattgtcctgaccgctgctgatgacctgcgtccgacccgtgccaagcacggtctggctcgttccatcatggccggcatggtcaagggtgttcacgatggctactccaagactcttgagatcgtcggcaccggttaccgcgccgtcgccaagggccagggcatcgagttcttcctcggctactcccacaccatcaccgtcaacccgcccgaaggcatcaccctgaaggtgaccgacgccaaccacgtggttgtcgaaggcaccgacaagcaggtcgtgggccaggttgccgccaacatccgcaagctgcgcgctccggaaccctacaagggcaagggcatcaagtactccgatgaacgcatcctgcgcaaggctggaaaggctggtaagtgatatgagcgttgctattctcggaaaaggcaagaaggtagctctcaagcgccgtcacgcgcgtatccgcaagcgcatctccggtacccccgagcgtccgcgcctggtggtcacccgctccaaccgtcacatggttgctcaggtggtcgacgataccaagggcattaccctggtgtccgcctccactcttcaggccgacttcgccggcttcgaaggcaccaagactgaggccgccaagaaggtcggcgagctgatcgccgagaaggccaaggctgccggcatcaccgcagtcgtgttcgaccgcggtggcaacaagtacaccggtcgcgtcgcagccgttgctgatggcgcccgcgagggaggtcttgcactgtgagcgacaacgaaacgaaggaaacccaagtggctgaagaaactcagaacactgtggcgaccgaatccaacaacgaggaccgcaagggtcgtcgtggccagcgcggtgaaggccgtcgtggcgagcgtcgtaaccgtcgtgaagaaaaccacggcgacgagctgctcgatcgcgtggtgaccatcaaccgtgtgtccaagacccacaagggtggccgtaccttcagcttcgccgcactggttgtggtcggcgacggcaacggcaccgtgggtgtcggctacggcaagtcccgtgaagtcccggccgccatcgccaagggccagctggacgccaagaagcacatgttctctgtgcctcgcgtccgcggcaccatcacccacccggttcagggtcacgacgctgctggcaccgtcctgctgcgtccggccgccccgggtaccggtgtaatcgccggtggctccgtgcgcgccgtcatggaatgcgcaggcatcaccgacgtcctgaccaagtcgatgggctccgccaccgccgttaacgtggtgcgcgctaccgtcgacgccctcaagcagctcgaagagcccgaggagatcgccgcccgtcgtggcctggcgctcgacgaggtcgctcccgatgctctgctgcgcgcccgcgccgccggcattgccgaggctcgcaaggctcgcgaagaggctgctgccgctaaggccgccgaagagaaggatggtgagtgatactcatggctaagaacctgaagattaccctgcaccacggcatcgtgaaccgtaccccggctcagcgcgccaccgtcaagaccctcggcctcaacaagatcggtaagaccgttgtccgcgaggacaccccggccaaccgtggtctggtgaacgccgtgcgtcacctggtcaccgttgaggaggttgactgattatggcagataacgaaatcctgcagatgcacgacctgaagcccgccccgggtgccaagaaggaccgcacccgtgtgggccgcggtgaaggctccaagggtaagacctccggtcgtggcgccaagggccagacgaagcgcaaccacgtgcgtccgggctttgaaggcggccagctgccgctgtacatgcgcctgccgaagctccgtggcttcaagaacccgttcaaggtcgagttccaggtcatcaacatcgctcgtctcgtggagctcttccccgagggcggcgaggttgctgtggccgacctgatcgccaagggcgctgttcgtgacaacgctccggtgaaggttctgggcgacggcgagaccaccgtggctttcaccctcaagggtgttaaggcttcggcttccgccaagtccaagatcgaggccgccggcggttccgtttccgaggactgattagtcctacggggagcgcaataggctgtacaacccccgcccgccaataggtggacgggggttcccttttctaaaaaattgttgttctgagtgcagagaagcagtctcaacacaatgatcgttttgagtatgcttccccccgttcagtacgacggagcataattcaggtaacattcgcgagacatgaagtggccgaagtaggcactttagactatgctcgtttgttagtttgtgtatttcgcgcgattggcgcgctattgggaggaaatctaggtgaggacactaatccaggccctgaaaaccaaagagttgaggaagaagattctcttcgtcctgttcatcatcatcgtctaccgcatcggttcgttcattccgacccctggcgtggactacaacgtggtgaacaagtgcatggccaccatcggcagcgcctcccaggagaacttcatcggactggtgaacctcttctcgggtggcgccatgctccagctgtctatcttcgcgctgggcgtcatgccgtacatcaccgcgtccatcgtggtgcagctgctgcgcgtggtcatcccccgcttcgaggccctgcacaaggagggccagtccggcgaggccaagctcacccagtacacccgttacctgaccatcggcctggccgtgctccagtccaccaccatcctggtcaccgcccgctccggcgccctgttcaactaccagtgcgaccaggtcatcccggacggctccgtgttcaacctcgtggtcatggtcctcatcatgaccggcggcaccggcctgatcatgtggatggccgagctcgtgaccgacaagggcatcggccagggcatgtccatcttgatcttcatgtccatctgctccggcttcctgccgcagctgtgggagatcggctacggcaccaacggcaccgacggcgactggctcaagttcggcatcgtcgtgggcgtgctcgtggtcatcctcatcttcgtcgacttcgtcgaactgtgccagcgccgcgtcccggtccagtacacgcgccgcatgatcggccgtaagatgtacggcggctcctccacctacctgccgctgaagatcaacatgtccggcgtcatcccgccgatcttcgcctcctcgatcctcgccatcccgaccctgatcgcccagttcggcaagtccgaccagtcgtgggtcaagtggatcaacgccaacctggcgaacaccacctccgtgtggtacatcgcgctgtacgcgctgatgattgtgttcttctgcttcttctacacctcgatcacgttcaacccggacgagaccgcggacaacatgaagcagtacggcggcttcatccccggcatccgcgccggcaacgccaccagccgctacctgacctacgtgattaaccgactcaacaccgtcggcgccgtctacctgctgttcgtggccctgatcccgaccgtgctgatcatggccctcggcctcaacgccaagctgccgttcggtggtaccacgatcctgattatcgcgggcgtgggcctcgacaccctgcgccaggccaaggcccagaccgaacagttccagtacaccggcttcctgttcgaaaacgcggaccacaaagagggctgacgcccgcttggcagcggtcgcccgcaatgggcaggcggccgcgcgaggagtggaacagtccagtggactgttccacgacggagcaatctttcttccgcatataactcaatggctcccttaaccaagggagccaaaaccgtattaataaccgacataaaaggagaccaccatgcgtctgctcatcatgggcccccagggcgtgggcaagggcacccaggctgctctgctcgccgaacacttcaacatccccaccatctccaccggcgacatcttccgctacaacatcaagaacaagaccgaactcggccttgaggcgatgagctacaccgacaagggcgagctggttccggactccctgaccaacaagattgtcaaggatcgtctggccaaggaagactgcaagaacggctggatcctcgacggctacccgcgtaacgccgcccaggtcaccgctctcgacgagatgctcgccgacctcgacactccgctcgaccacgtggtggccctcgaagccgcccgcgacgtgctgctggagcgtatgaagaagcgcgccgccgagcagggccgcgctgacgacactccggaggccatcgccaagcgcctggagacctatgagaaggaaaccgctccgctgctcgacatctacgaggcccgtggcctgctcgtcgtggtcaacggcgtcggcgacatcgacgagatcagcggccgtatcatcagccacctcgagtagtaggttcggcagcccgggcaacaagccggagtgatgccgaaataccacatcaacgtttccatacccctgtgcgacacgccgagtgttcgtacaggggtatgtgcgtatatagtttacagttggtgtgtcttcggatatgccatagtaatcatccaacggaataggactagaggcacatggcaaaagacggtgtgattgaagtcgaaggacaggtcgtggaagcactgcctaacgcgatgttccgcgttgaactcgaaaacaagcacatcgtgctcgccacgatttccggcaaaatgcgtaagaactacattcgtattctgccgcaggatcgtgtcgtgctcgaaatgagcccttacgacctgaaccgcggacgcattacgtaccgttacaagtaaaggtacacaagaaaaggataaccatgaaggtcagccctagcgtgaagaggatctgcgaaaactgccgcgtgatccgccgtcacggccgcgtcatggtgatctgcgtcaacccgcgccacaagcagcgtcagggctgagagcagattctccagcggcactaagtaaataaggcactctctcacagtgcttcccgcaagggaacgacactgaaccacgggtacgtaggcccgtgccgggtaaccgggcgagcgggtgcaagacctacggcaacaagaaggaatcgcaatggcacgtcttgccggagtcgacatccccaatgagaagcgcatcgagatcgccctcacctacattttcggtgtgggtcgcactcgtgccaaggaaacgcttgccgcgaccggtattagtccggacatccgcgtcaaggatctcaccgacgagcagctgattacgctgcgtgactacctcgaagccaactacaagatcgagggtgacctgcgtcgtgaagtcgatgcagatattcgtcgcaagattcagatcaactgctaccaaggccagcgtcaccgtaagggacttcctgtgcgcggccagcgcaccaagaccaatgctcgtacccgcaagggcccgaagcgcacggtcgccggaaagaagaaggccaccaagtagtcggtggcatgattcgggccacgggatgattttcatcccatcgcccgaacgtcaacaacaaagttcgttactaggaaacgagggtcaatggcagcgcctaagcaagccgctcgtaagccccgtcgtcgcgaccgcaagtcggtcccggtcggccaggctcacatcaagtccactttcaataacacgatcatttcgatcaccgatccgtccggcgccgtggtgtcctgggcgtccggtggcgatgtcggcttcaagggctcccgtaagtccacgccgtacgccgctggtatggctgccgagtccgccgcccgcaaggcgatggaacacggcgtcaagaaggtcgacgtgttcgtcaagggcccgggttccggtcgtgaaaccgccatccgttccctgcagtctgcgggcctcgaggttggttccatcaccgacgtcaccccgcaagcccacaacggcgttcgtcctccgaagcgtcgtcgcgtctgagcactcagcaataccaaatccatccaaaaccgcctgaccggtgagtgcaccaccgagttcaagctgaaaggataaccacagtgcttattgcacagcgtccgactcttaccgaggaatctctgaatccgcagcgctcccgcttcaccatcgagccgctcgagcctggcttcggctacacgctcggcaactcgctgcgtcgcacgctgctgagctccatcccgggtgctgccgtgacctccgtgcgtatttccggtgccctgcatgagttcaccactctgccaggtgtccaggaagacgtcaccgagatcctgctgaacatcaagggcatcgtgctcaccagcgaatacgacgagcctgtggtcatgtatctgcgcaagagcggcaagggcgaagccgtggctggggacatcaccccgccggccggcgtcaccattgccaacccggagcagcacatcgctaccctcgccgacgatggcgaactcgagatcgagttcactgtcgagcgtggccgtggctatgttcctgcccagatgaacaagcaggacaacgatgagatcggccgtattccggttgattccatctactccccggtactcaaggtgagctacaaggtcgaggccacccgtgtggaacagcgcacggacttcgacaagctcatcctggacgtggagaccaagcccgccatctccccgcgtgacgcggtggcttccgccggttccaccttggtggagctcttcggcctgtgccgtgagctcaacgcccaggctgaaggcgtcgaggtcggtccggccccggtggccgaggagaccaaccccgagatggccgttccgattgaggacctcaacctgacgcagcgttcttacaactgcctcaagcgcgagggcatccacaccatcggtgagcttgtctcccacaccgagcaggacctgctcgacatccgcaatttcggtatgaagtcaatcgatgaggtcaaggagaagctgcagaccttgggcctgagcctcaagtcctcgccgatggccttcgataccaataatctcgaaggtggcacgttcttctcgccggaagacgagtgatctgcctctttgaccaatcgttcgttcactaggcaagcggatgttcgggcatatgcccacctgcttgcctgaagaacggacatataaggagtaaacccaatgcctacacctaagaagggcccgcgtctggcttccagccccgcacacgagcgcctcatgctggcaaacatggcgaccagcctgttccagaacggccgcatcaccaccacgctgccgaaggccaagcgccttcgtccgctggcagagcgcctgatcaccttcgccaagcgtggtgatctgcactcccgccgtcgcgtgatgcgcgtcatccgcaacaagtccgtggtgcacatcctgttcacccagattgccgagcagatggagcagcgtgaaggtggctacacccgtatcgtcaagatcgctccgcgcgttggcgatgccgctccggccgctgtgatcgagctcgtcaccgagccggttgccaagaaggctgttgtgaaggaagctgaagccgccgccaaggttgccgaagaagaagctccggccgttgaggctgaggccactgaggctgctgaggctgttgaggctgttgaggctccggtcgaggagaccgccgccgctgaggctgaggctcccgctgaggaagccgctgacgccgagaaggccgagtgagctgaatagcgtttcgctaagctagctgaaagggctggaatccgtttgggttccagcccttttgcgttgttttcatagaatctacaacgtacgtacggcccgaatggcctcggctcttgcggccagctgatcatcggcgggatatgcgatatgctccaaagtcaggccctgcggcgcaatcggcccgcttgagccttcacgtactggctcggccattttgccggcaaaccactccagtgatttgcgtcccgaaccaactttgatgcatgagccgaccagggagcgcaccatattgcgggcaaaggcgtccgccacaatcgtgaacactaccaggccggactccagcgacggagtccgatatgcttcatgcgatgccatctcatccggtactaggggagtgatcggcacccgccgccaataggcggtcttgacttcacggatcgtagtgcctcccggattcggagtggcgaaggaaccaaaatcgtgcaggccgatggtcaatgaggctgcgcggttcataagctccagatccagcgcttcatccacggtaagtacgcatccacgcaggcgcgggtcgacctcagacgaacgatcggcgacccgatacacataagtgcgctccaatgcggagaacctggcatcgaagccgaccggagctacggcaatgccatgaatgacgatgtccgaaggcagcacagccttgagtctgcgagtcagcgcctcggtgaccggaatggtcatgtgacctacgcagcgattcagtacctcatcggatacatccagatgcgccacttggtgggaggcatgtacaccggtgtcggtgcgtccagccactgtcaagcgtaacggttcggccgcgtcatcggtcggcacccgcagcaccttgtgcagcgcatcttcaatggtgccttgcactgtacgaagattgggctgtttggcccagccatagaatccgccgccgtcgtaggccaagtcaatgcgcagtcgtgtcatagccattcattgtaacgagtgcggtcggcgagacgagtgcggtcggcaagatgcgtgcggtcggcaagatgcgtgtggtcggcgagacgagtgcggtcgtcaagatgcacgcggccggcgaagtgacctgcctgtaacattctcgcgcgtttgttgaaacgggcccgccttaggttgaaaccatcaaacccggttacggcttgcggcgtcagcgtgcgctcaaaacgcctaaccgcttgaagccacagaagccgccacagcaaggagcaggcacgatgatcgaatccgcagcacgcagactggcccatgaactggtaaaccgtcgcgaagcgatcaatcgagagctgtcccgcaacggtgtgcgtttcggcatctacaagaacggcgaataccatgaccggctgttcccgtacgaccctgtgccgcgcattatcgaatccgacgaatacgacgaattggagaagggcctgaagcagcgcgtcaacgccctgaacgcctatctgaaggacatctactccgacaaggccatcatccatgacggcgtggtgccggaggaatacgtatacacctcggccggctacttcccgcaggtcaacggtgtgacccctcccggcggcattttcgcgcatatcgccggcgaggacctggtccaaggcgaggacggccgctggtgggtgctggaagacaacctgcgcatcccctcgggtgccagctacccgctgttcgtgcgcgacatcgagcgccgcatctccccgcgcctgttccgcgacgttcgtattcgcgataatcgcgaatacccgcgcctgttgcgcaaagccatggactttgtctccaccgagggcatcgccgtggtactgactcccggccgctacaattccgcgttcttcgagcacgcctatctggcggagaaaaccggtgcggcgttggccttccccgaggacctcgaagtggtggacaacaaggtctacttcctcgactacgccggcaaacgccaccgtgtgggcgtggtctaccgccgcctgtccgacgaattcctcgacccgttcgccttcaatcctgattcggtgatcggtgtgcccggtatcctgtccgcctaccgcgcgggcaacgtggccatcgtcaacgcgccgggcaacggcgcggccgatgacaaggccatctactacttcgtgccgcagatgatcaagtactatctcggcgaggaaccgattctcaacaacgcgcccacgtacatgccgatgttcgaggccgaccgcaaggaagtcctgaatcggatgggcgagctggtcatcaaggatgtggccgaagccggcggttacggcgtggtgtttggttcgtcgctggatgccgccgcacgtgaggagctcgccaaccggatcaaggaggagccgcgtcgattcattgcccaagaggtgattcagttccgtgatatcgatgtggtggacccgaagaccggcgagatgtcgccgcgcaagtgcgatttgcgtgccttcgtggtcaccggcaagaatacgcacgtgtggtattcgggcttgactcgatactcgtcggtgcctggccagatgattgtcaactcgtcgcagggtggcggattcaaggatacgtgggtgttggcacccgaatccggcgtggagcatgaatacggtgccgaaacgcaggtggtgaacctgctgaaccagtcccgccgccactcgttgtctctggtcaccgcttccaaggcagacaacctgtattggctgggccggtacaccgagcgcgccttcaccacgctgaaccagttcttcccgttctacgatcgtgtgatggacactgatgtggacgccttccgtccgttcgctcacgcactcgacctgcccgaagatttcgaggacttcgacgggttcgtgaacagcttcctgtatgacgggtccaatcctgattcggtgcggtcggccgtaacctccgcattcaacaacgccgtgattctgcgcccggaattgagctcgcgtctgctgcagtacgtggagttggcgatgaccaatatcaccgatgccgccaaatacgcggccgatgccgaggacatctacaagcagcgcgatattaccgatgacatgctcgccttctggggcggcatcgagaattcgccggtcgaccccacgctgaaggcgttcatcttcatcggcaaatatctggaacgcatcgacctgtacacgcgcttcggcctgacgatggaggagctggaagcgccgctcaagaagctcgccgcctattcgatgaccttggacggcatgccgctgcccagctgcttcgccgacggactgagctggctggtcggtcagctgccgtctcgcggatatcaggaagtcgccgacctgctgaagaagtaccttgacgactactccggccgtgtcagcgcgctggccatcaaagacatgggctcactgagctccatgaacatggacgccaagcgtccctgatcccgacctgacaccctgacgggttcaaatgctatggtggtatggcgaaaaaaccgtgcgcccgagtgccggcctgtgcatatcagcagattgccggaatatatgcgtgggctgtgagcgcacggaccatacctcagccatggctgtagtgttgttatcccgagaatatgccggttgccggctcgtgtgcaagtgcaggagacgttgtgaaaaaactcgtgttcgactatgagatgaggctgtccttcagcgcaccggtcaccgatcacaggttccagcttcgctgtattccctccactggccctcgccaacaggtgattgacgtggaagtgaagattcagcccgaaaccgaactcgaaaccaccatcgactcctttgactccgtggtgatgaccggattcatccctgagccgcacgacatattcagctactcggtgaccggcatcgccttcgtggacaatgcgcatatccataaggaagcctataaaccgctgtaccgattcaattcagcgctcaccattcccggcccgaacgtggaggcgatgattgccgtatgccgcgaacgcttggcggcgctgccttccgacgccactccggtgcagcaggctgccgaagtgatggatgaggtctacaaggcgtttgtgtatacgcccggttccaccacgattcgcaccaccgccgaacaggccttggctcagcgcaagggcgtatgccaggattatgcgcacgtgatgctgtccgtgtgccggcatgtgggattgaccgcgcgctacattgccggtttgcttgggggagagggcgcgacccatgcttgggtcgaggtgtatcaggatggccgatgggtcggactggatcccacgcataaccgattggtggacgacagctacatcaccatcgcccacggccgcgattaccgcgactgcatgctcgacatcggcatcttctctggatacaacgtccagcagtcccaatgggtcaacgcctccgtccacgaacaggtggcataaataaaattccaagccccctctgatgagctgagccgtgaagaaaacgccggaggcgtttttaggcgaaggcgaacgacagtgagcaaataaaatggcagctggaaagctgtccttaattgcgttcgagctgtcagccgtaaggctgaccgagggagagaccactcaatgcagagtggccccgtcaccgcttctaccaccaccaatattcggattttggtagttgaagaattcggattttcgcagttgaccaattcggactgttaatcggctcatcgtctgacccatcgcaatctcacacaaaatcgcattatcccacgccgaatcgagctcagcgaaactccgatttgccaggtcggcagaatgtggcataatgaacaagttgccattttggcagcatggataagtgtccgagcggtctaaggagcacgcctcgaaagcgtgtgaggtgaaagcctccgcgagttcgaatctcgccttatccgcctgcaagggtttcgaggtgacctcgaaaccctttttgtttctgcgaaaccccacctttggggctataggccaaaatggagttataggccaaaatgtgtgtccggcggtctagtcgttcgactgccattcgacccgtgtgtggaactcgttccagtcgatgctggtgcctgtattgcttcaatgtttgttgggcgggttcggcagtgtttttcacagccaaaaaaaatcagtgacgaaacacgaaacatcgacttgactaaatacaaacggcgccgccacgaggagcggacccgccccgcggccccgcattcgctgcagcaccggtcggtctcgtccgtcggatcgcagccgatcagccacacgccggcacacgagcccgacgtgacgtggcgttgcgagaccgggttcaacccgagcctgtccagaccgagcagcacccggccgtcgaacgcgctagacttggaaccaagctgcgcggttttcttcgctttttcgatcacacaccgaataaaaacgcacggcccatacacacccaaatgcgaagggccagttatgacccgagaacgcctataactagcgcctgtatgcatgtaattgcagaaatcgacgtcttgtgcatgcaatttgggtccgtaaatagcgcagaaatgcgaggcaatctgcggacgggaagcgggaagggcggttcaggagctttaaatggtcctcttatgcatgcggcctcatgatcgggaaccggctaggaaatacgttgcatgcatttcggcatcataaggcatcggaaaagtcctacggtagcggtcccgcgattcgtcaattgagtgattactcggtactgtctcccgaaccgaccagttttttgctcatacactagttccgggtttcgatgagattgatgatgggcgataaaagggtccgacgcgctaacgtcgggcccttgcgttgattacggggtcgtgcccctaaccaaaggttacgggacgaatcgtatcatgatgcgcggtagtctgaccgtgagcaaacgcactgtgattgtctatatgacggatgcgcgcggtccaacgtgcgtggcctctggccgttacctcttgctaagactgcttatgtaacggtcgttaaagcatgatgtttcctcgctaggtattttgaccgcggcagttgttggatggatttgattcggatgatgatatagcgttgtatcaattgtggttgctgttatttgtatttgttgaagtatgtgagtggcgagtggcgctttacacgttcttttttctgtcttttggcccgattcttttcggcgtgttgccttgaaaatacacgcttatgcagatgttttgcgcctcgtcgttgcatgatttggttctttgttgtatcatctaactaaatgataagtacaatgttgtatcaagttgtactcagtaattatcttccgcgctgaagcggtgatttttacttatctgagacaacgttgtatcgaatttatggaagcaaaggataacaatggcagagcagcagtccaacaccgcctcagattcctcccgtctgatcgtcgacgatgccttcgaagtggctccggtgaatgatcgtctttttggctcgtttgtggaacatttgggacgttgtgtatatgacggcatctatgagcctagtcatcccgaagcggatgaggatggattccgcaaagatgtcattgagctggttcgtgagttaggtgccactaccatacgttatcccggcggcaattttgtgtccggttatcgctgggaagatggtgtcggcccgaaggaaagccgtccgcgtcgtcttgatttggcttggcattccactgaaaccaatcagttcggcttgcacgagatgtctcagtggttagacaaggtcggcggcaatgagctcatggaagctgtgaatcttggcacccgtggtcttgaggaagctctcgatttgcttgagtacgcgaatgttcctagcggtactaagctctctgatgaacgacgtgccaatggcaaggaaaacccgttcggtatcaagatgtggtgccttggcaatgagatggatggcccctggcagactgggcacaaatcagccgaagactacggtacattggctgcctcggttgcggcgggtatgcgcatgattgatccggatgtggagctggtcgtatgtggatcatccagtcacatgatggacacatttggtaaatgggaagaaacggttcttgaaaaggcctatgacagtgtcgatttcatctcgtgtcatgcctattatcatcctgaatttcaggctgatggcactcgtgatatggcaagcttccttgcatccggcgttgatatggatggcttcatcaaggatgtcgctgccgccatcgacgctaccaaggctcgccttaagagcgaccataacgtattcatctcatttgatgaatggaacgtgtggtatatcgatgaagaaccaagcaaaaatccggaaggtattggtaattggcctgtggcgccccgtctgcttgaagatagctacaccgctgcggatgccgtggtctttggcgacctcatgattacgttgctcaaaaacgccgatcgcgttcatgcggcgagccttgctcagctagtcaatgtcattgcgccaattatgaccgagccaggaggtccggcatggcgccagacgacgttctatccattctcgatgactgcgagatatgccaagaacggtacggtacttgagcccaaactgacttcgaatacttatgccacggccaagtatggagaggtaccggtggtcaactctgtggcagtacgcggggccgatggatctgtgaccattttcgtggtcaatcggtcattggaattgtccaatgacttcgaaatccaagtgccggatgatggcaacttcactgaagcgaccgcacagacgctacatgaagaggacttgctcgctaggaacaccttggaaaaccaagatcgcgtgattcttcacaccaatgattctgttacgttcagtgccgacgatgccatcgtacatgtgacattgcctccggtgtcttggactgccgtgcatgtgcggtgatttgaacgggtgaacatcgaaatataggtacgagataaggggaggagcgtcacatgaattgcagccaattcactccatgtgagggacgaacagagattgtcgatgctgatggacgattgatctggcataacgatgacatctgcatggtattcgtagttcgcgataatgctccggttgtgctcgccggtttgtccggatatggtatgcgtcctgcctgcgaattgaacaacgagaaaggtgcgtttcccattgtggaagtacttacttctatctcgggtcgtaccatgaatcatcaacgcttgaccgatactcgggaaggaagtcagctccgttttgtagcagcttatacctatgagcgcggcatgcgtcatgttctcaggattgatcagaaagatgaacattctggcctgttgactgagacggagttctcgatgttccccggagtcagtgccgtgagttgccagtcccgcatcgcatcggaacgccggctgccggtagaagcagtgtcttcgttgaatctcaccgtgccgttggatgccgctgggggtggagttgacggagtcgaggtctactgggccgacagcacatgggccgcggaaaataattggcatcaggcgccacttcgcgagattggtttgccggacatcaataccaacattaatcctcgtgttccgggcgcacgatttaatctctcttcgcgatccacttggtcgactggagagaagcttccccttggcgttttaaccatgggggaggggattcgtcgctcggctctgatttggcaaatcgaacacaacggtccatgggcttgggaaattggtgaaggcatcgatggccttcatatcacggccggcggtcctaatggggatgatcatcaatgggccgttgtgcttgacgaacgcactgattttgtcacagttccagctagctttgccatttgctcaggcggctggcagcaggtagtcgaacaaatgacgttacatcgtcgggcattgcgctctgctcgtttggctgtaaacggtcagaaccatgattccgaacagctggtcatttacaacgactatatgaataccctgttcggcaatccgacggctgataaagaactgccgctaattgaaggtgcaggcaagctcggcgtggacgtgttctgcatcgatgctggatggtatgacagcgccgatggcggctggtgggacatggttggcgagtggaagccctctaccaatcgtttcggcaatcttggcttgaaaggaatcgcttcggccatccgcaaggccggcatgggactgggactatggctcgagccggaagtcgtaggagtacgttctccaattgctaatgagttgccggattccgcattcttctgccggcatggcgagcgcgtggcagacgatggacgttaccatctcgatttccgttctcctgatgcgcgcgctcatatggatgacacgatggagcgcatcatcgctgaattccagccgaaattctttaaattcgactacaacaccgtacccggggttggtaccgaaatcgatgccggatatctaggtgaagggttgcttggtcatagccgtgcttatgtgcggtggctagacgatctcaagcaccggcatcccgagcttgtcattgagaattgtggttccggtgccatgcgtgctgactacgcgatgctgcaacgtctcgatctgcaatcgacttctgaccaatgtgatccggctatatatgctgccattgcagctggagcctcaatgtcgattctgccggagcaacaaggcaattggggctacgctcagcaggagatggatgacgagactgcggttttcactcttgcagcaggtatcgccggtcgtctgtatctgtcaggtttcgtcaaccgaatggatgagaggcgcttgcgtctggtccgaggtgccattgaagcgcaccggcaggtgctgaggaaccagtccggtcaggtgccattctggccattgggacttccggttttttcgggcgattggttggccagtgggcttttgccttatgcggataataacgagaccggctatatgacgatttggcaccgcggcggtgcaaacagcgttgttgtagaagtgccgcaaggtgccactttgagaccgtttttcccgaagccgggactcatcgacaagagccatggtgcagtcgattggcatgtcgagcctcttgatggcacacatgtccgtctgactgtttccgacaatcgtcgcagtgccagagtgtatgcgattgatatgccggattccaccaaataacaacaagatttgcctgcgcaacaccgcgctggcagcaatgataaggagaaagaacatgaagcaccccttcagaagtgcggttgccgcagtcagttcaatggtgatgctgacttcccttgccgcatgtggcggcagcgacacggcccagtccgatgaaaaggaactcacgatttcttggtattactcctctggcggtggtgacacgtgggagcgtgccatcaagctgtacaagaaggaaaatccagatgtcaagatcaatgaagtccacacttcattcccgcagatgcagaagaatgcatcgttgactctgcaggctgacgatgctcctgacgtggccatgtacaaccaggggaccagttctgttggcaatctcgcatcgcaaggtattctggctgacttaagcgaatatgcggacaaatatggttggaccgatacgttgcctgaatccattcagactgtggccaaatataaggccgatgatggtggcgttatgtcctcggacggcgaatggtatggcgtgccaatcaacggtgagttcgttctggcgtactacaaccaggacatgttcgataaaaatggcatcgctattccggaaaccttcgacgagcttgagtccgctatgcagcagttcgtggacaaaggcattacgccggttgcttttgaaggcaatgagacggcttcgcagcatctgtggtatcagctggtactgtctaaggccaatcgccagtttgttgacgattatcaatcctatgagcacgacgtcgacttctccagtgagccattcacctatgctgcgaacaagttctccgagtgggtccagaagggatatcttccgagcaactccggtggtctggtcgctgaggatatgattacacagttctgtgcaggtgaatacccaatcatgttctctggctcgtggtggttcggacgtgtcaatcaggatggcaacttcaagagcacgttccgtgccttgcccggcaacgagaagctgaacaccggtgcaaccggcaaactatgggtggttccggaaacctctaagcataaggatcttgctgccgacttcctgaacttcctgctctccaaagatgtgcagaacatgcttgctactgaagctggtttgccgttcaatgcctctgatgattactcgattgactctttgccggatgagcttaagaatccgctgaagactttcgatgacatgcaggactctgtcaaagagttcaacacggtgttcgaacagttgctcgacaacgatgcgattgcgttgtacccggattggccaagtgccggcatgtatgatgctctgaattcggctctccaaggcttgattaacggcaactccactcctgagcaggcaaccggtgaaatcaaggctgcttatgaggaaggaaagtcagatctgggactgtaacgagttcctgtctcttcgactacacgataaagccacgtagtgtggcatggtgtgggatggatgttcattgttgatcatcttcccacaccgtgcctgacacattcgcactcatgtacagagctggcactgtcgccagcccgcatcccatatcgtcggtgtccattgacaaaaggaggagaccatgtctcatggcaacggctcatctcaaggaaagcggcagaagaagcagctttccaataacgagaaaatatatgaaaagcgtattcgtagcggttatggccgttacattgttcccggtgccatcggtaccgtggtgattctgctgattccttttatcgccaatatttggatttcattgcacagttggcgtggtggccgcagcaaaatgaaattcatcggtttggacaattatgtcaaactactgggggatgaaaagttctggacctcattttccaattcgttgtacatgattgtggccatggtaattattccgctgcttatcggtctgattcttgcagcagtattgttcgattatatcggtcgtgaattcggtggtaagacatcgagctttttgagggcttgctactacctgccacaaattcttcccgtcggtgtagccggcattctgtggaattggattcttaattcacagaccggcgcgattaatcgaattcttgccggacttttcggcatggataagactcctgattggctaggcgacccagatcttgcgatttatgcggtgatgctgatgttggtgtggagccagataggatatccggttgtcatcttcatgtcggcgttggggcgagtcgatcccgagctgtatgaagctgcatcgcttgatggtgccgggtggtggcggcgattcagcgccatcacgctgcctcagattaaacctgagattttcgtggtggtactgacctgcactgttgcggcgcttaaggtttttggacctgtttatatgctgaccaagggcggtccgcaaagctccacccttgtgccgtcctactattcctacattaatttcttcggtaaatcacagattggctatggagcggccatcgcaagcgtgttggcgattgtcatcgccatcgtcgcatctgtcatcatggtgttccagaaccgtagcgctgctcgggaacgtgaaggagctctgatcgtatgagcgcatcatcatctgtcaaaacaggcatccaagctcgtatgaatcgtattgaacagcgtgatcgagttaagcagtccaagacgcgcaagcctattaatctattgcgatgggtaattctcattgcatgtgtgttgtttgcgattctgattctctcgcctctgttccttatggtgctcaatgcgttcaaaacgtcacaagattacacacagaacggtccgttgagcctgcctcatgaactgtatttcggtggcttggtgaatttctggaaagcgaccgacttccccatcaagttctggaattcattgtggatttccgtggtgtctgcgctgttgtccgtggtgctctcgctatttaacgcctatgcgctgggtatcggccgtgtgcgtggtagctcagtgattattgcactgttcatgattctgaccatgctgccaggagaaggattcatctacccactgttttacatgttcaacgcggtgggcatgggcaattctcaatggaccatcgtaattatatgcggcattatcaatatggcgtttggcacatatttgctcagctcggtgatgtcgacattccccaaggagctgttggaagctgcacaaatcgacggggctggtcgttggcgcacactccgtgacgtcgtgttcccgattatgaagtcgaactgcgcggtcttgttcatcttcttcttcatttggacgtggaacgagttctacttcaccttgattttcctagtgtctggagatactcagaccataccgctggcaatcgcgtcgttgcagggcgaccgcatcatggacgttccgactatcaacgcgggaagccttatctcccttattccggcgtttgtcttcttcctcatcttccagaggacgttgacgaagggcattaccgccggagctgtgaaataaccgaacccgatgcactgttggccggtggttctcctcctctccttcccactggccatagtgtatcgatgtatctttcgcccagcgtggggcaacaatgaagaaaggcaaacaaatgaaattttccgatggatattggcgtgtgcgtgaaggctttaccgcagcatgggcccgacagacacatgacatcgcgaaaaccgataacgggatttgtgcacatgcttctgcgaatctggtcaatgggcgtggggattccttaggaggtccggtattcacagttactttatcgaccccggccgaaggaatcatcaaagtagtggaagagcattttcgtggagcggtgaatccagatccacattttcatctgaatattgatgaggatgcgaatttcgacattgagaccggggacggggccacggtgtttcgtgcgggctcgctcgaagtcgccgtctccaatcctggcgagatttggtccatggacttccgagcgaatgggcatagtctcactggaacgtcgtacaaggggctgggcgcatataccgaacagtcgaccggtatccattacatgcgtgaacagctgcgtcttgccctagacgaaaaagtctacggcttcggagagcgatttggccacttcgtcaagaatggacagaccgtggaaatgtggaactctgatgccggtacctcatctgacgctgtgtacaaagccatccctttctattggacgaataaaggctatggcgtgttcgtaaatcatagcgaagacgtgtcatttgaggtcggatctgagactgtgggcaaagtgcagttttccactaaaggacatcgacttgaatactatgtgattaatggcccggaaccaaaagatgtactacgccgttatacgaagctgaccggacgtgctccctatctgccggcatggtcatacggtttatggctgaccacatcattcctgaccgattatgatgatgccactgtagcgggattcgtggatggcatgcaggaacgagatatcccactatcagtcttccactatgactgcttctggctcaaggaataccatttctgcgacttcgaatgggatggagatatgttccgtgatccgaggggaaccattgccgagcatcaccgtaaaggtctcaaggtgtgcgtatggattaactcctacctgagttccatgtcgccgttgtttgacgaggctatgtctaagggctacttgctcaagcttcctgatggcagcgtttacgagaccgatttttggcagccgggcatgggcctggtcgatttctcgaagccggaagctcgtgaatggtactgctctaagcttgagaagcttattgatatgggtgtggattgctttaaaaccgatttcggagaatcagtgcctactgaagtggtttatgaagatggttccgattcggtcaaaatgcataactactacacgtatctgtacaacaagactgtctacgaattcttggagcgaaagcttggcaagggacaggcggtgctgttcgcccgttccgccaccgttggtggacagcaattccctgtccattggggcggcgactgcgaatcgacttatacggcgatggccgagtcgctgcgcggcggcctatcgttgatgtcgtctggatttgggtactgggcgcatgacatcggtggattcgaaggcaatcctggtcctgacctgtacaagcggtgggtgcagtttggtttgctgtcgacgcattcgcggctgcatggttcccattcggtgcgtgtgccgtgggccttcgatgaagaatcctgtgatgtactacgcaagttcaccaaattgaagttgtcgttgctgccgtatctggcctatggatccaaacaggtcagcgaagaaggcattccgctgatgcgtcccatggctttggagttccctcacgatccagcggcagaatatctggatcgtcagtacatgctgggcgatgatttgctggttgctccggtcttttctccagatggagtggttcgttattatgtgccggaaggaacttggacgaacgtactcaatggagagcgaatcgcgggtccgagatggatcgaggaacaattcgattacatgaccatgccgttgctggcgcgtccaggtgcggtcattccaatgcaggaaggacgttgcgacaccgatggggatttgaccgacgacgtgatcctgaagatttatgatccggcggcccttgactcggaatggcgccaactggtcctgcggcatggttttgaggaagatgccgctgagacgatcttccggattcggcgtacgaatgatgtgcttgaagtgcgctgcgattccgtggaagacggatggactgtcgaatgtggcggtcagcgggttcaagcgcatgccggagccgcaacattgtcggtgcaatgatcccatagtatgcgcaagcatcgtggacgccggaatgatatctatgacggcattccggcgtctgcaatatctgtgtgaccttctgtgaccttgggcttaagatagggggatatcatgggtggataggcgatggtggtgccacgacaagatatgcgaaggagagatatgggcagccgcgtaacgattaaagacgtggccaaagcggctgatgtctccattaagaccgtatctaacgtgattaacaacactggaagaatgcgcccggacacgcgacaaagagtggaaggggccatgcgacaacttggatatacggttaatttgtcggcgcgttccatccgttccggtggcaccaggctgataggcctgaatatcttcgacttttcgcagccgtttgctccgtatctagctgataaggtcattgattttgccaaggagcgccaatacggggttattatcaatacctatggctccgatggcactggcttggcggatggtattgaagagacctatcgcttgggagccgatgggtggattttctttactgaacgcgctcttgtcgatgacggtgctgcacttgaacagccatatcctgtggtaatggcaggcgattatctgtcttacggcaaaagtgatttggtgaccatgcctaacgtgtcagctgtacagcagaccgtgggcagattgcttgataccggagtcagagctattgctctattgggtgccccgccggggataactgattgggattctttgaaaagtcagaaagaaggcacccaagagttacgtacccagggctatgtacgggcgttcaaggaacgagggcttgacgtggactggcgatatgttattccggtccatggatggaatcagcatggtggtgtgcaatccactgcagcgatgcttgactcgttaccttgccctgaagcagtggtctgtctcaatgacgccatggcactaggtgccgttcatgagctacagcgtcgtgatttacgagtccctcaagacgtgcaactgataggcttcgataacgtgccggaagccgagtactcggtgccggcgctgaccaccatcgatcctcatatcgatgattatgccaagcatgccgttgacatgcttatcgaccgcatcgaaggatactcaggcccggcccgtacgtacaccaccgatttcacattggtggaacgtgcctcaactcgacttgcccactagcatccaacaagttcgcatcggcttcgtgaggagtgtgtgtctactcgaacaatgcggcgtcagtcgctgggtagccaagttggaacgcggtgtaggcgtgcttggcggccagtgcggcgaggatgagcagcgtatcgctctcggtggaagatttcgattcggtcacggccttgatctgcgcgcgggcgcagtccatttcgatggcggcggcggtcggtacggtttggccgcttgccttgtcggcgatggtggtggggttggccagtagttggtcgatggcatagaccttttggcgggggtcgttttggccggaagaactggattgtgcgccggaatcatcaaaattgccgttcgccagcgcaaccaactgctgcccggcggtcttatgcatatcgctcaacgccaacgtagccccagcggtctgtcctcgtgcggccaagacctcgatagcgaatccggcgcgatcctcggccacggccatcgcatccaataccgatcgatcaacgttggcggacgtgacgccatcaagacgcgccggcgtcacctcaggcgcggactgcccgaatttatcggccagaaaagccagccattgcttggtctgcgcgtcacgtaacgttccctcggcaaaacgacccgaacaatacccggcaacgtcaatccaagccaggggagcggccagaccggtggcatactgctctaataacggcgtgccttcagccggatgggtggcgtagcccgccaacgtcatcgctttctcgcaaggggtcatttgagcttctgcctcggcccgtccggccagtcgcggcatcgaacacgccgaaagcgaacacagcatcgcgctcgcgcatagtacggatgccaagcgccgggtaaaccgtcctgaagagaagcgtgtctgcatggaaacatacactaatagctaactgtgactactcataggccatgcgccacataacttcataggaggtacggatcgatggaactggacctgacaggaatacacaagctcgccgccgagcaaggaatcgaccccgaaaccctggatgatgcgctggcagaggccctgcgcctcgcctacctcaagaccccgcacgccgccaagcacgcgcgcgtggagcttgacgaacgttccggcaacttcaccgtgtgggccgccgacgaaattccggtcgaacccaccgaagacaacccttaccccgttcccaagctgggcgaggaatacgatgacaccccgcgtgacttcggccgtctcgccgcagccaccgcacgccaggtcatcacccagctgttccgccgcgccgaagatgagaaggtattcggtgcgttctccggccagaagggcaagctcatcaccggcatcatccagcaggatgcttccgacccctccaacgtgcatgtcgcgatgggcgatgtcgaagccattctgcctcgccgtgagcaggtgcccggcgaacgttaccgccacggcgaacgcatccgcgtgtacgtggtgaacgtggcccgtggcatcaagggcccggaaatcgtggtgtcccgctcccacccggagctggtccgcaagctgttcgagcgcgaagtgccggaactggtctccggtgccgtgtccatcatggccatcgctcgtgaggccggcgcccgcaccaagatcgcggtcaaggccaacaccgatggcgtgaacccgaagggcgcgctgatcggccccggcggcgctcgcgtgcgtgccgttatggagaaccttggcccggagaagatcgacatcgtcgactactccgacgatccggccaagttcgtggcagccgcgctgtccccggctgtggccaccggcgtgcaggtgatcagcgagaagaacaagaccgccatcgccttcatccacgacgaccagctgtccttggccatcggcaaggaaggccagaacgcacgactggcagccaagctgaccggctggaagatcggcatcgaatccgccgaggcccatgccaagaaagtcgccgccgaaaaggccgcccaggctgcggccgaggctgctgctccggaagccgaataggccgccgggctcgaaggcgaatgatcttcagggcgcattatttcctgatacgagccgcgtcagcaatggcgcggctcgctgcgtctacgctatccagcgctatgagtatgcttgattggcgtatgtgggctggcgcagtgtgcgcgaaatcgcccacaccagagacgaggtaacacgatcatggtcgcacgatgagacagggtaggcttgccgtcatcaccaactgaccacgcccatgcacgcgcgtggtcacagaataggagtaattagtggcgaaaccacgcgtatacgaactggctaaggttttgaatgtcgatagcaaaaccgtgcttgagaagcttaaggacatgggagaattcgtcaagtccgcttcttctacgattgaaccgccggtagcccggcgtctgaaggcagagttcgccaaggacaacgccaagggcgattccaagcccgtgcagcagcgccgcccggccgcaccttcggccccggcttccacttcatcttccgcaccgactccggccgctcccgcacgtcaggcatcgcctgcctcggcacatcagcaggctccgactccgggtgcaccgacaccgcgtccgcagggcggcgcacgccccggcatgccgacccccggccgccacggtcagaacgacaaccgtgagaatggtcgcgataatcgcgaaggccgtgagaacggtcgtcagagtcgcccgaacgatcgccgtaacaacgatcgtcgtaacaaccagggccgtccgaacaatggccagccggttcagcatcagaacaaccgcggcaatgcttcggctccgcgcccgcacgctcagggcggcgccggtgccaatggcggcaatgccgcttcaaatgcgattccgcgcccgcacgctcagggcccgcgcccgggcaacaacccgttctcccgcaagcagggtatgcacaccccgacgccgggtgatattccgcgtccgcatccgatggctcgtccgactgctgataacggtcgtggcggtcgtccgggccgtcccggccaaggccaggggcagggccgcggcttccgtggcggtcgtccgggccaaggtggtcagggcggtccgcgtcccggccagtggggccacaaccgtccgggtcagggcggcggctcccagggtgccggtcagggcggcgcacgcggcggcttccgtgggggccaaggcggcggcaataacttccagggcggcggtgcaccgagcaacggtcccgcacgtggcggcggtcgcggcggtcgcggcggtgccgcaggcgcattcggacgtcagggcggcaagtcttcaaaggcccgtaagaaccgtctggcaaagcgccatgagtatgaggagctgaaagcaccgaccatcggcggcgttcgcatccccaacggcaacggccagaccatccgtctgcgtcagggcgcgtccctggccgatcttgcggagaagatcaacgtcaaccaggccgcgctggtcaccgtgctcttccacctgggtcagatggctaccgccacccagtccttggatgaggagaccttccagattctgggcgaagagatcggctggaacatccagctcgtctccgcagaagaggaagacaaggaactgctccagcagttcgacatcaaccttgacgaggaagaactgcaggatgacgaggatctcaagcctcgcccgccggtcgttaccgtcatgggccacgtcgaccacggtaagacacgactgctggataccatccgcaagaccaacgtcatcgcacgtgaggccggcggcattacccagcgcatcggtgcctaccaggtcaccgtgaaccttgaaggcgaaccgcgcaagatcaccttcctcgatacccctggccacgaggcgttcaccgccatgcgtgcccgtggtgccgagctcactgacgtcgcgatcctcgtggtcgccgccgacgatggtgtgatgccccagaccgttgaggccatcaaccacgctcaggccgccaaggtgccgatcgtcgtggccgtcaacaagatcgatgtgcccggtgccaacccggagaaggtccgcggccagctcaccgagttcggcttggtccctgaagagtatggtggcgacaccatgttcgtcgacatctccgccaagcagaacctgcacgtcgacaagctgctcgaagccgtgctgctcacggctgacgctgagctggacctccgcgccaaccccgacatggacgcccgtggtgccaccgtcgaagcccgactcgacaagggtcgtggtgccgtggccactgtgctggttcagcagggtacgctccacgtgggcgatgccatcgtggccggcacttcgtacggccgcgtgcgtgccatgctcgacgagaacggtcagccgatggaagcggccggtccgtccacacctgttcaggtgctgggcttgacctccgtgcccaccgccggtgacctcttcctggtcgcctccgatgatcgtgccgctcgccagattgccgagaagcgtcaggccaccgagcgtgccgcccagctggccaagcgtcgcaaggtcgtctccctcgaggacttcaagaagaagttcgccgagtccgagatcgacatgctcaatattgtcatcaagggcgattcgtccggttctgtcgaggcgctcgaggattccttgatgaagatcgaggtatccgacgaggtcggcatccaggtcatccaccgcggcgtcggtgcaatcacccagaatgatgtcaacctggccacggtcgacaaggccgttatcatcggtttcaacgtgcgtccgaaccgtcaggtcgcggacctcgccgagcgcgagggcgtggagatcaagtactactcggtcatctaccgtgcgatcgaagacatcgaggcatccctcaagggcatgctcaagccggaatacgaagaggtcgtcacctctcactccgagatccgcgagatcttccgctcctccaagttcggcaacatcgccggcgttatggtgcaggacggcgaggtcaagcgtggtacgaagtgccgtatcctgcgcaacggcgtggccacggtcaacgacctcgagatctcctcgctgcgtcgcttcaaggacgacgttcagtccgtcaaggaaggctacgaggctggtatcaacctcggcaccttcaacgacattgaactcggcgacatcatcgagaccttcgagatgcgggaagtcgagcgcaagtagtcattgttaagccccctctggcgagggggctgtcagccgcaggctgactgggggagagacatggtagttccatgattttctctcccctggcctcactgcgttcggcagcccctcgtcagagggggctcaagtctagaaaaggaaattcctatggcaggaaccaacccgcgcgccgcacgtattgcggccttgattcagcgtgtcgtcgcctcctccattgagcgcgaactgcatgacaagcgactcgccagcatcaccgtcaccgaagtccgtgtgaccaacgatttgcaaatcgccaaggtctactggacccagctcggccacgaaggccatgaggaaggcgaacgcaagcgcgcccagcaggccctcgatcaggccaagggccacctgcgttctctggtgggccacaaggctggcctgcgtctgactccgcagctccaattcgtgttcgatgaagtgcccggcgaggctcacgagatcgaagacattctcgccgtggccaagaagcgtgacgaagaactcgcccgtgctcgcgccaccgcccagtacgccggcgacgccgatccgtacaagcatgacgacgagcccagcgacgacttcgaagacgactctgacgaggagtagtgtgcttcatacaacccccagcggtctgctcatcatcgacaagccgcaaggcgtgaccagtttcgacgccgtcgccgccgtgcgcggcgcgttgcacatcaagaaggtcggtcacgccggcacccttgaccccatggccactggcacgctggtcatcgccttcggccacgccacacgactgctcaacgccatcgtggcgcatgacaaaacctacgaggctaccatacgcctcggcctgcgcaccactaccgacgatgccgaaggcgaggtgcttgtcgatgacgaagcccgctcccgctggcaaacgctatcagcgcagctgactgagggtggccagagcggcgaaccaacggcgttaccaactgcctcatggcaagacctgctcacacgcaccatcgccaccaatttcaccggcgatatcgaacaagtccccaatacgttctccgccatcaaaatcaacggccagcgtgcctacgacttggctcgcgaaggcaaggatgtggaactcaaaccccgcccggtcaccatcagcgaattcaccgtgctggatatccgcagcggattcgtagcaggggagcagaccgctgaaccattgcgggaagacgcgaacacgggagcgattcccgcacttgatgttgacgtgcggatcagctgttcatcgggcacctatatccgtgcgctcgcccgcgacctcggcaaagaacttggcgtcggcggatacctgacccgtttgcgccgtacgcgagtcggccgattcgcgttgccggacgatgccagcggacttatcgctcctgaggcgatgcttgacacgcgaacccataccgtcaccgcacataccgatcagaagacgttcactaatcgggaagggcaaaccgtcacgcgcaacaagtgcgtattggacactcctgaaggtcttgccggtgacgagcgccgcaactggctgcttgaccatgcccttaccatggaacaggccgctcgaggtgcgatgccggcgcttgacatcactcctgaggaggccagcgaattacgcttcggccgccgtattgagcgtacaatcagcgagcccactgccgccattgtgccgcaaacgcatgatgtggcggcgattatcgagcgtgcaaacgctcatcaggccaagccggtcaccgtattccccctcgcgtaaagtagacgcggtgaaaagtgcagcttgatacaggccgcgcacaacaacgtctatattgcataaataacatcgcacggataaaaggaacagcacactgatggatatcacgcacctgacccctgacgccgaaggttcgattgaatggccctcgttcagtaacgataagaaggccgtggtgacattgggcgcatttgatggcatgcacttgggtcatcaggcggtgatcaagcgtgtggtggaactcgcgcaccagcatgatgctttttccgtggtgattctgtttgatccgcgccccgcattcgtgcacggctgggtcatctcgcaccatggcgaagaacccgcggtgcagaacgtggatgccgaagccttgaccagtgtggatgatcgactgcaccgcatggaacagttcggcgtggaccacgtgctggtggtgcactacacgctggccttcgcagctatgtcatacattttcttccttggccgactcaccggcaagctgggtatgcgcacgttggtccttgggcaggatgccgccatgggcaagggtcgagaaggtgatgtgaagcatatcgccaatcttgccgccgccaccggtgtattcgaacttgatgtggtcgatgaccgtggcccgggtgaagtgcgtattccgcgcgatttcaagccggaagccccgagcgaatggggagagcccgtcgacccgctggccaatgccaccaaggccgagcgccgcgcatggagcaagaagaaccaggccaaggcaatgcgcgcatggagctccaccaatgtgcgctacctgctggctcatggccgaatccaggacgccaacgccattctgggtgctccgcactccatcgagggcgaagtggtgcacggtgaggagcgtggccgcaccatcggattccccaccgccaatcttggctccgacattgcaggctacattccggtcgacggcgtctatgccggttggctggtagatggtgaaaaccgttggcccgccgccatctccattggcaccaaacccaccttcagcgagaaaacaggccttaatgagcgtgtggtggaggcctactgcatcactgaagaatggatcgacctgtacgaccacaaggttcgcgtcgaattcgtcggcttcctgcgcccgcaggtcaagtttgatggccccgaccaactcgtcgacgaactcaagcgcaacgtcgaggagaccaagcgtcttaccgcctgaggcatatctcagggctatttacgcactcccaaggcgtctaatgcgtcggacaatgtgttggactccaccagctgaagtccctcgacatgcaccggcttgcgcagtggcggaatgaccgccgtggtgaagccgaggcgtgcggcctcgcgaaggcgatattccatacgcggtaccgggcgcacctgaccggtcagggaaatctcaccaatggcgcacgtggctcgcgcaatgggttttgacgtggcggcgctcgccagtgccgccactatcgccaagtcggaaccgggctccttggcctggcccccggcaatagtggagatatacaggtcgttggacagcaggttgagcttgctgtgacggtagagcaccgcgaccagcatggcgatacggctggggtccacgccattgaccgcacgacggggtgtgggcagcaccgacgtggtgaccagagcctgtacttcgataggcagactgcgatgcccatccaatgtgaacgtcacgcaggtgccttccacgggtgccgcgttggccgcatcagggccgtctccagacaggaacaatccggcgggatcggtgacctcttcgatgccttcaccgctcatgtcgaaacagccgacttcatcggtcgggccaaaacgattcttcaccgctcgcagcattctcagcgcagtctcgctgtcgccttcgaattggcagaccacatcgaccagatgctccaatgtgcgcgggcctgcaatcgaaccatccttggtcacatgaccaaccagaaatactggaatgtcaagtgtcttagcggtatctatcagcgcgcttgccacttcgcgcacctgagtcgaaccgccggaaatgccatcgacctcctgcgagacgatggtctgcgccgaatccacaatggccaaggccggcttgttctgttcgatcagccccaatactgtggacaggtcggtggtggaggccagtaacaagttcggctccaccgcattgatgcgggaagcgcgcaaacgaacctgcgcctgtgattcctcgccggaaatgtacagcacggtgttggcgtgtgttgatgatgcgttgccccgcatcggcaccgtgttcgatgcgttgccctgcgcccggcccgactgttgggcagaccgctgacctgcccctcggaacgtactgtctcccgccacaacgcgcgcgatattgccggccgtctgcaacagcaatgtcgacttgccgatacccggttcgcccgctatcagcgttactgaacccggcaccacgccaccgccgagcacacggtcgaattcggaaaacccggtaccgagccgctcgacgctttccgtgcccacttcggtaatcggacgggctgcagatctggcgttgttggcaaccgtaaccgactgcgtgcgtgatgttcggccgggagcggccgtgcgagagcctgccgccggccgagcctcgtgaaattcctcgaccgtgccccactgaccacactcggggcaacggccgtaccacttcggcccgttccaaccgcattcggaacatacatactgcacacttgatttcgccatggtctcaccctaacccaaacaccagcggacggtaaatttttaccgttcacaagagtttcacgcggcttgcgcacaacgactaaaattacggccgcctagcgtcacgcggctgtgagagaatcggggcatgactaatagtgagaactcctcgaccacgcaatcccatggcaagttgattgcagtggtggttgccgcagctgttgtgattatcctggcagtgctttcggcctttgtgtggccgggttgggccatccagaagaatgatggcacctccactaccacccaaaacagccagcagaaaaccgaatcatccgagccgaccaagccgaccatcgacgccacagctttgccggatgatgccagtgagctgttgaaggccatgccgggcagcgtgctgaattacgcgcgtaccaaggcggatgcctccacgacgtggaattccgcgtcgccgctcgaggagtacactctgacctactccactggtgatgccgccaaggatgtcacgctggtcgccgcgcagtggtcgtcggcggacaatgccaagacccagtacgatgcgttggtcgctgcgcagaccggcgatgagtcggcatccggcaacgtcaaggtttccggcaacgtcacgggcgcgtacgtggtgaaggccgatgcctccaacagcaagaacgccgttgccatctggcagaacgataccgtggtcttccaagctaccggcaccaaggaagcggtcgatcgcttctaccagaagttcccgatgtagcatctagtatcggctgtcagctgctgcacaaacttatgaacgttggggcatccacattgctgatgtggatgccccaactgcgttcagggcatatgcggactatcggcaacatactggttccctctgtctggcaacacgtgtattatggtgcgagttgcaacttttacgattaatcgaaatggaggcttcagatgggttctgtcatcaagaagcgccgcaagcggatgagcaagaagaagcaccgcaaactgctgcgtaagacccgccaccagcgtaagtagtcttacctgcaatcaaggcattagaaaccccgtgatcgttatggtcgcggggtttctcttttgcttggctctttgccttgttcgggcaacagtaaagcccgcacctgcgatgtgcagatgcgggcttggaaaagcttagtgatgtgagacgatcacttgttggcgttggtcatcacgcgcgggccgttcgggtcgccgacgatgaccttgtcgaccatgttgaggaacaggccgtgctccaccacgccgaccgtgttgatgaggtcttcggccagctcctgcgggtgatcgatgcgctccaggtgcaggtccaccacgaagttgttctcgtcggtgcgcacttccttgccgtcggcgtcaagacgaagcaccggcttgtagccgcgggcctcgaacttcttgatgacttggccggcaccgaacggaatgacctcgaccggcagcgggaacttgccgatggtgtccacaaccttggactcgtccacgatccacacgatctggttggagttggtggccacgatcttctcccacagcagagcagcgccgccgcccttgatgccgttgaagttcttgtcgacttcgtcggcgccgtcgatggtcacgtcgatgtggtccacgtcgtcgatgtccacgatcttgatgccgtagctctcggcctgggcctgcgtgcggcgagacgtggtcacgccagtgaactcaagaccttcctcctgatgacggcggccgagctcgtccaccaggaacttcacggtcgaaccagtgccgaggcctgcgatcatgccgttttcaacgagcttggcggcttcgatgccggccgccttcttcagcgcatcctgctgtgccttatccatggtttctcctttgccatccttgcctccgccgcatggatcaacggcgtgaagccttatctcctatcctaacgcgaatgagcgattttgtgtcatcgtgtccgattgcggtacatattcgtgtgtttgggtgtcagtgtcgtacgaatggtgcgttggtgatggtcaggttgccgtcgccgtccacatagccttcgatttcgatgctgcctttgatcggcatcggctgcccgttgaaatacgggctcgttttcggcgcgggggagaaggtcagcgtaccggataccgtcagcccgctgggctttgcggggggtacaggttgcgttgattgtacaggttgcgttgattgtgccgctaagggtgacgaagacttggtctccggccttgcggcatccgtctgatccgtcgccgcagccggcttgcgcaaacttgccgcatccgctttgccgtccaataccaattgcacgtctggaggcacatcggtgccatgtgcgtattcggagcccagcagcgactgccagccttcaatcggtagatagccgtcgcgcgcacccgaacggcaatcgcccgcataggtgcgtgccagttcatcgaccagctcattgccttcgttgccggcgtgacctttgacccatcggaaatccaccgggccagggcgttgcgagatttcacggtcgatcgcctgaataagctctttgttcttcacgggttttttctgtgaatttttccagccattcttcttccagcctttgacccacttggtcgagcaattgatggcgtactgcgaatccgattcgatgagcaatggctcagggcccggatgcgctcgcaaagcttccagcactgcgcacagttcgccaatctggttggtgccgttggtcgcgccgccggcgtcgtagccgtggtcgtcgtgcttatggccgggcttgccgccggcgttctgctcatgatcggcccaggcccagcccattggcccgtttggattccctaatgcggaaccgtctgtggatactgtgatagtcatgttctccaccctaacgcaagctgtgcaatctcttgctgaagtggggctgcccagcgcgaggcaaaacaacgtagtggagggtgtggataacatcacacctattgactttgcttgaaaaacatgccatcgcgcgtgaataggtgagcgctcacaagaaagacaagacatttcctctctgcgggtgaggccggcaacaatggcgcatccggtatctggaatgagaataagggactgtacaaaaccagtgacggcaacatcgaaatcctcaaaccagaggcggacagcgatggttcgacctccacggccgcatccaagggcaccatgcttatcgcaggcaactccaaaaccgtggcactcggtccaggcggcatggccttggctcccggcctgccgctcggtcttggctggttcatccgacgccgcttaggattggatgcctccgacattctggaccgtaagctcggcttgaagtaacggctggttcggacgtgattgctgtcacgtccggatcatgacgacagcgcgaaggtcctcatcggtttacgtcgatgaggaccttcgcgcgcattaggggagtctgttgcgggctgcgctacgcgggtcatgctgcgcgggcgtgctatgcgaacaaactacgcgaacaagtcgttcagtgcctcggcaatcgtcggatgcgtgaacaccatatcgcgcaacgtgctggccggcgcgtcaagatccatcgccaacttgacgatattgatcacctcgtgcgactcgacggaaagcagcatcgcacccagaatgcggccagtattgcgttccacaatcgccttcatcagaccatccggtcgccgcattacctgggccttcggcacagcggccaccggcaatcgcttgaccacataatccaatccagccgccttcgcctcgcgctcattcaatcccacgcgcgagtaaggcgtggcgaggaatgtgcttgacggcacatgcttgcggtccttcaccgtgtacggacggtcggaaccattgagctgcgaccacaccacgcgatagtcatccagcgaaatgtacgtgtgctgcgggccgccgttcacatcgcccagagcccaaatgtcggctgctgtggtgcgcagaagctcgtcgactttcacggcaccgcgttcggtgagctccacgccagctgcctcaagatgcagtccctcgacgttcggcgtacgtccggtggccaccagtaccgcgtcggtggtcaggcagaatcgggcttcagccggctcggcgaaccgcggctcgccatcatctgatggtttcgtttgaacgtgtgacatcgtggcgtgatcggtcgggttgctagtggggctggtggttgttgtagtgtcggtggcgccggtgatatcggtatgagcgttcccggtgccggcgggggtggaatcgcaagcttgcgatgcgccgcgagtcatacccttcaccgcaacggacaacctgacgccgccgtcagcagcaggcgcgatggccttggtatccgcgttgaacaggaacttgacgccctgcgcttccaactgtgcgcgaatcgcggccgccacatccgcatcctcgcgcggcaggaactcggcattgtgctgcagcacggtaaccgccgtgccgaaatcggcaaacatcgaggcaaactcaagtccaatgaatcctgaaccgataatcaccagtcgctgcggcatatcgtcgagatccatcagtccagtgctggtgtagacgccgggcgtagtgtggataccgggaatatccggaatgcgcggcgtggcaccggtattgatgaagatcttgctggcggtcacggcgatcgggccctcagcggtggcgatttccacgctatgagggccggtgaagtgagcgcggccggtgattacggtgatgttgtcttggtcggcgagcttgtgatagttcttgtcgcgcagcatcgaagtgacgcggcgcttctccttgatagcagcctcgaacgctgcttcgcgggtttcgggagtactgttcgcgccatcccgccgcgcctgttcggcggacaaaatcagtgacttggacggcaagcatccgatattgatgcaggtgccgccgtacatgtcggcgcttgcctcggcgacgacgaccttgcggccggctgcactgagcttggcagccaaggttttgccgcccttgccgaatccaatgatcagggcgtcggtggtgatagtgggggaggtgctgggtgtgctgatggcattgggtgtgctgatggacatggttacttccttacgtattcgagtgataagagtgcgttgtgctgatgtgttgtgtgccgtgcggcgtctgttttcttctttgactgccgaagcgttatcgactgatgctggctaggggaaacgcgcgggattattagcctttgcgctcgctgaatatctgttcggtgatgtcgtggatggtggtgtgttcgagttgttcgaggcaagtgcggttgagcccggcatagatgtcgttcatcactgcgcccattgaagatgacaccagacagtcctcgtgtacgtcgcccggtgtccagttcactttcacaaaagtggtgccggtggcttccgctaccgcgcgcaaagtgatttcggcggcgggccgggccagagcgtacccgccttcagcaccctctttagtggcgatgagtccggctgaggcgagcggtcgcattactttgcgcacgcgcgccgcattggtacatatgttctcggccaggatctgactgggcaggtgtgtggcgcgatggtcaaggtagaccaatgcgtgcactgccagtgaatggtcgccgttcatgaaacgacctccttaccgagtcgaactgtagctatgatgtgtacagttatgatactgtaatcatatcagatacagttagtgtgtcaaatcggggttgaagaggtggatgactatgtgtataagtgaggtgtccacatggttatccacaatgaatgtgcgtaagtgaagctaggaccacatacctcgaatcggcttccgtttccgcacccactacccatatggtggtgtcatgaacaggatgaccgacggcatcaccaactatggagctctgccaggctctatatacgatccgcctccggaagaatcggagacagtttttgttccgcccgaatttgcgggggcattttctgctgactcgaaatacccgacttttcgcgactcgccatcgccaaacagtggtgcacatgattctgcggcggcaccgaccatgagcgaaagccttgcccagcgcaaacgcgacatggtcgcacgctgcactgaggaagcgaaacgggcgggcaagaagctgcttttcggcatgaccacttccctcgctctgcaatccgtaccgattcccgccgattgcgacctcgactcggccaagctgcacactgtatccagcgttaagagcaagcggtttcgtacacgccatgcaccactgcaaacgcatatttggaaacatgcggctaaagccgccaatgtggaaatgaaccaacacgtgtttgcgctggacctgtttcacgtatgggctcaacttgccccgtatgtttcttttgagtccctgattgtgctcggggatgccgtcatcgctgctacgagcaaacagccagtattggccaaggatcgtgatgctgctgcaatctatcaggatctggtgaagttcgtggagcgatttacccgattcagagggcgcccgtcctgcgttcgagcattgccgctgatatcacctggtgctgattcgcccaaagaatcagaagaacgactctctctggtagcgcatgggattccacagccggttgcgaactatgtggtgccggatgcggcttttgcatctggagctcccataacgttggacttagcgtggccggagttcaaggtcgctgttgaatatgatggcgatcatcatcgtacgagtaagactcaatggcgccgtgaccaagagaaaaggggtgtgctggtcgggcggagatggctggtcttcgtcgccacggcggcaagtatcgctaacgaggatgctcgtgctgaattcgctttcaatgtggcgagggcgcttgcttcgcgcggtgccgtattcgagtttcatgtagttgccatgtctcttgaagagttgtcgcagagcctgctgtgaccataatgtccgaaacggactgatgtaaaggcaatatttgtacgacctgttgttgtggtgtgtgcttgatattgcatgccgttcgattgtgatgcctcgtagtgatggatttcgtgaatgactagtgttcgattgtggaggaaaatgtgtcatagtggtcgattggggggggggtattggtgcattgagcgtggatttgcgtcaatgggtgtgggacgctgcgcgtgttttgccgatttttgcgtggcgtcccacggcccctcgggtaatggctatgacgggtgtggcaggaatggcgtctttccggggtttccagtttgagtgtgtgggatgggggggtgtaaaacgattgacttagctgttgtcccacgcttttgtgggatggcaactctggaatgggcgaattcgtcgtggcgtcccacaacgatgttaaaactcgaccatgatgcaagccgaccgaacgcttcggtggtcatctggccgctgtgaccccacaatgatgatggtaggcaggcgaacgtttcgcggtcatctggccgtcctgccctgcagtgatgttgagaaaatgcagtcacggtgcatgaggagaaccgttgacctgcgtgtttcagtggtcgcgaactgcatatgcgctaaaaaagctctgcagtggattgcatgaatccaatgcagagccttattggttgcggtgaacgcgactaacgcagcgatttcactcgctcagggccttgtcgaccacgacggtggcctcgtcgagtaccttgtccagagcctcgggggagacgaaggactcggcgtacaccttgtagatgttctcggtgccggaggggcgggcggcgaaccagttgtccttggtggtgaccttcagaccgccgatcttggcgtggttgcccggtgcctcggtcagcttggcggtgatgtcttcgccagccagggtggaggcggtcacgtcgtcgccggacagtgccgcgaacttggccttctgctccagtgtggtcggggtgtcgacgcgcttgtaccaagactcgccgaagcgctcgacctgctcctggtgaagctgggccgggttcttgccggtcttggcagtgatctcggcggccagcaggtcggggatcagaccatccttatcggtggtccacacgcggccgtccttgcgcaggaagctcatgccggagctctcctcgccgccgaaggcgacttcgccgctgaacagcgggtccacgaaccacttgaagcccaccggcacttcgatgaccttcgcgttgatcgatgcggccacgcggtcgatcagggaagaggagaccagcgtcttgcccacggctgcgccctcaggccagcccggacggttgccgccgaacaggtactccacgcacacggcgatgtagtggttcgggttcatcacgccccagttcgggcagacgatgccgtgacggtcggcgtccgggtcggtgccgccgaccagatcgtacttgtcccaagcgccggcgttgagctcgtcgaccaggcccttcatggcgtacggggaagacgggtccatgcggatcttgccgtcgtggtcgatggtcatgaagcgccaggtcgggtcgacctcaggacgcaccacgccgatgttcaggccgtacttctcgttgatgagcggccagtagttcacggaagcgccgccgagcggatcgatgcccagacgcacgccggagttgcggatcacgtcgaagtcgatgacgttctccaggtcgtccacgtagtgctcgcggaagtcgaagccctcgacgtactcggacttgatggcctcctcgtagggcacacgcttgatggacttgaagtcgccgagcagctcgttggcgcgagcggcgatggcattggtggtctcggccggagccgggccgccggtgacggggtcgtacttgaagccaccgtcggtgggtgggttgtgggacggcgtgacgacgatgccgtcggcgaggccctcgccctcgaagcgctgggtgccgtcggccgcacggttgtgggtcaggatggcctgggagaccaccggggtgggcacgaagtcgtcacgggaatcgacgcgtacgtgcacgccgttggcgacgagcacctcgatggcggtcttcttggccgggccggacagcgcgtgggtgtcggagccgaggtacagcgggccggtgacgccggccttcttgcggtattcggcgatggcctgggagatggcgatgatgtgggcctcgttgaacgaggtcttcagggacgatccgcggtggccggaggtgccgaagatgacacgctgctcggggacttcgggatcggggacgaggtcatagtatttgccgataacctcatcgacattgatcagatctgctggggtggcgggctgacccgcattgtttgctaccatgctccctattctgccacgttttttcgccacgttgggtacgattatgttaagagttgtcaacttttgtgcgaatcgtgtgccggttgtctagcgcttggtcatttcctcctcgatttcctccagcgacttgccgttggtctcgggcaccaagcgcatcacgaacgggatggacagggccgaaaacacgccgaaaatcgcgaacgggccgcccacattgttgccgaacgcatcgagcagcacgaggaagaactgggagacgatgaagttgcccagccagttcgccgccgagccgaaggaggagccgatgccgcgcacgctcagcgggaagatctcgccgataagcacccaggcgatcgggccccacgagaccgcaaagccgaggatatagaaagcgatgagaatcatcgtcggcacggccagcacggccacgtcgcccacgaagttcatcacggcgagcactgcgagcgaaacggtcatcacgatggaaccgaagatcagcacgcccttgcgcgggaaacgatccatgataagcgtggccacgatggtgctcacgaagttcaccacgccgatgcccaccgacacccagattgcgtcgccttcagggaagccgaagcccttgatgaacacctgcggcaggaagtagatcaccgagttgatgcccacgagctgctggaacagcatgataccgatggcggccaccagcgccggacgagcgatacggaacagttcgcgcacaccacccttggtgtcctgtgcggccacggccttgatttcgtccagctcaatctgcacctgggtctgatccacgtccttgcgaatcagcgtaagcactttgaaggcgttgcgggtgtcgcccttgttcaccagataacgcggggattcgggcagcaacaggccgccgagcagcaacaaggcggccggcaccagcgccgaaccgagcatccagcgccagtcgcggatgccgaagaggttgtggttcaggaatccgaggttggaggcgtaggccagcagaatgccgaaggtgaccatgagctggaacagcgtggacagtgagccgcgacgctccttcggcgccagttcggccaagtacgccggggtcagggcggaggccgcgccgacggcgagacccaggatgatgcgggcgcacaccatcatcgcgaatccggtggaggaggcgcacaggcctgagccgagcaggaacagcagcgcggagacgatgagcagcttcttgcggccgaaccggtcagacagtgcgccgatcgacagcgcgcctgcgcacgagccgatcagcaccgaggaggtgatgaaaccggtctgagagacgctcaggccgaagtccgattcgataagcggggaggcgccggagatgatgccggtgtcgaaaccgaacagcatgccgccgagcgcgccgaaggtgaagatgaatgcgctgttgagcgggaagcgcgtggagaagccgtgcgattcggcggcttcgaggtcctcgattgcgttggctgccgcgtttgtggccgcgcccgccactccggccacgccggtttcgatggtttcgattgcggtggccgccgccccggttgcgctggtttcctgcgccgcggatgccgtctgtttcgatacgggtgatgccgttgtcgtcgtcattgccttgtcctttcgccgttgacggaccgcgcctgttgcgtggcccctctgccgcgtgcaaggtcaggcttcgattgtctgaagtcgcccgaaaacaaaaaaagacctggaacaacgtggaattcgcatattacgatacgcaaattccacgtcgctccaggtcttgcctcgttttgagtaacaaccctgctacgcaacgtgtgtgaaagatagaatacgacttccgcagtcgcgacactccgaataggcagcaaaaaacgatgatttttgacaacgattgcaggattctgcatggtggaatgatgtcggaatgggcgctgcggcaaatacggagaacgggtgtggcgaagcatcatcgcggaacattatggcgggacaccatcgcggagcaccgtagcgcatagttgccgtttcgcgatgctttgccggcattgccgtgcttttggggcacccagcgccgataatggaacacagtggcatacggcagcaaggaggaaccgtggcgaacgcatcgaacgcaacgcctgcagtgattgcggcgcgcatcgtcgatgccgtcggcggccccgcgaacattaccagcctgacccattgcgccacgcgactgcacttcgaactggccgatgccggccatgtcaaccagcacggtctcgaatccatccccggagtcctcggcgcattcccgcgaaccggcaatcgttatcaggtcatcatcggcggagcggtcgcctcggtgtacgagcagatcgttcggatgcaggcagcgcgattgactccggcaacgcaattaccatcggcggcgtcgcggccaacgcagtccgcgcaatccactcagtccgcgcaatccactcagtcaacgcaatccactcagtcaacgcaatccactcagcctacgcagcctacgcagtccgcgccgaacctttccgacgacgtcgcaccattgcgcgataccgacaccgagcagagtcacggcccagccaatacatcccgtcacttcacgcctcgtaccgtccgcgagtggggcagtgccgcccgtgcccgggctgccgcgtttttcgactacctgtccgactcgttccgcccgattctgggtgtactgctcggtgcctcgctggtcatcgccatcgtcaacgtgatcgttgcactcggcattgtgcctgatggcgagacgtccaccggttggatactactcaaggcgatttgggagggtgtgttcaccgttctgccgattatgatcgcttacaatgcggccaagaaactggacgtcgacccttggctcggcggtgcgattatggccgcgcttatgaccccgcagcttactggcgtgatgtccggaatgtccgggacgtccgtatccagcgctctctccggggagattcaatgctcggccaccgccacattcggcaccgaaacctgcaccgtgtcggcgttcggcataccgattcaactcaacgactacagtggcaacatcttcgtaccattgctcatggccgccgtgctcgccgtggtctaccgcgggctgaagcgcgtcattcccgacagcgtacagctggtgttcgtgccattcctctcactggtcgtcgtttttgcgctcaccatactggttatcgggcctctgggaatatggctcggcagcgggctgggagcggccacagcatggcttaacgcgcacgtgccattcctgttcgcgctcatcatcccgatgctctacccgtttctcgtgccgctcggtctgcactggccgttgaacgccctgatactgatgaacattcagacgctcggctacgacttcgtccaaggtccgatgggtgtatggaacttcgcctgcttcggtgccaccgccggcgtgctcgtgctggccgtacgcggcaaggattcggccatgcggcagaccgcggtgggggcgttgctcgcgggattgctgggtggcgtttcggaactgagcctgtacggcatccatctgcatcaccgccgcgtctaccgctggctgctcgccggctgcgcggccggcggggtgaccagcgcggtgttcggctggctgttcccgtccgtgctgccatccggccagatggtccggggcgttacgactacggcattcgccttctcctcgttgctgacgattccggtgttcgatcggatgtgggtgtacgcgctgtccatcgccgttgcgtttgtaatggcgatggtgctgacggtgctgttcgggtaccgtacgccgccgcgcgccacggaggcgcagatggtctcggcgggcgagaacgcacgcccgcaggatatggcgagggggattgacacgaccgtgtcggatgtggagtctgcggaagattctccatcgcgggctgcccctgatcgggctcttgactccaacgccatcttgtcgccggtcgccggccggttgatgaatctggaagcgactggcgatccggtgttcgcctcccgcgcgctgggggagggtgtaggcgtcgtgccggagacgaccggtgagacagccgtgctcgcaccggtcagtggcatgctgaaaaccgtggcccgaaccggccatgccttcggcattaaaaccgatggcggcatcgaggtgctggttcatatcggcattgacaccgtcgatatggatggcgagggattcgctgtggtcgtggctaaaggcgagcgaatcgcggcgggagagccactggccaccgtggatttcggcaaagtcgcggcggccgggcacagcgttgtggtggtggtgacggtggtcaacgccgctgaactgaccgtggtcacgccgttgatcggcgacggtagcggcgacaacaacggcggtgactgcaaaaccgtatcagccggcagcccgatcatcgatgtggaacaatgacgttgcgaaaggatgccatggaaatactgcgagtgttcaacaacaacgtcgtgctcgccaaaggcggcgacggcggtgaggtgattctcaccggccgtggactggggttccaggccaagccggggcagacggtcgacgagtcgaaagtcgtgcgcaccttcgtgccgtcggacgggcgtgacccggaccatctggcgcagatgctggcggacattccgcccgaaatcatccgcgtggtcgtcgaatccatgcaggaagccggactgggggagcgcgagaccggcagcaccacgctggtcatggccctgtcggaccacgtggcgaatgcggtggagcgggtgcggcgcggcatcgacatcacctacccgctgctcggcgaggtgagcaacctgtacccgcaggaatacgcgcaggggcgtgcgatgctcgcatcgctcaatgcacggctcgacgtcacgctgccggacggcgaggccaccgcgcttgccatgcatctggtcaacgccggcttcgccaccggcgacctgtcctatacgtacacgatgacgggcgtgatccagcaactgcttgacatcatcgaccacagctacggcatcacgttggaccgcagttccgtgaacgtgggccggttcatcacccacctgcgctacctgttcgtacgcatccaccagcaccagcaactgacggacgagccggcaccggtgatgaaggtgattcgtgagtcctaccccgccgcgctacgatgcgcgcgaaccatcgcctccctgctcgaactgcgcctcgacacggatatcagcgacgacgaaatcgcttatttggcgatgcacgtcgcccgagtcaccggccacgcatcgtagcggatcagcgaatcggctcgagtgtaccggtcatttcggcgaaattcgaggtggcatttgaagcagcggcctgcgcggtcttttccagcgcggaggcgtcgggcacgcgcacgatcagcgcgcggtgatccaccgagaaacggatgtggcgggtttccggcagcatgtcaccgtccacctgcgctttggccggcttttccaatgtgatttcggcactgacgccctgaacctgttcgatggtcgagttcgtggacagcgggttctgttcgggcttgccgatgatcgtctggtgcaccacgtcgccgaacaggttggcccagccgaggatgccgccggtggtgtcgatgatttcgaagtccagcagaccatcgtcataggatgccgccggcatcagcgagaacatgggaatctggccgcagttgccggccatcaccgtgcggaaatcgagattcttgatggtgtgggtcgagccgtcggcgctggtgactgtcagcgtgccgcggaacttcggcgcgaacaggttcttcacgccgcccacgaagtaggcgagccagctgatgttcgccttgagctcggggttggtgtcgtcgatcatggccgcatcgaagccgatgccggcgatgatgaggaaggcgtggccgtggtcgtcctccgggtggtcgagcagggtgagacggcccatgtccaccaggcgggagccgtgggaggtggccacggtcagcgcggcgtcgatatcgtccacgggaacgcccatattgcgggcaaacaggttgccggtgccgatggggatgatgcccagcgcatggccggtgccggagacggcgctcgccaccgtgcgcaccgtgccgtcgccgccgaccgcgatcaccacgtcggcgccgtcctccagcgcctcaagcgcgcagaccctgccgtccttgtcaagctgggtgtcgtagaagcggatgcgattgagccccttggcctcgcagaacctctggatatgcagcctgcgggcttcggcctgcggtttggacggattcacgatgaaggcgtactgcacctcgtcgtcccggcgcttctccagcgtctgagccagcttgcggcggcgctgcgcgcgcagagcgatgacgatgacggcgatgagcaccaccacaatggcgattgcggcgatgatcagaaacacggtgagggcaggctgaggcatggctcctattgttatcggtggggaggtcgtttgcggccatggtgcgccgtacgtgaacatttcctgcacgcaacagccccgtggggcgtgattatggttcaatcgcgtctcatctgacgaaattggccgggtggacccgtccgcggactttcccgggcttccctgtgatttccgcgtgactcccgcgcattcggccattgtcggtgtctgcttacgcggctagtctggtgcccatgcttgatattcaattcatccgtgaacacaccgatatcgtcaaggaatcccagcgcaagcgcggcgagtccgtggaactcgtcgacgaagtgctctcctccgacaccgcacgtcgtgaggcgctgaaggccttcgaagaggctcgcgcccagcagaaggaaatcggcaagaaagtcgcctccgccccggcggacgagaaggccaagctcatcgccgaaaccaaggaactgtcccagaaggtctccgaatacaagtccaaggccgattccgcagccgaggaatacaccaccgccatgtggaagctctccaacatcgtggagcccgaagctcccgaaggcggcgaggatgactacgtggtcgtcaagaaggttggccagattcgcgacttcgcggccgaaggcttcgagcccaaggaccacctgaccctcggcaccggcgtggccggcatcgacatgcgccgcggcgtcaaggtcggcggctcccgcttctatttcctgcgtggccaggtggcccgcatgcagattgccatgctcaccatggccgtggaccaggccgaagagcacggcttcacgctggccatcaccccgacgctcgtgcgccccgaggtcatgcgcggcaccggcttcctgaactcccacgccgacgagatctaccgtctgcgcgagcccgatgaccagtacctggtcggcacttccgaagtggcgctcgccggcatgcacgagaacgagatcctcgacctcggcaacggcccgctgcgctactgcggttggtcctcctgctaccgccgcgaggccggtgccgcaggcaaggatacttccggcatcatccgcgtccaccagttcgacaaggtggagatgttcgtttacgccaagcaggaggactcctacaaggagcacgagcacctgctggccatggaacaggagatgctcgccaaggtcgaggtgccctaccgcatcatcgataccgccgccggcgacctcggttcctccgccgcccgtaagttcgactgcgaggcttgggtgccgacccagggccgttaccgcgagctcacctccacctcgaactgcaccgagtaccaggctcgccgcttgaacatccgcgagcgtatggaagacggcggcacccgcccggtctccaccctgaacggcacgttggccaccacccgttggctggtcgccatcatggagaaccaccagcagaaggacggctccatcgagatcccgaaggccatgcgcgcctacatgggcggcaaggaagttatcgagcccacgaagtgggaggcctgagtctcatcgtgctttagctccctctgatgagggagctgtcagcgtagctgactgagggagagattactgagggagagatcgctgatagccagcaggcgaatccaagaccgaccgcactgccgaatatcaacatccctcccttctgtataatgaatacttgcgcgtgtgaacgcgcatcaggacaggtgtctgagcggcctaaagagacggtcttgaaaaccgttgaggggcaaccctccgcgagttcgaatctcgccctgtccgcgaaccgaggcctgggcaacatgcccaggccctttttttctttttctggaacctgtcttcttgattgccgccggggtgctgatatattggtttgtgatgccgtaacatgcggtgtccccgttgatatgacgggccgatcggcgtgagccgataagaaaaggcccgacgtttgcagcatcgggcctttgcgttgattaccggcttgcgcctttaatcaacaaggttgcaagatgaatcatatcacgatgcacggtagtctgaccgtgaacgggcgcaccgtgatcgtccatatgggcgatggcgaggcgaacgccacggttgacggcacgcacttcaacgtgcgtagcctgtggcagctctaccagttgctgagactgctcgtgtagcgtctcattaaggtgcggtgccccctggtcgggtatcgcgccggcgacctgaaaaccgataatgttggcaagtgcttgcaatttgcggtggacgattgcaagctaacgtcttggattgttgccgctatccaatatctcattaggcctaccggtggaccaaaagtacgttgctttgtaaggggagttaatgaaatgaacaaactcgcacaatcgagcatcgaaccggtttaatgctactcgcctcaacgggacgcgcggtaattgttagctaagttgacaataaaagaatgagggcatacattagtaatcagtcatcacactgagatgatgatttcactacgaaggagtagagatatggtatctcgcaataagcgcatcgtggctgcttttgccgcggtagcagcaatgggaatgggcttggccggttgcggcagcgacactgccggcgacacgaagaccaccgatgatggtggcgtggtcaacatcacctacatgcaccgtctgccggattccgagggcatgactctggtcaacgacatcgttgccaagtggaataagcagcatccggatattcaggtcaaggccaccaagttcgatggtaaggcctctgacatgatcaagaagcttgagaccgacgtcaagtccggcgaggctccggatctggctcaggtcggttacgccgagctgcctgaggtcttcaccaagggtctgctgcaggatgtgacccagtatgccgagcagtacaagaacgacttcgcatccggcccgtacagcctggttcaggttggcggcaaggcttacggcctgccgcaggacaccggcccgctggtttacttctacaacaaggctgagttcgagaagctcggcatcaccgagattccgcagaccgccgatgagtttatcgccgctgccaagaccgctgccgccgctggcaagtacatcatgtcctaccagcctgatgaggccggcaacatgatctccggtctggctggcgcctccggtggttggtacaaggtgaagggcgactcctgggtcgtcaacaccgagaccgatggctccaaggcaaccgctgacttctaccagcagctgctcgacgccaaggcagccaccaccaacccgcgttgggatccgtccttcgatgcatccatcaaggatggctcgttgatcggtactgtggccgccgcttgggaagccccgctgttcatgacctcctccggtggcaccggctccggcgaatggcaggtcgctcagctcggtgactggttcggcaacgctggcaagaccggccctgacggtggttccgccgtggccgtgctgaagaactccaagcacccgaaggaagcaatggagttcctggattggttcaacacccaggttcctgatctggtttcccagggcctcgtgccggctgctaccactgaagacgctgagactccttccgagtggtccaccttcttcggtggtcaggacatcatgaaggaattcaagaccgctaacaacaacatgggtgacttcacctacatgcctggcttctccgcagtcgccgccaagatgaacgaaaccgccgccaaggccaccgatggctccggcaaggttgcagacatcttctccgacgcacagaccacctctgtggatacgctgaagaacttcggcctgtctgtttccgagtgacattaacggttagggttccttccagccgctgatatcctcaaccacacatcgaaaggccggagctcaacactccggcctttccttttactcgagttcggttcgtcattaattgtgtttgatctgactgcatcgattcgaactgcattacgtactttctatttctcactgttcttttgaaagacaggtttccctatgactgcaacaacaaaaacggcgaagacgggggtcgccaggcgtgccgataagccaaaggcttctgatgctgtgaagcgtgagaatcgtaccggctgggccttcatggcaccgtttggcatcctgttcgctctggtatttattcttcccatcatttgggctatttattccagcttcttccgccaggtcaccacgggcggtggcgcatacggcggcggggaactggtcgataagttcgtcggacttcagaacttccaatacgttattacttccggcaacttctgggctggcgtgggcagggtagtgctctacaccgtgattcaggtgccggtcatgatcatcgcggcacttgctctggcaatgctcatcgattcctatatcgtcaagcacatcaccgcattccgtctgagctacttcctgccgtacgccattccgggcgtggtcgcatccatcatctgggtgtacctctacaacggccagatttcccctatcgttaagggacttgccgccatcggcatcaaggtgaacttcttcggcgacaatgtggtcctcggctctatggccaacatcacgacctggaccttcaccggctacaacatgctgatcttcctcgccgcactgcaggccattccgcacgatctgtacgaggccgcacgcatcgatggcgccagtggcttccagatcgccatgaagatcaagctgccgaacgtgcgtgcagccgccctgcttgccatgctgctctccatcgtcggcaccatccagctgttcaacgagccgcaggtgatgtcgatttccgatccgagcatttccaagtcgtacacgccaatgatgatggccctcaatacctcgcagggcacgctgaccccgggtggtgacggacctgcatccgctgtggccatcgttatggcactgatcgctggcgtactcgccgtggtctacacgctcgttgaaaggaaggtgaacgcagaatgagcaccgtagaagctactgataaggaatcccgcgcggtcgcacgcgctcgtaagaaggctgacaggattcgcgacaagcatgccaacgacctgcctcgttccatgcagccttccgcgctggtcaagaccatcaccatcgttgttctggtcttcgcgctgatctactttctgttcccgatttactgggccatcatcgcctcgaccaagacgccgagccagatgaccggcagcaacggtctgtggttcgccgtgggtctgagcgatttgcctgccgccatcgccaagaactatggcacgctgattggttggacccgtggccagttctggcgctgggtgctgaactccctgatctactcgggtgtttccgctctggtgggtacgctcgtggctgtgatggcgggatacgctaccgcaaagttcaacttcaagggtaagaaccttgccattggcgtgattatgggctgcatgctgatgccggccgctctgctgaccattccgcagtactccatcttccatgccatgcacctgaccaacacgatgctctccatcatcatcccgtgctgcgtctctccgttcggcttcttcctgggccgcgtatacgcgcagacctcagtgccgaacgagctgcttgaggcggcgcgtatcgatggtgcaagcgaagctcgcatcttcttcaccattgtgttgaggattctggctccggcaatggtcacgatcttcctgttcctgttcgtggccacttggaacaacttcctgctgccgttgatgatggtctcttccgacaccttgaagccggtgaccttgggtctgtacggcatggtctctctggctaccttcactgatcgtggcgctctgatgatgggtgctctgctcggtgtgctgcctgtgatcgtgctcttcctcggtctccagcgctactggcaggccggcctcgccgctggtgcggtcaagggctgacgcgttaagcggacagcccggtgggctgtctgtagcgtcggcccgagcgaggcggtagccgagcgaaggcagcattgagtctcgccgtaggcgagtccttaattgcaggggccgaaggcgacgcgttaagcggacagcctaagaccaataattcccgccgtccggtgcctcgtgctactccttccggcgccggacggcttctcaacaataagtagcacgcaaccataccgatccagagccttcctgattcttgtcatgagattgtcggtgaaactgaccgggaagctccggtgatgttcaattcgctcttccggcgttgccgtggggctactctcaaggatttatacagtcaggatcctggacgcccgacggttgtgtcggattcttgttttatatgcatatattgtttacaatttaattatccaaaaaaataatcaatgtcctcaaaggagagactatgactagcaccggccgcttcaccttgcctagcgaggagaattttgcggagaagaccaaggagcttgccgaactgtggggagcagacgccattcgtaactccgatggcacgcatctggatgaggctgtgcttgccttgggcaagaagatttacaatgcgtatttcccgactcgcgcgcataacgagtggattacgctgcatatggatgagacgccacaggtgtatctgctgaccgatcgcattctcgccgaatcggatacggttgatattccgctgatggaaagcttcttcgctgagcagctgaagccgaatcgtgatgccgaccctcacaagtattgggaggttgtagaccgcaccaccggcgaggtcgttgattcggcgaactggacgcttgacgcggacgaggacaccgtgcatgtgagcggcgttgccgcatggcatgagtacacggtgagtttcctggcctacatcatctgggacccggtcgagatgtacaaccatctgaccaacgactggggcgacaaggaacacgagatcccgttcgacatctaccatccggccacccgcaagttcgtgttcgacacgttcgagcagtggcttaaggacagcccgcagaccgatgtggtgcgattcaccacgttcttctaccagttcacgctcctgttcgatgaaaagcgccgcgaaaaggtcgtcgactggtttggttgcgcctgcaccgtaagcccgcgtgcgctggatgatttcgaagccaagtatggctaccgcctgcgcccggaggacttcgtggacggcggtgcctacaactccgcatggcgcgtgcccagaaaagcccagcgcgactggatcgacttcctctccggcttcgtgcgcgaaaacgtcaagcagctcgccgacatgtcccacgccgccggcaaagaggcgatgatgttcctcggcgaccagtggatcggcaccgaaccgtacaaggacggattcgacgaactcggcctggacgccgtggtcggttccatcggcgacggcaccaccacccgcatgatcgccgatattccgggcgtcaagtacaccgaaggccgcttcctgccgtacttcttccccgacacgttctacgagggcaacgatccgagcatcgaaggcctcgacaactggcgcaaggcccgccgcgcgatcctgcgctcgccgatcagccgcatgggctacggcggctacctctccctggccgccaagttcccgaagttcgtggacacggtgacccatatcgccaacgaattccgcgacatccacgaccgcactggtggggtggccgccgaaggtgagctcaacgtggcgattctgaattcctggggcaagatgcgctcctggatggcgttcaccgtggcacacgccctgcccaacaagcagacctactcctactacggcattctggaatccctgtccggcatgcgcgtgaacgtgcggttcatcagcttcgacgacgtactcgcgcatggcatcgatagcgatatcgacgtaatcatcaacggcggcccggtcgacaccgcattcaccggcggcgatgtgtggaccaacccgaagctcgtggaaaccgtgcgcgcctgggtgcgtggcggcggcgcgttcgtgggcgtgggcgagccgagctcggcaccgcgcttccaaacgggccggttcttccagctggccgacgtgattggcgtggacgaggagcgctatcagaccctttcggtggacaagtatttcccgccggtggtgccggaccacttcatcaccgccgatgtgccggtcgacccggcggcccgcgaggcttgggagcaggccggctaccgcatcccgctgagcggctgcggcggcggccagtccatcaagccgttgggcggcatcgatttcggcgaacccgtgctcaacacgtatccggtcaatgaaaacgtgaccctgctgcgcgcggacggcggccaggtacagctcgcgaccaacgattatggcaagggccgcggcgtgtacatctccggcctgccctattcggcggccaacgcccgactgctggaacgcgtgctgttctacgcttcccacaacgaagacaagtatgcggcctggagctcgtccaatccggaatgcgaagtggcacacttccccgagcaagggctgtattgcgtaatcaacaacaccgatcagccgcagaagaccacggtgactttggccgacggcaccaccgaggacttcgacctgcctgacagcggtatcgcctggcgtgaagcctgatcccacgttttggagaacggacccatcatgactgaaagcaatgaagttttattcggcatcgcctcgcattttgcgctggaaggtgccgtgaccggtatcgaaccttacggagacggccacatcaacaccacctatctggtgaccacggacggcccccgctacatcctccagcagatgaacaccagcatcttccccgatacggtgaatctgatgcgcaatgtcgaactggtcacctccactctcaaggctcagggcaaagagacgctggacattgtgcccaccacctcaggcgccacctgggccgagatcgatggcggcgcatggcgcgtctacaagttcatcgaacacaccgtgtcctacaacctcgtgccgaacccggacgtgttccgcgaagccggcagcgcattcggcgacttccagaacttcctgtccgaattcgacgccagccagctgaccgaaaccatcgcccacttccacgacaccccgcatcgtttcgaggacttcaaggccgccctcgccgcggacaagctcggccgcgccgccgcatgccagccggaaatcgacttctatctgagtcacgccgaccagtatgccgtcgtgatggatgggctcagggacggttcgattccgctgcgcgtgacccacaatgacaccaagctcaacaacatcctcatggacgccaccaccggcaaggcgcgtgcgatcatcgatctcgacaccatcatgcccggctccatgctgttcgacttcggcgattccatacgctttggtgcgtccactgctctggaagacgaaaaggacctcagcaaggtgcatttcagcaccgagctgttccgcgcctacacggaaggcttcgtgggcgaactacgcggcagcatcaccgcgcgcgaggccgaactgctgccgttcagcggcaacctgctcaccatggaatgcggcatgcgctttctcgccgactacttggaaggcgatatctactttgccaccaagtaccccgagcataatctggtgcgcacccgcacccagatcaaactcgtgcaggagatggagcagaaggccagcgaaacccgcgccatcgtagccgacatcatggaggctgccaggtgagccgtcagccgaaccatacccgaaccagcatgatggaggcagagcaatgaacgatcagctgaccgaggtatacgccagcatcgacgccctgatcgattatgccttggcccatcttgaccttgacccacgcaacgcagactggacccgcaaccaaatcttcgccctcttccgcctagattcctaccccggacccaaaaccacaacgtcggcggcgtcagtgtcagacgtagtccaagacattgttggcagccgaagccaggccccctatggcgaaaagacccccgaccccctgctcgccgccttccgcgccgccgccacaaccgccggccttttcaagccggaggaaggcccggcctacgccgacaccatcatgggcatcctctccgccaaccccgctgatctcgacgaccgattcctgctcgtcgagcaccgggatggcggcatggccgccatgcaatggttctacgactactgtgtggccaacaattatgtcaagcgtgcccagctcgaccggaacccgcgcttcgactcgcacgggctgacggtgaccatcaacctcgccaaacccgaattcaagaacatgaagaaggcggcggccggcaacgccgtggccggcggctacccgaagtgcacgatctgccatgagaacgagggcttcgccggacgtgacaagcgcacgctgcgcaccttgccggtcacgctcggcggcgagtcatggttctggcagttctcgccctacggctacttcgaccagcacggcatctgcgtgaacaccgaccacacgccgatgcatgtggaccgcgacaccttcggccatctgctcgacttcgtggaccgtttccccggatacttcctcggatgcaacgccgcgctgcctcgcatcggcggctcggtgctcgcccatgaccattaccagggcggcggcgaactgctgccgatgcacaaggccgccacttgggccgccttcacacttgccgactatccggacgccgtggttgaaatccttgactggcccggcaccgccgtgcgcgtggtgtcgaagagtcgccagagcatcatcgacgtatccgacatcatccgcgaggcatgggtcggttatgacgacgcggcgaacggcatcgccagccatgacgcggatggcaaccgccaatccgctctctcgcccagcgcgatcatcaccgaacgcggctatgagatgagtctcatcttccgcaacaatgcgatcagcgacgagtacccggaaggtattttccatgcacaccccgaatactggccggtcaagcaggagccgatcggactgatcgaggcccaaggcttgttcattctgcccggacggctcgtcgaccagctcggcattgtcgaagaggcgctcgccgaaggccgcgatttgcccgatgaagtcagcgaattcagtctcgaatggggcgaactcgctgaaacgttggccggaaaccacgaccgcgaggccatccgccaagccgtacacgacgagctcggcagcgtctgctaccgcatcctcggcaacacggccgtcttcaagcagaaagccaccacgcaaacatttctcgaaagccttggttttgccgctaggtgaaacaggtcaagtgaagtaagctcaatactgaaggaaaaaccgaaggcaagtccttccaaaggagggaatatgactactgttctggttacgggcggtgctggattcatcgccacccacaccgacatcgaactgctcaacaagggctacgacgttatttccgtagataactacggcaactcgtcgcccgtggcgcttgagcgcgtcgagcaaatcaccggcaagccggtcaagcgttatgacggcgacgtgcgcgatgaggcgctcatggaacgcgtcttcgctgaaaacaacatcgactgggtcatccacttcgccggtctcaaggccgtgggcgagtccgtggccaagccgatcgaatactacgacaacaacctgtactccacgcttgtgctgctcaaggtgatgaagaagcacaacgtcaagaagatcatcttctcatcctccgccaccgtgtacggcacgccgaaggaactgccgatcaccgaggagacgccgaccggcggcaccaccaacccgtacggcacctccaagctgttccaggagcagattctgcgcgacgtgcatgtggccgatccgtcctggaccatcgtgctgctgcgctacttcaacccggtcggcgcgcacgagtccggcctgctgggcgaagacccgaagggtattccggcgaacctcaccccgtacgtggccaaggtcgcggtcggcgagctcaaggaagtccaggtctacggcgacgactacgacacgcccgacggcactggtgtgcgtgactacatccacgtggtcgacctggccaagggccacgtggccgtcattgaccacatcgacaaggaaggcgtgttcgtctacaacctgggtactggccacggctactccgtgcttgaggttatcaaggcttacgagaaggccgccggtcatccgattccgtacgcgatcaagccgcgtcgccccggtgacatcgccgcctgctacgccgacgcttccaaggcggagaaggagcttggctggaaggccgagctgaccatcgacgacatggccgcctcctccctcaactggcagaccaagaaccccaacggtttccgcgacgcggagtgatatgagcagatgagctccctctgatgagggagctcatctgtcgtttatcacacaatgcgcctatcggcggcccagcgggtgagctcggtgcgattcgaaagctgaagctttcgcaacaccgagctcacgtgcgtttcgaccgtcttgatcgaaatgaacagttcggccgccacctctttatacgtgtaaccacgcgcgatcagccgcatgacctcctgctcgcgggcggacagccggtccagctcctcatcatgagcccgtgccgcaccatcagcgccgccatcagaccccgccgccggcacaccctggaaggtcgaaagtacaaaaccggccagttttggcgagaacacggcatagccctcatgcacctgcttgatggatgaaatcaaatcagcgccggtaatcgtcttggttacatagccctgggcgccggcgcgaatcaccgaccccacatcctgcggcgcatccgaaaccgacaatgccagaaacacggtagtgggggagtagggccgcgatttggcgaggatctcggcaccgccgccaccctcgccgccgggcacatgcacatccagcaacaccacctgcggcttggtctgtgcgatcatcgccaccgaaccgggcacgtccgccgcttggccgacgatatcgaaggaatcgcgcaacgtggcgattacgcccgcacggaacatctcatggtcatcgaccatggccacacgaatcttggctgtctcgttctcgctcatcgatgttctccctgcgccgctttcagcgcgatcggcatatgcattctgacctcggtgccccagccggccctggacactatctccactgtaccgccgcgccgtttgatgcggccgataatcgattcgcggatgcccagccggtcgggcggaatggcgtccatatcgaagccttcgccatggtcgcgcacgaacacttcaaccatcgtgtcgctggcctcgcaatacaaagacaccggctcgccgccatgcgtgaccgcattgaccaacgcctgacgggtggcgtccagcagcgcatcggtctgggcgctcggccgcgcgtcgcccacggtgaccacctcaatcggcttgccgtgctcgtcctccacctcggcggcgatctgcttcaatccggctcccaccgaacgatccgatgtggaacgttcctgatacagccattcgcgcagctcgcgctcttggctacgcgccagggcgaatacggtggtcggttcctcggagttcagctgaatcagcgccaacgtttgcagcacgccatcatgcagatgggcggtcatgtccgcgcgctcctcttcgcgctccttcaatgcctgctcgtgggtgagtcgttgcagcatcgcgttcgcccacggcatcaccgccaccacgataccgacgatcatcacgaatccgctggcaacaatgcgtcgaggagaggtgccccacccaggaatgctgacattatgcacatacaatgcccatcccatgaaaatcagtgcgatgccgcccaacatagacaacagctgcgtgcctcgcggactaagattcatccatgccagtgcgatgccgcccaaccctaccagcagcggaaacacaatctggacatccgcaccggtgctggtgagcaacagtccagtggccatcaacgcgaaaccggccaatgccacgacggccggtttcggagcacgttggatggcctcggacaatgattccggtgcggcagccgattcgtcgtcatgagcggcaagtggctgattgcctcgcgcaagcggcgcctgattaacgggcactgtgcgagccgcagccgccaccgggtctccggcaggcatgaacacccacaggaatacataagcgatgatgcctgcgccgtagaggacggtcagtgcgatgaacgcaatccgaacccatgccacgccgatgcccaagtgcagggcgatgcccttgcacacgccggtgagccaacggccctgccgggggcgcatcaacggcatgcgcgcgggcagcaatggttcgggagatgacgtcatactcctattgtgccgcgctcagggcgttgcggccggggttttacccggtgttcagggaacaatcagggtgttccccgagcgttgtggcagtggtcgggcggtgtaatggaatcatgagcaatccaaacgcgaatccatatcagccacagccgcagcctggtccgcaaaaaaacaagacatcgcgacgcttcttcacttgggtgcgatccagtggactggttcgcggcgacgaccggtggatcggcggcgtatgcagcggcatcgctttacggcttggctggagccccacattagtacgtgcgttggtgattgtatgtacattgttcttcggttttggcgcagctctgtacgcactcggctggtttctgatgccggatgtacgcgatgggcacatcttggccgaggacctcattgccggccaatgggactggaattgtctgggatgcttcctgttcctcgccgtggcaatcgtgattccaggtgcggggtggggttgtattgcgctcgccgccttagcgctatggctgttggccaaaagcggcattcgccagcaggaagggtacggattcggggcatctgagccgcgaccggtttcacagcctgtgtcatatccagccgcgcaaccagtacctcaatctcctttgtattcagctccgcaaccttttccacaacctgtttcacaacctgtttcacaacctgtttcacaaaccgcgcctagtgtttcacagcctgtttcacagcctgtttcacagcctgtctatcagtcgatgcccagcgtgatgccgggtactgtgcccggcgcgatgcccggcacagtacccaacgggccgtttgcccccgaccgtatgaatgcgacggcctatgcccccaccgagtccaagcgccgcaagccggcgggcccaatcgtggtcttgagcatactgggccttaccttcctctcctttgccggtctgatgggactgatttgggtaaacgacatgggcattatcggcattatgcgtctgggcaccatctggattgccgcagtatgcatagtgatggggctggtggtcatcattctcggattcagaggacggcgtaccggtggtctgattcctctcggactggttgccggtggatgcgcgctctgcatgaccatcgtttcaggcacgtatggcgtgtactaccgtgatcttggtgccagcggcatcaatactgttgtttcactgagccaatctgtcagtgcgagaaacagcgacggcatgaacgatgtgcaaaaggatggcatcttcgttgccgatgccagcgatgccacgtttgaaacattgcagcaaggtgtggcgttcagcggtgaaaactacaacaccgatcaggcaatcattgattggtccgattgggacaagacacatggaccgcacacggtgaagatgctggatggcaaaacttccatcagtaattgcccggtcggtaccatcaccatagccgcaacacaggcgcaagtgcatatcgttctgccggattcctgcacttacgccttcggcaccgccgactcctactactccacttcgagtgacgttggcggcaaatacgagatggtatacaacaactacatgggtccaagctttgttttcttcgaagctgaaagtgccaccaatgggcctgatcacgaatggttgtataaggaatccgccatgccggacaacggcccagaattaaaaatcaatattccctatgtggtggaagcacgtgtcaacgtggtgtacgcctccgattgggaaggctctacgttccagccgcttgccgatatatacgacggcaacagtacaagcaagaacacaaccgaacaatcggaatgatcaagccgttgcaactaggagatggaatcatgactgatgaaaccaaggaattcgcctccatcgaggatgcgacaccgaccacggccataccttccgaaaccgacgcgaccaccgcgaccacaaccatggtgaccgtcgatgaccgaaccgataccacggtgctgccatccgcagcggatgatgacgaaacggctgtgctgcccgtccccgacaatcatgcggatgcgtcggtctcggatgtggatacgcaggcaacagctgcctctccatcgcccatcgaaccaaccacagatcggattgccctggaaacagttgccgatgccgtggagggagatggtgggccgattccatctgccgatgatgtgccgatgtacgcagcatcttcagcacgacctccctatgggcagtctcagaccgccggcaaaccatgccagcctggggggagcgccaagaacgtccagagcgccaagaacgtccagaatgctaaggatgtcaagagtgccaagaacatccagaaacagagcaccagcgcgcctactgtggtattcggactattaggcgtgattatcggcgtgatcgcgctggttttcgggtacatatctccggatcggatgatttcgttgttctcgccgaatccgcaattgctgacggctattatttgcgccgtagtgggactgattctggtaatagtggccgttgtatgggccatagtcggtgccgtcaagaagagaaaatagcgttacaaaccattgcattacggtcccagtagaagcacattatgacgggagccgaccgataagagccgaccgttctatgctgatgggggggggaggcatagtaactatgaagcggatttcggtgcggcgggtagcgagcgtcatcgtcaccgcgatggcgatgacgctggtattcgccacacttggctgggcgatgatgccgcaatggaacacacggccctacaccaagcacatcgttatcgcttctgccgacaccaccatcacccctgcccatgcgaacattccccacgaggggcgatatcgtacgcgtgaaacccgactatccatcaagaccggcgacggcgtcacgctacccgccgtactacgtgaaccggtcggcgctcccgggccacgcccggcttgtctgttcattcacgggtccggtaccagtggtgccgaggatttcggcgatatcgccaacgccatggcctctgccggtatcgtgaccttggtgccggccaagcgcaacgacaactacaccgtgctgcatcgcgactacccgcgttttgctcgcgaatacgggcgttcgctcgacgtgttgcgtggcagaatcggcgtggaccccgccaaaaccggcatctacgccgaatccgaaggcacctggatcgccacgattctaacctcgaaacggcaagacattgcctttgccatacttacatccgcaccggtgttcaatggacgtgagcaaatggccatggctgtcagcgcctatacgcatgaggccggcgcgcccaagcccgtggtcaaagacatggccaaattgatgtcgctggactacgcgccattcgatctggcctatgccgactttgatgccgaccggtatctgaaatccctcaccatgccggtgctggtgaactacggcacctacgatacggccatgcccatcgaacagggggcgcagcggatcatcgccacggccaacaagtccggcaacgagaacgtcaccgtacgctatttcgccggcaaccatcagatgcgggctggtgagggcttattcaccccgaacctgccattggccgaaggctatacgcaagcgctggaaaattgggtgaacggtgtgactgccggaaccaaagccgatggatgggcaacgccccaagtcgccggtgcgacacctcaccagcgcttcgccgcgccgcaacgtaccagatccggtatcgtcggctcgctcggcgtgctggccggtctgatggtggcagggcccgtgctgatcgtgatggcggcgatattaggtattggcttgactgtgttttcttggctacagacgttgctggccgggcgacgtagtgtggcgactgtgcgggccatgcatgcgacgccgagtgggctgggagccgcccaacagcgtacgttgcacggcattgccggcttatctgccggtatcggcacagcggtaatggtgattaccgtgctgttgtatggctatatgagcgccgtaggcgtatcggctgtattggttatgcctcaaccgcggctgtttgccgtcggatgggtggtgctgcgaatagcgaccatgctgttggtggtgctgtttgcttgggaaatggaacgtgtctggtattgccgcgccgatatcgtcggtgtacggcgcgtcatatgcgtgatggtagcgctcggcactctcaccacactgatgacactggcattctggggcctattctcgctgtaattctgccgatgtgcgccggtcaatggggcctggcgggcaagctgcgttggtggtctgggtgtggggcgatcggcagattgcgttggactgggtgtggccggccggcgtacatcagtcggggggccggtacacagtgaatggctgagtattacgcttgggaggcttcggcctcctccaaggtgtcgaaaccgccgagctggaccgtgtgcaacaaggtttcctcagtgatattgcgttgcgggctggctgcggcgcgctcgctaatcatcacctcgtagagctggaaggtccgttcggaatacgtaccaagctcgccgcgcagataggtttcgaatgaggtggcagatggtgtgtcgtcggtggtggtgagtacgcgcatcgcctcgccgagcttggggtagcgctcgcggaaatccttggcccaggcgacctgctgggcgatgacctgttcctgacgggccacgcgctcttcagagagacgcggaatatacggctctatgttcttcgtgaaatcttccggcgcggtggaggccatcatgcggccgtatttttcggtcacgaggttgcggcccacgtggtcggccgcgtcaagatcagcggcatagctggtgagtaatggccgctcccatgtgaggaactgggccagccgcatctggtggaacaccggccagttgccttggcatgccgcgcgtccaccctcattgttggtgcgctggaactgatcccattcatggcgcacaatagcctcgcgcagttcatcatcagtcagttcgttggtcatcgacgttcctttcactaatcctctgatgagggagatggcacggcgaagccgtgacagagggagcttgaatctacaaacttttaagcaccggatcatcagaggcgatgtggtcctcgacatacgggcgctgccattcgaggaaggtctcgccggacgtggtcaggtgttcgcgtttgagttccttgacgatatccgccgcaatctgctccacgatatcgttgattttcttgattgctgtagccgcgcccttgccgccttcgccgaatccggccccgccatagcaggctgccgaactcaatcgcatcacggtttccaactgttcgcccacgttcggcaacagcgcgaacatcgagccagacagcttgcgcaatgctgcgaactgccacttgtaatacggcatatagcccaccaccatcggcacgttaaccaggaacaccaacgaggcggtggcctgcacgaactcgtggatggacagccatgcggccgcgccgtcgccgcgtttcaacgaacgcggcagattatattgaccggcctgggcgatcatgccgagtcgcttggagatcagcgcgagccgcacatcgtcgggcatgttcttgaacccttggcgcgtcttggaaaacagaccggtgggatcggcgaacacctcgccattggtggcggcggccaaggtcgattcctgaagcattagccactcatgcggcgcggtctgcgccggcgcagtgtgatacccggtgatcgactcaaagaagtcaccgatgcggaacacgccgtcacggcgattcgcgccctgtgcgcgcggcgtgacgggggagagcggtgcatcaatcggagtcgtcatcgcttccgccacatcagaggacgccgcgcctgactcggcagtggcggtatcgtgcgtagcggtgccgggggtgggtgcgtttgccgcatcgggtatgacggtggagcctgcacctgcggaggggaatgctccggaagcatcggacctggcctgcgcctcgaacgtcacgcggccttgcgcatccacgctgaacttgcgcggcagtgcctcgtaatcgacctcaagttgctcgccgatcgccgcgtaatcctcatccgtaagccacaggcagaagcgcgggccgaaatcgtggtcctgcgaatacgcatcatcgaatccgtagcattccgagccatgacccaccagaccggcggcgatacgcccggcatactgcggatacttcgccgcaatcatcggcttgcccatctgcgtccagaacgcgcgggccagcttcagtccggacaccgggcatgcggaaacggcctcggccgcgcccgcagaaccggtcgacaccgaaacggtggatggggaagatgccgcgttcgcaccggtcttgccctgtgccgggctgttcggcagccgcgagccggactggggcagcgcgcctgcatcgccggcaacacctgcattgtcaaccgtcaccccggcctgcgccgccgcttcctcggcctgccgcagattgtcggcggtgatacgccagtaatcggtgtccttgccgtaacattcctcgatcacggccagcgcatgccggtatccagtaaccgcatccgcataccgtctctcggcaaagcacacctgcgcgaagcccgccagtgcggaggcataatgcgcggaatgttccagatggccggtgcgatagatttccagcgccttggctgcatgccaatgcgcgtcctccaacttgtgttcggtcagcagggtcaacgccagattcgtgtgcgagctggacacgtcgatatccgcgtccgggttcacgctcgaggcttcgataatgcgcagcgcttcacgcaactccagttccgccttgtcgggccgattcgtctcgctgtagagcatcgacagattgttgtgcagtgctgcgagcctacggtcggtgggcgccagcgaatgccggcagacactctgcgcctgatgatacaaatcctcggcctgatcgtattgtttggccgcgcgcatcgaggtggcgcaattgattagcgtgatggcccacgcctcggatgtgccggtggtcaagcccatacgagcggccagttccagcgctcgctgcacaatccactgattctccttgtgccgaccttgcgagcgatagaagcccatcgtttcgttgagcacggtgagcagtccggcctcgtcgccggcgttttccgcgtccaccatcgcctgttccaagtacgggccggcttcggtggcggccgtgtggcgatcgaaaatcgcgtccagtccgttcaggaattgttgggtatcaaaggttgcgggcgattgatcggcatcgtccgcaacctggttcgccgtggaatcggcaccttgtgctgcggccgccgcatcggtgtcgtcggcatcgtctggaccatgcgcgaattgcgcggcgaattgtttgagcagtgcttcctcatccataccgccagacctccctgaatcgtgtctgatttcagtctattaatactgtgaacaaacacgtcagggagtttgctgtgagcttggtctcagtccaccttggtttcgcgcaagcggtgaatggcgtcggtatcggtttcgcagcgccacgagtagaaggccagcagccctacggcaagcagagccagcggcataccgcccaggccggtatagcgatagttcatcgagaaggtggtgagcatcgcgccgccgacaatcgagccgatggcattgccgaagttaaacgccacctgtacagccgcgccggcgatcagctcgccgccgccctggccggcttcggtcatcagcaattgctgtggagcggaagtaaagaacaatccgatggcgatccagaacgtcagtacagcggtcatcggctgattacccggagtgataagcaccagcaacaagccgaggcaggagatggactgacctattgcggccgcgccggcatgcctccaatggtcggtcagacgacctccaagcagaccgccgatgaccataccaaagccggcaagcatcatcagcatcggcaccagggaagacgaccatccgccggttttctgcagccaaggggagacgtagctccaccagcagaacacaccggcattgccggtgaacacggcggccaaaatcacccacgggccacggcgggtgaggaacttgaactgaccggcgatgcctgcgtccttgatcggtgcaacgtacggaatccacgccgacgccagcacaatcgtcattgccgcccaagcggccaaaatgccgaaggcaagacgccaggaaaggaactcggccatcaaggtgcccgccggtacgccgagcatattggccacggtctgtccggtgaccatcacggatacggcctgcgcctccttgccttcctccgccagagtcttggcgatgagtgtggctgtgccgaagaatgcgccgtgcggcaggccggcgacgaatcgtgcgacgaccagcatggcggcattgacggagaatgcggaagccagattgcccaccaaggcaatcaccataaacaatatgatgaggtccttcggcggcaccttgcggccgaataccagaatcagtgtgccgaagcacacgccgatcgcatacgcggaaatgtaatggcctgcggtggggatgtccacgccggtggcggccgcggcctgcggcagaatgcccatcatcacgaactcggcggcaccgagaatgaacgcgcccgaagccagtgcaagcagactcttcttcatggttcctctaattacttcagtattacttacaaaaacagtgcggcaatcgattgattcgagcgatatattacggtggtccgccaacaaatacgggggcttgccgtgatgtggtttgtcgctgtgtgcggcgggttgtttaccgctgttcgatcgcttggtttgattgttgggacaggaaacgaaaaaccggattgctgatttctcaacaatccggtccagttgtcgggctggcgggatttgaacccgcggcctcttcgtcccgaacgaagcgcgctaccaagctgcgctacagcccgtttggcaacagatgtagatattacattgtggtggtggacaatgcaaatcggcatgtcgcgagtgttgcgtgatggtggattcgccatgtgtacaggtctctcaagccttgtgcagggccggttttgcgtcatgtgagcgggtgttcagatggccgtgcggtctgccgggctcataatcgccggccttgcgtacactgatgaatcatggctgaagttgtcgaaaataccgaaaacactgagaatgaaaccccggccgtcccgcagatgagcaccgtcgaacgtgcggaaatgctgctcaagcaggacgccaccatccgcgagaagatcaagtccggtgccacgctggacgaagccgtggacccctccaacaaggagttcggcccgctggcccaccccgagcaggtgcagatgcgcgtggccaagcgcgcgatgatgcttgaggccggcattgccccctacccggtgcacttggacgtcaccgacaccatcgaggcggttcgcgccaagtatgacggcaagctcgaggctggcgaagagaccgaagacatggtcggcattgctggccgcgtgctgttcctgcgcaacgcgggcggcctgtgcttcgtgcagctgtccgccggtgacggcaccaagattcagggcatgatctccaagaaggagattggcgccgactcgctcaagcagttcaagcagctcgtcgaccttggcgatcacctgtacctcaagggccgcgtcatcgcctccaagaccggcgagctgtccgtattcgccactgagtgggctatcgcctctaaggccctgcagccgctgccggccctgcacaaggacctgaacgaagacacccgcacccgcaagccgtacatcggcatgatcgcggacgagaacatccgcaacatggtgcgcaaccgctccaaggccgtggcctccctgcgccgcacctttgacgaccacgacttcctcgaggtcgaaaccccgatgctgcagaccctgcacggtggcgcggccgcccgcccgttcaccacgcacatgaacgccttcgaccttgacctgtaccttcgcatcgccccggaactgttcctcaagcgctgcctggtcggcggcatcgatcgcgtgttcgaaatcaaccgtgacttccgcaatgagggcgtcgacgccacgcacgcccccgaattcaccatggtcgaggcctaccaggcctatggcacctatgattccatcggccagctggtcaaggagctcgtgcagaagaccgccatggacgtctacggctcgcacaaggtcaccctgctcgacggcaccgaatacgacttcggcggcgaatggaagaccatcagcatgtacgactccctgtccgaatcgttgggcgaggagattgtgccgaacggcggcccggacgcccccggcacctccgttgagcacctgggcgccatcgccgacaagctcggcgtagagcgcgacgacgtggagaaccacggcaagctcgtcgaacacctgtgggagcacttctacgaggacaagctttacgagcccaccttcgtgcgtgacttcccggtcgaaacctccccgctggtcaagggccaccgcaccaagcccggcgtggtggagaagtgggatctctacgtgcgcggcttcgagctggctaccggctactccgagctcaacgacccgatcgtgcagcgtgaacgtttcgtggctcaggccaaggacgcgctcgctggcgacgaagaggcttgcgacatcgatgaggacttcctcgaggctctcggcgtgggcatgcctccggccggcggtatgggtatgggtattgatcgactgcttatcgccttgaccggtgccacgattcgcgagaccatcaccttcccgctggtcaagccgctcgttggctgattaggcatactctggctcccctcagagaggggagccgagttatatatgaaaggattgcttatgtccatcggcttgtgggttcggggcgcgcgtcccaagaccttggccacttccatcgcgtcggtgatggttggggcgacgatggcatacgcgcatatcgagcagtcgggcacctgcatcgcaatatatccagaaccggcctcctgcgccacggcccgtgaacagcagaccctgctgatggaccgattctggccggtgaccatcctgtgcctgctagtcgcgctgttcctgcaaatcgccgtcaactatgcgaacgactattccgacggcatccgcggcactgacgccgggcgtgacatggacgaatcgaaatcaggcaaaccccagcgactgaccgcatccggactggtaccggccaagcatgtactgttcgcggcgatgatttgcgccgccatcgcctgcatatgcggtgttgtggcggtcgtgctcgcccaagcatggtggttgctggccgtgggcgcggcctccttgctggccggctggttctacaccggtggcaagcatccgtatggatacgtcgggctgggagaagtcggcgtgttcctgttcttcggcttggctgcggtattgggcaccgaatacgcgctgtgcggcacggtggacgtcggcggactattgggtgctgtggcggctggcctgttctcctgcctgatcatgatggtgaacaatatccgtgacatcgacgaggatcgtgagcatggtaagtgcacgctggccgtacggctgggtgaatccggcgcgcgtacgctgctgattgtgtgctgcgtggccgcgtgggccatagccctgctcatgtgcgcgaccctatggtggccgtggggcgcagtgctgttgatctcgggcgtcggaatacctgtgcgcatggtctccagcgtgaataaacgtcaattccgcccggctctgcccgccgccagcttccagaccttgctgtttgcggtggtgctggcggtttccgtgacgctctgagagcgaaataataagacgaatactcgtgtttgggcgcacgcggctgtagactgaaccgtatgacttataaactagtactgctccgtcatggacagagcgcatggaataaaactaaccagttcaccggctgggtcgacgtaccgctgaccgagcagggtgaagccgaagccaagcgtggcggcgagctgctcaaggagaagaacgtccttccggacatcgtgttcacctccctgctgcgtcgcgccatcaacaccgccaacatcgctctggatgccgcagatcgtctgtggattccggttcagcgtgactggcgtctcaacgagcgtcactacggcgctctgcagggcaagaacaagaccgagatccgcgaagagtacggcgacgagaagttcatgctgtggcgccgttcttacgccaccccgccgcccgagatcgacccgaacgaccagtacgcccagaacaacgacccgcgctacgccggcgatccggttccggaagccgagtgcctggccaacgttgttgagcgtgtgaagccgtacttcgagtccgctatcgagccggagctcaaggccggcaagaccgtgctgattgctgcccacggcaactccctccgcgccatcgtcaagatgctggacaacctgtctgaggaagagatcgccaaggtcaacatcccgaccgccatcccgctgctctacgagctggacgagaacttcaagccgatcaagccgcgtggcgagtacctggacccggaggctgctgctgccggtgccgccgctgtcgccgctcagggccagaagtgagcctaagccgctaacacggtacaagctgtaaggggagtcgcacataacgtgcggctcccctttgctatgcctgccaaatcccccatggggcggtgattaccccatggggcggtaaaaccctcatggggcggtatgccagaatggcttaattccgcggtttcacatatccttcaaaccgccccatgggcaagttaccgccctatgggtgttttgccgccccatggatacgccggtgtaccgcccaaaagcaacaaaaacggcgtccagccgtagccggatcgccgctttcgggcatcctcctcaaaccacaggagaacaagtgttcagttattcgcccaatgtgagaacaagtcccaatcagtcgatgtcggtgccctcgtcgcgggtcggctccttagtggggtcgaagccggagacgatgtacaccacacggcgggcggcggacacggcgtgatcgccgagacgctccaggaagcggcccagcagcacgatatccacggtctgctgacgggtgatgtcatcggacagcgctagatcgaaggtctggtggtgcagattgtccagcttgtcgtcagccaggatgatggcctcggcggtcttggcatcgcgatcgaagagcatggccaccagctggtcagcggtgttgtccaggaagtcgatcatctcggcgaacaccggttgagcggattcaggaatcgcggcggccggataggtgcggcgagcggcctcggccacgtggcgggcaagatcgcccatacgctcgaacgtggaagccagacgcatggtggaaacgaccacacgcagatcggtggccaccggattctgcttggcgagcaacttgacgcactggtcaatcacagaggactccagggcatcgatttcgatgtcgccgtcaatcacagtctgtgcggcttcaacgtcctgattcagcagggcttccccagctcctttgatcgccttgcgtacgttctgcgccatacggtcgaggtcgtcagcaacctgcttcagctcctcgttgaaaataacgcgcatttctctagcctttcatgcttgcttattgcaacctgtaccagtgtattattccagtacttgttccccacttcaacgtaggtaatggcaacctcaagttgttctactgttcattgggttgttcacctgaaattcatgttaccggcgtgccggcaaaccgcaatcccggcgtgtggtgtgaaagaatgggggcatgacacagatgccgctcgtcgccgcgattgctcttattgtcacggctgttttatttgtggtaggaatcatcacgctcatcgtgggatttgcgacacatcgagtgtccatggaatcgccgctggccgatgatgacgacaatgacgatctgtccgacgacaccgccacgctgctgtccatgctgccaggtgcgtccgtggtggtcgacgagcacgacgaggtggtccgctgcaatcccgccgcctaccgcctgggtgtggtgtcagatgacgccattgcccagcagcatgtgctggatgccattcacgaggcgcgcaagtccggtggcaggcgccagttcgacttgaccaccgatactccggagcggtacgtcgcagaccagaacaagggcgatcacgtcgccacgcagtccgtccaccgccccaactggctgaaggtgactgtagggcgtatcaacgagcagttcgtcatcgtgttgattaccgatgtcagtgatgtgattcgtttcgctcaagtgcgtgactcgtttattaccaatgtgtccgagcaattgttgggccccactgaggctctggccaaactcgccgattcgctggagtccggcaatctggacgaacagcaggtggctgccgacgctcgccaggtgcgttccagctgcagcaagctcaaccacatggtgtctgatttgctgctgctcatacgcgcgcaggagccgattacgccgtcttccgccaaccgactgaacgttatggaacagctcagggccacggcggcgcgactggagccgcaggcagccgaggctggcgtgcagctgaacatcaagggcgacgatgatctagtcatcaatggtgaggcggaccagatcgacagcgccgtgaccaagctcatcgaaaacgccatcggctattccaaggaaaatggcgtggtcagcgtgtccgcatccaaagacaaggatggcgaccgcgcggtgattcgcgtgattgaccaaggcacgggcatcgctaagaaggaccaggcgcgcatcttcgagcggttctaccggggcgtggaacagagcaatcgcacggcggatggcgtgggcctaggcttggccatcgtcaagcatgtggcgctgacccatcatggcgatgtgaccgtatggagcgcgcccgggcaaggcagtacgttcagccttacgttgccgttggcgcagtgaggtaaggaattggtggcatgccttgcatgccaccaatgctgtttgatgagcgacctgcggccgcggtctctccctcaatcagctacgctgacagctcccgtcatcagagggagcttgtgatgcgttactgtccgaggcggcggtagtcccagcggtcgaagtattcccaaatcagcagtagcaagccaataatgacaccggccacgcacataatcaccaacggcattacgctgtagcccacggccagcagaatcagcacgacaatcaacgccacaatccatagaccggtaccgatggcaaacaccttacgcaggtccacccgtacgggcttgggcgcgggtttgcggacggcagggtcaatgagaggcgcgaacttcatactcatgcactgtagtaagagtagggaggggcgtcaaacacctctccctacgatttattcaatcggtatcggttgagaccgatcaatgtgcatggcatatatggtcggccatgcgaggcatagaccgccatcacaggtgctcgaccacatagtcgacgcacttggtgaaggccatgacatcagccggttccaccgaggggaacacgccaacgcgcagctggttgcggcccagcttgcggtagccggcggcgtccacgatgccgttctctcgcaggatggacagtatctgggaggcctggacgcgctcgtccagatcaatggtgaccacggcgttcgagcgggcgtccgcatcgacgacgaacggagcggcgtattcggagcgctcggcccacgagtacaggatggatgcggacttggcgcaacgcgtggtggcccaggcgaggccgccgttgctgttgagccagcgaatctggttttccatcatgatcagggtggccacggcgggcgtattcagggtctgatccttgcgggagttgttcagtgccgtggtcagcgagaggaacggcggcacccagcgatgtgcgccttccagatgagcgcttgattcgacgcatgccgcacgatcgatggcttcgggggagaggatggcgacccacagaccgccatcggcaccgaaggccttctgcggtgagaagtagtagacgtcggtctggctgatgtccacgggcaaagcgccggctgcgctggtgccgtcgatgacggtcagggcaccggcttcacgactgccgggcacgcggcgaatcggggcggccacgccagtggaggtctcgttgtgagcccagcaatatgtgtccacgcccttggtgagctcaggcagacggtaagtgcccggctcgccggggaacagcaccgggtcttcaaggaagggtgcgttcgcggcagacgcggcgaacttggcactgaacgagccatacgtgccgaatgcggcgcgacgggtgatcagcgaagcgcaggcaatctcccagaacgcgctggcgccaccgttgccaagcgccacctcatacccttcaggcaggtggaagaactcgcgcagaccttcacgaatcgaagcgaccagttgcttgactggtgcctggcgatgtgatgtgccaagcagggtggtggcgccggcatcgagcgcggcgatctgttcggggcggattttgctgggaccggagccgaagcgaccatcttcgggcttcagcgactcgggaatactcagtgcgatagtcatggtttcaagggtagaccagtgttggggaatatcgcggataatgctcggtgtgcgggattgctgcggggctactgcggaattccggggtgccgggcggtagtagcggcaatgcggaatgcagtgcagaatgtacgcagcacatcatggatacggtgtgtcggaatgacatgagttagtgattcttccgataaccggatagtgaggttcgtgaacgggcggaaacaaggcagtttttcaccctgccgcacggttacgtaaatcgtttgacatgcccggatggtgggggatcgcattgaggattgacctctgttcgttgtacagtactcaattgtgccggtcatacggggtcgttgaaaggaccccgccgaacccatccaaggagttaacgtagtatgaagcatgcttcgcataaagcgaccacggtctcgcgccagaagttcagcttagcgaaggcattgtttgcctccggcaagggttctcattccgttcgtgccgtgcgcgcggtgcaatccgctggcagcgacgccgttgttttggggcttgatccggccattgccgagaagatcaatgaaatcgctccccagactcgtcgttccattcgtgaggccgctcgtgccgctgaacgccgtagccatattcttgcctcggcctcactggccgctctggtcggcacggccgcaggtgctctcgcattttccaacaataaagacgccacgaactcgttcgtggctgatccggccacgacgaccacgcagattaagcgcatcagcgatgtgactgcggcttctcgttccgaagcacgtactgatctgagttcatcctccgttaccgcacagtccaccaatgaaggcggttgggggctgagcaattcagacagcaccttggacgccaagctgatgaatcgcaataatgcgaacaatcctgtggtgtcggctctcatggatgccgatggcgatgctgtgccggctggcttcaacccgaaccatgccgttggcaccaactccaacaactatccgtggggtcagtgcacgtggtacgcgtaccagcgtcgtgccgaactgggactgccttccagcggcaacttcggcaatggtggcgagtgggcggcgtcagcttccgctctgggctattgggtggacaacactcctcgccatgtcggtgatgctgtggtgttcgctcctggccaggccaatgccgatggcacatacggccatgttgccgttctggaaaagatcaatgccgacggctccattgagatctccgaatccaatgccaagggattgggtgtgatttcgacccgtacgttcagcgccgccgaagccggtaagttccagtacgtccactactgattcatttcattggcttacattcggtgattactgttcggatgtgacgtcgccctatcggcaatcgttcgcgcgaaatgacatttcaagtgttgcgaccgcgtattagtccgaactgacctgtgccgacacgccgatatatcccaatagctccggggtgttttatttcttccatcctgtacgagttaatgcgcaccgtgtaaggtgatggttctatgaagaccaaaactgtagcttcttccattgttgccgcgattgtctcctgtgcttgctcgtttatgtttgttcctacagcaactgcagctgagggtgttactgtgacttccaccaagtccttcccctcgtacacccaggtgcgcaaagatctgacgactgaagccactgccacgagcgttgaggacaatgctgattggggcggcattgagaacctcgatgtgccgcagacggaatctcaggcggaaaaggatgccgcagcggccaagaaggctgccgaagaggaggccgagaagcaggcggaggtcgaggctcaggcgacccaggagcaggccaacgccgcgagccgtaatgagtctcgctcttctgttacttattccgatgccagtggttcggtttccgctggtgccggtgcctctatcgaccgtgcgtattctttgatcggacagagcatggactgcaccgcattggtcagtcaagcgttggcggcccgtggcattaacttccacggttggcctgaagagtacgtcaatgttcctggtggccacgtagtcacagacggatccctgcagccgggcgatattctgatttatgccaacaccggtggatggaacggtggtgcacactacgatcatgtggcgttgtatgtcggcaacggtcaggcggtccatggtggatggaatggctatagcgtggctctcgctagtgccatgaccgaaaagctcaccatcgtggtgcgtatcccgtgatgcagtcttattgattgatttattgcaggcctcggatgccgatcggtatccgaggcctgttgcgttctcctgccgaatgatgcacccgcgacatcatcttcgaaatgctattcctgttatgaaatcgacccatgtgtgctagtgtatggcgttgatgatgagcgttaagactattatttccacatcagtggcgattatcgccacgggtgccatgtttgcgtgcgtagccccgtttgcctctgccgattccgcgcagacgagtgctgtggtgtcctcacgttctttcccgaaggcgagttcggtgaagaagaatttgttcgccgaatccacctccacctcggttgatgagaactctaaatggggtggcatcgagactcttgatgtgccacagaccgagtctcagggcgagaaggaagctgctgcagcggcggcggctcagaaagccgctgatgaagctgctgcagcccagtccgctgctgctgcggcagccagccgctctgaacagcgtgcgtcgattccacaggttgacttgggtaaaatgactggcactggcactggcgctgagcttgctagcttctcactgaagttccaaggctatccgtatgttgccggcggcaacactccggcaggatgggattgctccggttttgtgcagtacgtcttctcccagtttggcatctccctgcctcgtacctctggtgctcaagccaccgtgggtactccggtcgcaagcttggcggatgccaagccgggtgacattcttgcgaatggtactcatgcggccatttacatcggtaacggacaggtgatgaatgctatgaacccggtgcagggaacggcagtaagcgacgtttccgtattcggtggagctggatattccattcgccgcgtgatgtgacaagaattatgcggtaagcgaattcgtattaaggcacgtcctttggggtgtgcctttttcgtatacgcggatttctttttgagcggaggataccggccaaaccgagtgtcgcggggtattgttgagatacgcggtattcgtgccgcaataacttcaaggaggtcgtcatgattaacgacaaggctattctcgtcggcgttgacgggtcgcatgccagttacaaggcaacatggtgggccgcgaattatgcaaagcacgcggggctgacgctgcagattgtctgcgcatattccctgccgagctatgccgccgtttcgttcgatgccacttacacggcgatgggggacgataacgccgcgcattccgatgctcaggagattctgtccaaggccaaggccatcgcagacgagcagggcgtcgaagccgccacactgattgttaccggagatccggcatcggtgttcgtcgaattgtctcgtaactacaatctgatcgtcattggcaaccgtggcaagggcggtctggccgagcgcctgctgggcactacgtcctcatcgctgccggcatatgcttactgcccgattgtggtggtgccgtacaccgatgatgacggtaacctgatgcacctgaacaacacgatcaccaaggtggccgtcggctccgacgaatccaagtggggtctgaaggcgctggacattgccgccgacttcgccacgtgctggggtgcggaactggacgtgatttccgctgtgccgaacctgaagggtgtggacggcgaggacgccgtcatggagtcctacaaggacgatcttgaggtgcgcatcaagccgttgcaggaatcgcatcctgatctgaagatcaacaagcagatcgtttccggcccggccgtgagcgccctgaccaaggccagctacgatcacgatgtggttgttgtcggctcccgtggtcgcggcggcttcactggcttgctgctgggctccaccagccagggcctgctgcagcatgcggtcggcccggtgtacgtggtgccacgcaagtatgttgaggccgcggaatcgcgtctcgacaccgtgccgagctcgcccgccgaagtgcctaccaagtcgctggaggagattgccggcgtcgaggagattccggtgtccgcagccgagcctgaagtcgcccagcagatcgaaaagaccatcgatcccgatcgccagtaaagtccgaatatacggaaagaggctcccgccagggagcctcttcaatttatatcccgtctcagtgcttgacggtgacgttcatgcgcaccggggtctcctgcacgtaggtgtgcttgaccgtgcaacccttgtcgatatggcgggtgacgcgctccttgagcttgtcggcatcctcctcggacagaccggcgtcggaagcatcaatcaccacctgctcctcgaaaccggtgtaggcgtcattttccgggtcgtacgtgccatccaccacaatcttggcacccttgccctcacccagcgtatgttcgatggcgaactggctggacagcgcggcgcaaccggccagcgcgaccttcatcagatcgcccggcgtgaactggccacgatccttgccgaacttaatgtgtgcgccatcgtcgctgaacgcatcccacgaaccgtccttgttacgctcaacccacagtcgcttacccatagctgctcctttattttcagccgccggcgatctggcccatcgccatgccagcgggggagcgcggcacctggccgctctcccgcatcagtggacttctctattatgccccctaagctacactggtgcacatggctttgaccgaagaacaactcgcagatattcgctcccgtatccccgcacgtcccgaaacggacattccgatgccctatgaggacctggtgcgcaagatcctgaccgaaggcacgctgaagtccgatcgcaccggcaccggcacgatttccctgttcggccagcagatgcgctttgacctgtcgaagtacttcccgttgctgaccaccaagaccgtgttcttcaaaggcctggcctatgagctgctgtggtttttgaagggttcctccaacatcaactggctgctggagcacaacgtgcatatttgggatgagtgggcggacgagaacggcgatctgggcccggtctatggcgtgcagtggcgttcctggcccgcgccgacccccgaggacccgaatcgcaccatcgaccagatctccaatgtgctcgacctcatcaagcatcatccggattcgcgccgcatgatcgtctccgcgtggaatccggccgaggtggagaagatggcgttgccgccctgccacgcgctcttccagttctacgtggccgacgacaagctaagctgccagctgtaccagcgttcctgcgacatgttcctcggcgtgccgttcaatatcgcctcctactcgctgctcaccatgatgatggcgcagcaggccgggctcaagccgggcgaattcgtctggaccggcggcgactgccatgtttacgacaaccacgtcgaccagttccttgagcagctgggccgcaagccctacccgtacccgaccatcgagatccgtaaggccgattccctgttcgactaccagtatgaggacttcaaggtcgtcggctaccagcatcaccccactattaaggcacctgttgcggtctgatgctgattaccgtttcgtggacagcgaatactgtgaaggtgacggcccccgagtcttcgctgtccactacactaaggcccagttccgcaatccaggaggagtaagcgaaatggagcatgacagtagccgtagcggctatcacgaacccgagcccggatctgccgggctgtctgccactgaagaagactggggtgacgattatcccaagaccttctcggtgaatcttatctgggccgaagcccgtgacaaggaaggtcgcgccggtgccatcggcctcaatggtggcatgccttggcactgtgccgaggatatgaagcatttcaaggagctgaccgtctcccatccggtgattatgggtcgtaagacctgggaatcgctggggggcaagtaccggccgctgcccaaccgcgacaacatcgtcgtttcccacgatccgatgtaccgtgcgccgggggccactgtggtcaccagtcttgacgacgcgctcgatatggcccgtcaggaggcgattccggacgacggtctggaccgttcggagatttggatcctcggcggcgcccagttgttcgccaaggctttgccgttcgcggacaaagcctatgtgactgatctggccgccaccgtggatgccgacagctacgcgcccgatatggcgtcgctggtcgaggccgggatgtggcgggaagccgaagtgggcgagtggcatacgcccgccaaggaggagtccggcatcgattcctatcgtttccgtatcttggccaaaaccaagtaagcatgcgaatccggcttatgccctttatagcggcatgagccggattcatattcattcgaccccaacaatacagtcgggccgtgtgcggcccggtgaagcccgattgaggattgattcaaagctatgagcaatacccagccctacaccgtaatgaccgtctgcaccggcaatatctgccgttcgcctatgggtgagatcattctgcgtcacttctttaatgagcgcggtcttggcgaccaggtgaacgtggaatccagcggtgtgtccgacgaggagtggagccacccgatcgacccgcgtgccgtgcgcgtgctacgcgaacgtggctatggtgatgagattccgcgtgaccacttcgcacaccgcatctcgcgtgaggaaatcgaccgtaccgacctgttcctgccgatgaccgcctcccacatgcgcgccctgctgcgcatgctgccggccggcaagcgcgccgaagtgcacatgtaccgcagcttcgacccgaatctgcccaagccgaagcccggccgcgaagatcagatcgatctggtggacccgtggtacggcggcaagcacgagttcgaggtcgccatcgaccagattgaggaagtcgccccgtacatcgtcgattgggtggcgaagcagctgtaggaatcggcctgtggccgatgctgtgtgtttcgcagtcttacgactgcgggtctctacctccgtcaccgcttcgcggtgccgcctccctcgtcagaggaaggtacagaagattacctccctctgtaagggaggtgctgagcatagcgaagcggagggagagactaacgagtcgggtgcctcagaacaccagttgcaccagcaacatatatacaattgtgccgccggcgattgaaagcagcatattgcgtttccatacgtgcagcagcacgatgacggtgcaggcgatgagttccggaaggccgtgtgaaccggtcagaatcggggtgttgcgcagtgcgtataccaccagtagaccggtcatcgcatagggcaggacctggccgaaatactcgatgatgcgcggcggctgcttggactcgggaaacaccagaaacggcagaaaacgggtgcacatcgtgcccagcaccaccgtcacgatagtgattgcgccttgccagatggtcatcgtcatcgcgtctgtccttccttctgctggtccgctgcgtggctcatggcatggtctgccgtggcttccggggcgtcggcggccggccgcaacacgtccagatgcgggcgtagcgcgacgaacagtatcagcatggcgatcattgagggaatcatgaaatcattggccccgaatatcagcaggcaggccagtgatgtcagcacaccgatgacggcggacagtcgctcgcgatgcttgccgtcgagccactgatcgaggaagatcaccagaaacagcgcggtcagtacgaaatcaagaccgtcggtattgaacggcagatgcgcgccgatcagcccgcccagtgtggcgccggtcacccaatacagctgattgcacagcgtaacccagaagtagaaccagccacggtcgatgccggcggggattttcgcggtggagttgatggcaaaagtctcgtcgcacataccgaaaatcaggtatgggcgcttccagccgagccctttgaatttgccgagcatggatagtccataaaacaggtgacgggcgttgaccatcagggccagcagaaagccggcgagcgggttgaacgcggagagcagcagattcaccgtgacgaattccattgaaccggcgaagatgaacgcgctcatacacatcggccatacgaaggagaagcctttggtgcccatgagaatgccatacgaggcgccgagaaacaggaaccccaggcaaatcggtatggtcagcggaaacgccgctttgagcgccggcagccaggcgttggtgttggtgttggcggtgtctgccatgtggatgatgttctccttgtacaactggtctgccggccgatgttcgccgatgatgccatatgcggttatacacgcatggtgtcgataaacggggtgagggtggcgtcgggaccctgtgcgcgaagtcacagtgtggaggatgtcacatcgtctacggtgggatagtccttgtggcgggcgcgaacacgtgctgagatgaaaccatgagcacatatcaagcgggccgaatgctttcagacctggtcccgcgaatacgaaaagacctcggtcgctatgaccggggtctttagtgaagtacccccagagagagtcgaaccctcgttgtcagattgaaagtctggtgtcctaaccgttagacgatgggggcgaacaactcgaattactttacgggaggttgttcggttatgcaaatcgacggcatttcggcgtgtcgcaatcagttcagggtaacggcctgataggtgaagtcatgaatcacgcggccggcggccaggcccttcttctcgaagttggtgagcacgcggccctcgaatcgctcggattcggtgaagtcggcgtgcggcatatcggcggccatgtcggcattgcccttgcccacgtgctccagcggcaggctgacggttacgctgcccaggttcttccagccatcgaggccgtccatcacctcgtgcacgtgcagggcatagtcctcgatgtcggtggcgatacgccagacgccgtctgtgaccagcgcgcgatgaatgtcgccggccatggccttctgcacgatgcggcgcttgtggtgcttcttcttgggccaagggtcggggaagaaggtccatacctcggccacggtgccggccgcggtcaccttgaacagctcgggcgcattgacctgggccacgcgaatgttggtcagcccctgcttgccggcgagcagcagcgtgtgggccacgccggggtcatagacctctagagcaaggaagttcgtctccgggtgggctgcggctgctgccaccacgttttctccctgcccggtgccgatttccacaatgagcggattatcgttgccccatgcggactccacgaacgcgcggtcgagcgtgacgccttcgcgcacgtccagcaggttgccggccgcaatatccaacagatatgtgccggcatagttgtcccatgcgcgctgcaggcgatcgtccaaacgtccggagcggcgtacgaaggagagcaccttgtgcagggggtgcgccggtgcctcggtgtggtctgtgcccatcgcggcgacgggatcgattgctgtggattcgggattggtcatatattcctcggattttccttgtgcgccgcaccgctgttcattcattaggtcgatttggcgttcattaggtaggtggtgtgcgataccaaccaccatatcaagccgtttacccggtgtccgtgcgggccggctccgggccgacctacctaatgaacgccaaatcgacctaatgaatgcagatattgccggacgacaccaccgttttgtgcgattatgttcgtgtgatatactcaaattgtttcaaaaggtaacaaagcggaccaaaagtgaacagccgctgaactccccacggccgacgctttgcaacccgcacaaggaaaggtcaactatgacagttctcgtcaccggcggctgcggctacatcggcgctcatgtcgttcacgcactccatcaggccggcgaaaaggtcgttgtcgtcgacgatctgagctacggcaagcccactcgcatcgaagactcccgcctgtacggcatggatatcgccgccccgggcgccggtgagcgtttggccgaaatcctcgatgccgaaggcgtcgactccgtgatccactttgccgctcgcaagcaggtcggcgaatccgtggagaagccgctgtggtactaccagcagaacatcaacggcatgctcaacgtgctcaccggcatgacccagtccaagaacgccaagaagctcgtcttctcctcttccgccgccacctatggtgtgccgccggtcgatgtggtgcctgaggacgtcgtcccgatgctgccgatcaacccctacggccagaccaagctgttcggcgagtggatggcacgcgcctgcgagcagccgttcggcatccgcttctgcgcgctgcgctacttcaacgtggccggctgcggtccggtggagcttgaggatccggccatcctgaacctcatcccgatgctgttcaatcgcctcaagcagggcaaggctcccgccatcttcggcgacgactacccgactccggacggcacctgcgtgcgcgactacatccacgtctccgacttggccgacgcccacatcgccgccctcaagtacctcgaccgtgacgagcgcaagtacgacgccttcaacgtcggcaccggcgaaggcacctccgtgcgccagatcgtcgacgaagtcaagaaggtcaccggtctgccgttcaccgaggctgtcatggcccgccgcgccggcgacccgccgcacctgatcggctccccgaagcgcatcaacgaggagatgggctggcatgccaagtacgacgtggaagacatcgtcaagtccgcgtgggatgcctggcaggccaaccccgaacaccacatcgacgtcgacacctggaagcaggctgactgagattgacggtcactttgcggtggatgccgcgaagcgtttccgtccataagggcgtggccggggttccggtcgcgcccttcgtcgttttgtggatgtttgtgacagacgtgttcgcgtgctggtgatagcaaaaaccttgaaattatgcggaacacgccgaagtttgcatgactggcgaatttcagtaatatatacatctgttgcctcacgcaagtgagaacaatggccccgtagctcagttggttagagcgccgccctgtcacggcggaggtcaccggttcaagtccggccggggtcgctggaatggttatgaagcccggattatccgggtttttgactgttcatggctctgtagctcagttggtagagcgagcgactgaaaatcgctaggtcaacggatcgacgccgttcggagccaccataatgaagccccgccttgtgcggggcttttgcatatccgtcgcgtacctactccggcgggggttataggccaaaatggcgggctggccggtcaatgcaaaggctcgcgttcgccaacaactgtcttcctcgccgcaactacgcacgccaacagcaccaatgcgaacatcgatccgaacagcaacccggtcttaagactgtcgccattggcagaggccaccagtcccactacggcagggccgccggcgcatccgaggtcgccggccacggctagtagcgcgaacatcagcgtaccgccaccgggcatggcgtctgcagccatcgagaacgttccgggccacataatacccactgaaaaaccggtgagcgcacaggcaagcagacccagtaccggtgccgtggttagggctgcggtcagatacatggccacgcacagtacggaactgctgacaatgaatgccgtgagatccagtcgatgccccagcactccgtaaatcgtgcgggacaggcccatcatcagggcgaatgcggcaggtcccgccaagtcgccaatcaccttggtcacgcccagaccggactcggcgaacgcgctggcccactggctcatgccctgttcggccgcgcccgcgcacagcatcataaggaacatcaggtagaacaccggcttcttcgacaagtcggcgaaccgcatggtcgccgtgccttccggcacaatgcgcggcatgggagcgccagcgaacatcgcgatgccgatggcaggcacaatcgcccacaagcaagcgagaaccggccatgagccggtgccgaacgcaaacagaaacagcgtggagatggccacggtgccgagctggccccagcagtagaaggagtgcagcaggctcatcgccttggccttgtgttcgctcgggcaggcctcgacgatggggggagaccatgacctcgatgagtccgccgccgagcgcgtagaggaaaatcgccgccagaatcgcgagatacgggtccggcacgcgggtggggagcaagcccaacgccagcagtccggcaagggcggccaggtgggcggcgataatgcacggcttgtatccgatgcggtccacgaacttgccggccagcacgtccacgaccagttgggtgacgaagttgacggtgatgagggcggaaagccgcgccatgtcgatgccgagtgtcgccgcgaacgtgacgaacagcaacggcatgaagttattgattaccgcctgagtgatgtatcccacgaagcaggcggtgacagtgtggttgtagttcggggctgtggcgctcatagagtcagtattgcagaaaaagcacccgcgaaatgcgcgtgcgaagagaatcgtgtgggacggcagatgaacaatggtaaaaaccgcgtgccgtcccacaaaaaggaatcaggcctgccaccattggcgcagggggtaccacttgccgtccgggtgggccacgcgatccggcttgacggccaagaactggtgaatctggatgccgtcgagctcgaagttcagagcgcaggcggccaatgtacataccccataccttggcgcgttcaaagccgacctgcttgaccgcgtcgtcccaatgctcggagaggttctggttccagtgatgcagggtgagcgcgtagtgctggcgcaggttctcctgatgcaccacgttgaagccggcgtcatggatgcacgattcgatgaagccgggcgcgccgagatcaccgtccgggaagatgtaacggtcgaggaattcgtcggtaccgggcttgccgtgaggcttgtcatggctgatggtgatctggtggttcagcagtcggcccatcggcttcagaaggcggaacatctcttcgaagtagctctggtagttcttgacgcctacgtgctccatcatgccgatcgagcagataccgtcgaagtcgtgctcaggcacctcgcggtagtcctgcacacgcacttcggccagatcctgcagcccttcacgggcgatccattcgttggcgtacgcggcctgttccttggaaagggtgacgccgagcgccttgatgccgcgacgggcggcggtgatgaccatcgaaccccagccgcagccgatgtccagtaagcgctggccgggctgcaagtccagtttgtcgagaatcaggcgcagtttgttggcctgtgcgtcttcaaggctcatgtgttcgttgtcgaataccgcgcaagtgtaggtcatggaggatccaaggaagtcggcgtagaactcgttggacatgtcgtagtggaagctgacggtttccgaatcggccttttcggtgtgcggcatcaggccacgcttgatacgggcgaacttgctcgggccctcggtggcgggcaccggcggcttcttgaagccatggctcaggatgccggcagatacgcgggcaattgatgtgggagtgagtgggcgaacgtatttggacagcgacaccagcttgcgcatcgccggatacgggtcggcgtagtcaatgccgtccacgtcgaaatcgcccagaatgtatgagcgcacgatgccgatttcattcgggtgcgcgagtagctggtacatgcagttcggcgtggcgattttgaccttcaaatccgcgtctgccgggccgaaatgcgagccgtcgaaagcgtcgatacgaacgggagtggcggggtcgagaaacagggacgccatctcgccgaccgtcatagccttgccatttgccattatctacctcattctcttatgatgatcaccccaactgtcgaggtatcttagtcctcttcaggagactgaaaccgttgaatacaccatctggtgaaccagttcgcgttcggctgatgaagcacgaatggaattaggcatctcgcatattgattgcgctacgcgcgaagtaagcggatgagagacgagtttctcggagagcgtcagatgactccggaaaatggtcttatcgttgagatttcgggcgatggaactggtttggtcaatggacaataattcgacaagtgcggaattccgccatttcttgccattattttcagtgttgttctttcagcgtgttttcaggtgaatgctcatgcgcggagtagactggggaaccgttggaccactcaaagacagagtggaccaccagttaagacactagctcaaaaggagagcccctatggtgtaccgcatgattttcaaccagactgcatacttcggacgtggcgcgatcaaggagattccggccgtcgccaagcagcacggcttcaccaaggcatttatcgtcaccgacccggtgctgctggagaccggcaccgccgagaaggtcaccaaggttctggatgaggccggcctgccgtacgaggtgttctccaacgtcaagccgaacccgccggtcgagtgcatcaaggacggcgtcgccaagttcgccgagtccggtgcggacttcctgatcggcctgggcggtggctccccgcaagacacctgcaagggcatcggcatcatcaccgccaacccggagttcgccgacgtgctttctctggaaggcgtcgcggataccaagaacccgtccgtcccgatcttcggcgtgccgaccaccgccggcaccgcctcggagacgaccatcaactacgtggtcaccgacacggccaacaagcgcaagttcgtggctgtcgacccgcacgacatcccgatcgtcgctttcgtggacccggatctgaccgactcgatgccgcgcggcctgaaggtcgccaccggacttgacgccctgacccacgccatcgagggttacattaccccgggtgcctggagcctgtccgactgcctgtccatgcagaccatccgcatgattgccaagaacctggccaagtccgccgacggcgacattccggccggcgagcagatggcctacgcgtcctacatcaccggtatggcctactccaacgtgggcctcggtctggtgcacggcatggctcacccgctgggcggccgtctgggcgtggcccacggtgtggccaacggtattctgctggccccggtcatggaatacaacaaggacttcaccggtgagaagtaccgtgacatcgccgatgcgttcggtgttgaggacgcctacaccggcgacctggagaaggtgcgcgaagaggccgtgcaggccgtccacaagctgaccgtggatctgaagaacccgaccacgatttccgaagtgggcgccaccgaggccgaccttgagccgctggctcacgatgccttcaacgacgtgtgcacccccggcaacccgcgtcaggcaaccgaagaggacatcctcgcgatttacaagtcgctgatgtgatcagtcgatgacagtaagcattagctcccttatcagagggagcttgcataagcagagggggctcgtatatctagctacttttcgtgcttttcgtcgtagacttcgtcggtgggggtctcgtcgtacagctgcttgccttgcgcctccgccagttccatctgctcgttgatccacgcggcttcagccggattgatatccgcggaattcagcactttctgccacaccgggtagaacatgtgcatcgccggatacatggcggtgaacaacacctccggcttatgcgtgcgcgtatgttgcggatgcgcatcaaacgtattcttaaaacgtcgcatgtagctcaggaacgaactcaacgacgtatccatccgtcgcgcactcatcgcggcgatcatgcgcggcgagtacacggttttcagatccttgcccatcagatgcagggaaatatcgatatcctcatgcatcacatcggccttatcccggcagacctcattcgcaatctgatgccaggccgaagcgcgcaaggccatattcgagccgaacagcagcggctggccgccatcggcgcggtagattcgcttgcgcaaggaattgtcgcccttcaacccaaaatggcgtgagggcatgtcgtaatacatcaccggaccagtggcacccatcgcggccgggtcttcggtgaagatgccggagaccacctccacccagtcaggccggatcatacagtcggcgtcaaaacggcccagcacatcgccggtcgcggcgttcaggccaaagttgcgggtgggaatcagcccctgttcatcgttctggtgcaacagtttgaccggggcctcgggatgttcggcaatgaactgttcgacaaccgcacaggtgttgtccgtagaacgattgtccaccaccagcacctcatgcggcatgatggtctgacgggtggcgttcagcaggcagtcgcggatgcgttcggcttcgttccacgctgggatgatgatcgaaacgttgagcataacatcaacaatagaaaagcgggtgtacgccgccggcgtatccgagcttcaaacccctcgctacaatggggagccatgagcgaacgcgtgcgaaacgtaaacagcaccgacacgtcgagaaccggtgccgcagaggccggggcagacccggacgacgagaatcgtatcgactttggtactttgttccccgccaagggagattcccgtaggccaccggaatggttcggccgcgcgctgctgtatgtggcccttgccgtcatcgtattcatgttctgctggcgctcgtggggcgacatctcctatctagtgctcgacatcatcatctcgctgttcctggcgctggccgtcgaaccgttggtggtggcgctggtggctcatggctggaagcgtggcgtggcttccgccgtcagcttggtgggcgtggccgtggtcgtgggtgtgctgctcacgctatttggcaacatgttcgtacagcagatgattgccatggtccgcggtttgccggccatgtatgagcagattcgtgagttcgtggaccagtatgccacgttcaagatgccggaaatcagcaatctcggcatggaaatcttcaacaatatccagacctcgtgggtcaccgattttgccggtaccgccatgagtacggtgggcggcctgttctccttcctgctgaacctcatgaccgtggtcatgaccacgtattacatctccgccgccggccccaaactgcgccgctccttctgccagtggctggcccccaacacgcagcgccgattcctgctggtgtggaccgtggcccaaggccagatttcgtccttcctgttctcccgttcgattctggcgttgatcaacgccacctgcactgccatcttcttagagattctgcatgtgccctactggctgccgttggccctgttctgcggcgtggtatcccagttcatccccacggtcggcacctatatcggcggcgcgctgccggtgctgttcgcttggggcaaccgcggatggacgtacgccgtggcggtgctggtgttcatcatcgtctaccagcagatcgagaacctgattctctcgccgaggatttcgcagcgcacgatggatatcaacgcggccgtcgccttcctcgcggtgctggcgttcggctcgctgttcggcgcgtttggcgcgttcctggcgctgccggtcaccgcatcgctgcaggccatcttccgtgcgtacaccaagcgctatgagctgattgactcaccactgatgaacgatccgactccggagaagaagtccaagatcgtcgaggcgtccgaagcgttcggcgagcatgtgctgcagccgatcggcgagcacatgccgcgtgcggccaaggggtccaccagccgtgtgccgatgaatgaggaactgcgtttgctgcaggaacagatctatgcgattccgccacacgagacgaaagaatccgatttggacgattccgccactgtggcgattccgcagcgtggtgccgcggatacgcagcagtctgagcagcccaagcaacgcaagcaaaccaagcagtctgatcaatctgcctccagcaatcctagggcggggtggcgctgatgaccctgctttccgtactcgatatttttctggtaatcgtcggtggtgccggcatgatatatcagggactgtgcatcgtgatgtccctgttcgccaagcccgtgcgcttccccgacgccccgatgaccaaccggtatgccgtactgatctccgcgcgcaacgaagaaaacgtgatcggcaaccttattgggtcgattcgcgatcagacctacccgtccgacctcatcgacatctggctggtggccgacaactgcaccgacaacaccgccgacgtggtgcggtctttgggctgccatgtggtggaacgccacaatcttgaactggttggcaagggatatgcgctgacgtatctgttggggcatatgctcgacatcggtgtggccgatgattatgaggcctacttcgtgttcgatgccgataacaagctggacaagcactacttcgaggaaatgaacaaggcgttctgctccggattcaagattctgaccagctaccgtaattcggtgaatctggcggataactgggtgtcttctggttctgcgctgtggttcatccgtgaatcgcgattcctgtctaactcgcgtatgattctcggttcctcttgccatgtgggcggtacgggattcatgttctcccgcgaggtgatgaagcggaacaagggatggaagttccacctgctcactgaagatcttgaattcactatggattcgattctgcatggcgaccgcatcggctattgcggtactgcgatcctctacgacgagcagccggttaccttctcgcaaagttggcgtcagcgtttgcgttggagcaagggattcctgcaggtattccgttattatggctcggcattgctgaaacgcgcggttcgcgaacgtgatttctcctgcatcgacttcaccttgatgctgtgtccgtttaccgtgttgggcgtgattcgcgcggtgatgggcttgctgttcgccgcgtgtggcttcgtgagttggtcgagccagctgcaatcgctggccggttggtccagcggcatcatcacatcggtgttgggcctgatggcattggctgcattgaccatcattgtcgagcacgaccagatcggtgccacgaacaaggagctgctcgcctatgtgctcagcttcccgatttacatgctcagctacgtgccgatttccttccaggccatcttcgccaaagcccagtggaagcccatcgcacataagggctgaccgagtccgctagtccggagctgctcagcggggcaatccaacagcaacccgggggtgctgcgctgagggttgactggtgggttagagtagatgcatgagcttagacaatactcaaaggaatgtcggatttcagccgccgatgatgccagccgccgctcccgcgtcttcgcagtcgcaacagccacagccgcaagcatggccgccgaacccgaatacggcggtgtccattcgcggcctgttcaagcacttcgaccggaagatcgccgtcaacgggctcgcgcttgacattccaatcggctcgttctacggactggtgggccctaacggcgccggcaaaaccaccacgctcaatatggtgaccggtctattggtgccggacgccggcaccgccatgattctgggccatgacgtgtggagcgacgtgaacacggccaagcgcatgatcggcgtcatgccccagcccgaccagatcttcgaccgactgaccggtttgcaattgctcgtctactccggcatgctgcgcggcatgagccgcgaggagaccacgcgtcgcgcccaggacctgctcaatgctttcgacttggccggggccgccaacacgatggtcaccgattactcggccggcatgaccaagaagatctgcctggcctccgcgatgattcacagcccgcgcattctggtcttggatgagccgtttgaatccgtggacccggtgtccagcgccaacctcaaagacattctcatcgaatacgcgaagactggcggcacggtgatcatctcctcacacgtgatggcattggtcgaaaagatgtgtacgcatgtggccgtaatcaacgacggtctggtatgcgcggccggcacggtggacgaggtcgctgctggcgaagaactcgaagaccgcttcctgcaactagtcggtggccgccacgaagccgcccatctcgcgtggctcgatggcgggcaggcccaagcccaagcaccaacttcggcccagacgattcagccgattctgcctacgcccgccacacccaccgatgaggcccgccgatgatcagcagcgccatcaccctggtccgcctgcgctggacgctcacgctcgccaccctgcgaaaatcggcgtggcagaccgtcgcctatgtcttttccgctgtactcgcggccggcaccatcatcggcaccggcgtgctcgcatggttcatcggcatactgccgcccttcaccgtgaacgcggatggctttccgctgaacatccttggtcccggaggcatcgtcaacatagtcgtcgtgctggtcggcgcgaccatgaccatcttcatcggcttcatccagctcatgatgcttggcgaaggctccaccatgaacccacgcaaattcgcgatctacggcatcgccgaccgcaacctgcaattcggcttgctgctttccggcctgtccggcatcccctcccttactggcgtggcctcactgatgctctggacactggcctatcggcatatgggaccagccgtaatcatcagttccctcctcgccgcagtgctggccgtcatcaccatgatgagcatctccaaactggtcatcgccctatccaccacgctggtgaccagcaaacgcggcaaaggcgcgttctacatcttcatcgtgctgactttcgtcatcatctgccagttgccgaacattctggtcaactccggcatagccttcagcctcaacaccgagacctggggcgcggcgaccgccatcgccgcatggacgccgttcggtgcggccttccaactgccgttcgacgcgcttaccggagcttgggcggtgctgatcgcccgcatcgccatccttgccgtcacatggatcgtctgcttcgccgtatgcacttggtgtctgaggcatgaacggctcaccatcggcgcaaacagtccgtccgagaccgccaaaggcatcggcgcattcgcatggatgcccgattcggcatccggcgcggtgtccgcacgcctgatcacctatctcaaacgagacccccgccaagccatgaccttcgccatgccggtcctgttcctgatcatcttcgccttccaggcgcacggcatcagcgcggtcgtctggcagtcgctgatctggtgtggctggttcatgtcagtggtggaaagcaacgggctcgcatatgacggccgcggcttcaccatggaagtcatcgccggcgtgcgtggccggaccgacagaatcggccgcgtgcgcgtctacgtcggcatcatggtcgtctacatggtgctgctctatctcgccggcatcgtgctggtcggcgcactgaccggccgctgggcgcagcccgatgacctcgtcaccggcctgatcttcctcgccacgggcatgggcatcgccttgagcggactgggcgtggccgaagtcacctcctgtgtactgatgtacccggtcgcctcaatggacaagccgttctccgcgcctcaaggccgcgccatggcccaaggcttcttcccgttcgtctacatgcttggcagcctgctgctcatgctgcccactggcatcgtggcgctggtcatgctgctgacaggagccgaaggcgtcatgtggctggcgattattccggtcgcgctggccaatggcatcggcattctggcactcgggacatggctgggcggtaagctgatggatgcgcgaatgctctcgattgtggcaacactcgactcgttcgcctcattgcagaaatgattgccttggcataaggagcacgatggtatctacagcggtatcacgccgtcagcgacgtgaagcgcaacggcggacccaacgatcgcatcgccgaacactgaccgtcatcatttccgcactgaccaccatcgccctgttcgcggggtactgcgccgccgacatcaccgacgtggcccccggattgttgacgttaaaacctgtcaccgcacctgtttttgccgatccggccaccgccaaatcaggcggcaccatcgccggtgccctgaacgcgaacaaggccattgattccacggccgcttctgcactggtcaacgaattgctgtccgcgcaaggcgtgggaaacgatacgtcggtgatcattgaagacgcccaaggcaccgtcgctgccgaacatgagtcgaacactccacgcgagcctgcatccacactgaaaacgctgaccgcgctcgccgcctcatccaccctgaacatggcatccaccttggatacccaagtgttcctgacccaatccgatgacggcaccaatacgttgaccctcaaaggcaatggcgacatgctgctgtctgcaggcgattccgacgcaaaccataccaacggacgtgccggtctgaacaccttggccaaggccaccgtggccgcgctcgcccagcgaggcatcacttccgtcaatctcgagtacgacgacaccctattcggcgactcacgcattcccgcaggtctgtcggaaggcggcgcggtcttaagcgactacaccgtctacttcacgccggtctcatcaatggcgattgatggaggccgccaatacaccgccgatacgcctgcgccggccgaccctgatgattcggccggatacccggaactgtcccagcacaccgccagcgacgtggccacgaaattcgccgaactgctccaatcgaacggtgtggccgttaccggagacgtgacggcaaacaccgctccatccggcgaaacgcctttggcctcggtgagttcggcaacactgtccgaaatcatggcatacacgttgcggcattcggacaatacgctggccgaggagttcggtagactcaccgccttggcgaaatcagcgacaaacagtcctgaaggcggcacggaagcggtcaaatccactctgaacgatctcggtctcgacacatccggtctgaccatggccgattgctccggcctgtctcccggctcccggctcaccgtacgcacgctggcggccgtccaacaacgtaatctgaccaccgagagcggtgctgctggtgcggaaggtctatccatcgcggggttggtgggcacggcgcaggatcggtatacggatgatgccgtggccggtctgctgcgcgtcaaaaccggcagcctcggcacggtcacgtcgatggccggcaatgtgtcccgcaccaatgggggagcgttgtcgtttgccgtggtggtcaacaatcctgaggattatgccgccgcgcgtagcgccatcgactcgtttatcaccaagctcgcggggctgtaaaagaggcatcaagggccatcaagggctataaaggccgtaaacgtccataaacgcacgagtgcctataaccagaaaaaaggtggtgagtacatggcatattccgcacgattgcgcaaggccgtaggcgcggtccgcgcaacgctgagtgccgtggaactatgcgatgtgcaggctcccgaattcgcgcagcatggggaccatgccgttgccgccgatgcgccgctcgtgctcgtggcctgttcaggcgggcgcgattcgatggcactggctgcggtgagccatatcgtatgcacgtccatgggcgtgcgttgcggtgccgtgattgtggatcacggcttgcaggcaggctccgaacaggtcgccagcgaggccgcggatcgttgccacgcgttgggactgggcccggtcatcatgcgcaacgcaaccgtacaggcgcgcggcgagggcctcgaagcggccgcacggcaggcccggtatgacgagctgtgcgccgcggcgcatgaatcgggtgccattgccgtgctgttggcccacactatggacgatcaggcggaaaccgtattgattggcctgctgcgcagtcgaggcgtggatgcgttggctggcatgccgcaggtcttcacacgcagtggcgcgacttttgcgcggccactgcttacccttactcgagccgaaaccaccggcatctgtgaagacttaggtgtggaatattgggatgaccccaccaatggcgatgcggtagacggcgagttgccgaacgactatccgttgcgctcgcgggtgcgtcacgacctgctgccggccatcgaacgattcgctggattcaatgtcacccgccatttcgccgaaagcgcacggttggccagaatggataaggagtatctggatcagcgatccgacgaggtgatgggggaggcggttgcggcagttgattggccggcatcgtcggcagctgtatcgaccgatgcgccacgagcctgtgtggcaggcgataccaacgattcgagccatggcatcggcctgatgatcagcgtcaaacgtattgcacgtgagccagaggcgattcggttgcgggtcatcgctcacgcgctgagccaagccggtgtgaacgccagtgctgcccagattgccgccatcgaccggctggtcgtcgattggcatgggcaaggcggcgtctcacttcccagaggttattcagccaatcgcaagaaacacgtcattcgcgtgtgccaagatggagcgcatgcgaatcgctgacgttgaggaagatattgaccacgagctggtcagcaaagaacagattgatgccaagatccacgagatggctgctctcgcgagcgaggattaccgcgataagaatccgctgctcgttgcggtgctgaaaggggccgtgaatacgctggtcgcgttcacccaggccatgagcattcctgtacagatcgacttcatgagcctgtcgagctatggctcgggcacagtgtcgagcggtgaggtcacagtcaggcaggatttgtccgccgatgttcgcggacggcacattttgattgtggaggatattgttgattcaggacgcacgctcgcgtggctggtcgcagaactgaaacgtcgtggtgccgcttccgtggaggtcttcgctttgctgagcaagccttcccgccgagaagtggacgttgatgtgaagtacgccggctatgagattccggacgagttcgtcgtcggcttcggcctcgactttgacgaacgctaccgcaacctcgattcgatcgcggtcctcaagccgtccgtctaccaaggagtgcaagcatgagcttcccgcaagggccgggtaacggcaataatccgaacccgaacaacaaccgtaacaacggcaacccgttcaccaacccgttcaaccgtggcaataacgggaacaatggcaaaggcaacaacaacgagaaccgcccgatatggcagtccccttggctgtggggtgccgtgctcgtggtcatggttgtgctgatgttccagatgttcgccggcggtggcaccaaaaccatcgatactaaagatggtttcgcgctgatcaatcagggcaaggccacctacgccgagatcacggacaacaagcaggtcgtccgccttgagctgaagaacgactacaccaagaaaaacgccgacaccggcaaggtgaccaactacggcaagaacgtgcagttctactacaccttcgcgcagggcgcacaggtggccaaggccgtggagaacggcgatctcgaaaagggctggacctcgaatatcgagcagaccagcatgatgagctacctcatcacctcgatcctgccgttcatcatcttcttcgccctgttctggttcctgatgagccgcatgggcggtgccggcggcatgctcggcatgggcggcaagaagaacagcggcaagctgcccgacggccagacccccaccaccaagttcgccgatgtggccggcgaagacgaggccgtggccgaagtcgaggagatcaaggacttcctcaaggatccgtccaagtacaaggcgctgggtgcgcgcatcccgcgcggcgtgctgctgtacggtcctcccggcacgggtaagacgttgctggcccgagccatcgcaggtgaggccggcgtgccgttctactcgatggccggctccgacttcgtcgaaatgtttgtgggtctcggtgcctcccgtgtgcgtgacctgttcgatgaggccaagaagaacgcccccgccatcatcttcatcgatgaaatcgatgctgtgggccgcaagcgtggctccggcatgggcggtggccacgacgagcgcgagcagacgctgaaccagctgctcgtcgagatggatggtttcgacaacgacaccaacctcatcatcatcgccgccaccaaccgccctgacgtgcttgaccccgctctgctgcgtccgggtcgattcgaccgtcaggtgggcgtggccgcccctgatctggaaggccgtgaggcaattctgagggtgcatgccaagggcaagccgttcgtaccggacgtcgacctgcacatggtcgccgtgcgcacgccgggcttcaccggtgccgatctggccaacgtgctcaacgaagccgcgttgctgtgcgcccgtgccggtgcccagttgatcgacaaccgcgccatcgacgaggccatcgaccgcgttcaggccggaccgaagcgcaagtccaagggcatggctctggaagagctgcgcaacaccgcataccacgagggtgggcatgcgctggtagccgccgccctgaacaacaccgacccggtgaccaaggtgacgattctgccgcgaggccgcgccctcggctacaccgccgtcatgccgacctccgaccgctactcgcagtcgcgcaaccagctgctcgaccagatggcctacgcgatgggcggtcgcaccgccgaggaaatcgtcttccacgacccgaccaccggtgcctcgaacgatatcgagaaggctacgaacatcgcccgtacgatggtgatcgaatacggcttctccgacaagctcggtgccatcaagtggggttccgacgatgaccagaccactgtgatggacggtctgcagccgcgcaagtactccgatcgcaccgccgaagtgattgatgacgaggtgctcaagctggtggagaccgcgcacaccgaggcgtggaccatcatcaacgacaaccgcgagattcttgacgagctggtccgccagctgttggtcaaggagaccctgaacgagaaggaacttgcggcgatcttcgcgccgatcaagaaggctccggttcgtccggtgtggctgtccaacgaccgtcgccccgactcggacaagccgccggtggagattcccgaaagccttaagcgctcggtcggcatgaagccggaagagtagacacgatgacgattcggcccgacctgttcatgtggtttctcacgtacgcaggccggaccgacgtcgttgtggacaatgacaagggagagatgagatgaacgaatatatagagtcttgccatcgggagaaacgcacatacgacgaggaaggcgtgcgcgaggccgtacgtctgttcctgaagtcgattggcgaggatcccgagcgcgagggactggtggaaacgcctgaccgtatcgcccgcgcgtgccgcgagctgttcgccggtctgcaggcttccccggccgatgtgctggagaagcacttcgacgtggataccgacgaactggtgctggtcaaggacatcgaactgtattcggtgtgcgagcatcacctgctgccgttccacggcgtggcccatgtgggctatattcccgccaaggacggggtgatggggctgagcaagctcgcccgactggtcgaggtgtatgctcgccggccgcaggtgcaggagcgtttgacccagcagatcgccgacgcgctggtcgagtatgcgggcgcacgtggtgtgattgtggtgaccgaatgcgagcacctgtgcatgtctatgcgcggcatcaagaagtcttccgcccgcacggtgacctctgcggtgcgcggtctgctacgcaaccccgccacccgagccgaagccatgagcctcattttggataaatagtgtctactaagctccctcatcatagggagctcacttgggacctacatagaaggggaaacataatgactgatttgcaggcgttgcatgacactacgcacaccatggtgatgggtgtgctcaacatcaccgaggattcgtcctcggacggcggcctgtggttggacccggccaaggcggcacagcacgggcgcgacatgatggccgccggcgcggacatcatcgacatcggcgccgaatccacgcgccccggcgccaagcgcgtgtctgaggccgacgaattggtccgcatcaccggtgccgtcaagacattgattccggccggtgccatattgtccatcgacaccacgcgcgcatccgtggccgccgctgcgctgagcgagggcgcccagatcatcaacgacgtttccggtggcacgctggatgccgaactgccgcatgtggtcgccgaccacgactgcctgtacatcgtgcagcattggcgcggttggctcgccggttccaagggcgcgaaccccgatcaagacacctccgtctacgagcacggtgtattgaccgacgtacacgacgaactcatgcgccaagtcgacggtgtgctggccgccggcgtaaagcctgagcgcattatcatcgacccgggcctgggcttctccaagcccggcatcgagcacaacctgccgctgctgaccggactcgagaccttccgagccaccggatatccggtgctgatcggccagtcccgcaaacgcttcatctcggcgatgcttaccgaggcgggcgctgccggtgctgatgggccgatcatggcccagcgcgatgacgtgaccgcagccttgtccgccctgtccgccgaacacggcgcatgggccgtgcgcgtacacgacgtggccaaaagccgagccgccgtcatcgccggcaacacctggcgcgaatacgcatgattcccctggctccctgttttggttgcttctaggccttggctcccctcgggcgaggggagctggcgccgaaggcgactgaggggagcatttgagcagaaagccttaccaatggacaccatcacacttaccggcgtacatgccaacggcacccacggtgtgctcgccttcgaacacgaacggccacaaaccttcgtcgtggatgtcaccctgcaccttgatctggccgcagccggtcaatccgacgatctcaacgacaccatcgattacggccgtgtggccaaggatatcgcggctgtcatcgaaggccctcatgtggacctgatcgagcgtctggcccaacgtatcgcggataagattcttgccgatgcgccggccgtcgcctccatcgacgtcaccgtgcacaagcctcacgcacccatcgtcgtggcttttgcagatgtatcggtctccatctcgcgcgtgcgtgccaccgataatggacgtactgctgaagagcatgccatccataacgcggtggtggccttgggcggcaatgtgggcgaggtggaatccaccttgcgagccgccgttcgggagattgacgcgttgcctggcacacaggtgactggtatctcaccgctttaccgcacggccgcgtggggcatggccgacggtacgccggatttcctgaacgccgtggtggagcttgaaaccacaatgggcagccacgaattgctcgccgcgttgcaaaacatcgaagcgaaccatggacgaattcgtgagaatcattgggattccaggccgttggacttggacattatcgactttgatggcatcaccagcgcggatccggatctggcattgccccatccgcgtgcttggcagcgtgcgtttgtgctggctccctgggcggcgctgaatccgaacgccaaactcgccggagcccatgaggggcctgtagccgatttgctggccgccgcaccggaccgtaacgccgtgcaactcgagagcgaagactggatgctcggcgggcatgcagtcaagcaaaaatcagcgtcggggtcggcacccgtctcacgcaaggcgattatttcgctggattccacctcgcaggatgtcgaacggctgttccgcgaaaccatcgtttccatcgacagtgttcctggcaatcaggtacagggcatctcgccgctctaccatgtcagccatttcgacggcccggacgcgatgagcgcggtcatccaaatcgaaaccaagttgccgcccgccgacctgattgccgtattgggcagcatcgaaagcgttcatgacctggcagtcgaccttgaccttgttgacatggaaggcgtgacttccgacgagcccaactgcagcattccttggccgtcggcccgtaaccatgcgtcggtattggcaccttggctggatatggacccgaatgcttctctgggcggcgacccggtggccttccttttggccatggcaccggatgccggacaggtcggattgctatcggacaactggatactgtcgaatagttgagctgatggcggaaccagttacgaacggtaggctagaaaccagacggtgacggaccagtctccggcctcgagcagccaggcacggcaatgacgaaaaaacaaatcaagatgaacggccaaagcgcgaaggccgttcgcaaacagcaaacagcaacgcaacgataaggaggccggacatgaaaacacggcgaacaccatggtggcagtatgtgatcggtgccgtgttgggcctgttggcgggtatcggtctggcctcctacggcgaaagctcgggactgtcgctgattggtgcgccttggattgtgcccggattgctggccgtactgggcgttattgtgctgatcttggccctgcaagtgcataaatacgcgaataccgaccccaagaagcgtccgcatagcttcatcaatcccactatcgcggtgtatacgctggtgttggcaaaggcactgggattggcgggcgcaacgctcgccggctggtatggcggtcagattgtgatgagcctgagccatatcgaggcggatttctatgcacacgccgtcaccgagtgcgcaatcgcggccgtggtgtgcatcgccgacatgatcatcggcattatcggcgaatggttgtgccagctaccgccgaacgaaggccccgaaaacccgaaaatcagggaagccaagcgccgtagcgacatagcccaagcctacaagcggtaggggtgactattcctacggcacgcgcaccatagcttcctgagcgatggccgccaccaagtcgccattctgcgcatacactttggcaatgccgagtccgcgtccgtgcgcggcgataggcgtatcctgcacatacaaatgccattcgttgatatcgatatcctgataccaccacatcgaatggtcgatggacgcataggaaatgcccggtgtggaaatcgacagtccggcgcggcgcagcaccggctccatcatcacctgatcgcagccaagcgccagcatcgcacgatgcatgacctgcggcacatcgacgtggccatcggccttcatccacaccatctgcttgccggaatcatgctcggcggaatccttgtccgcgcgcagcatcacggtcggcgtcacgtggcggatatcgaacggcgatttctcggcatagtaattggcgaacggcgacttctcggcgaacggctgcatgagttctttggcggaagtcaacgtttcgggatcgggcaggttttccggcatcggatcggcaaattccacaccctcttggccggtctcctggaaagaggcgatggccgtgagaatcgacccctcggcttgggtgacgttgacccgacgagcggagaacgagcggccgtcgcgaaggttctcgacgtcaaacaacaggtcttgacgaatatcgccggcggcaatgaaatagccatgtaccgaatgcggcaggcgtgaagggcccactgttttggacgcggcgatcaccgactgggcgatgacctggccaccgtagacgcggccggtggggaagtacatactctcgccattgatatatgtgtgattgcggtaagcggaaggctcgcccaacttcagcaccttcaccagatggtccaatggagttacggtggttgcctgagccatggcgttcctcgattcttgttctgctgtgttcagtattcggttatcgtattccaacctatggttggcagtctatccggtgggggttaagagttccgggagcgaaatgtaacgagactgtttggaaggtaaacggtgggttatgcggcgcattgccgctacgttgctgctgcgctgccggtgtgttgccgtaggcgactgtgggattttatgggatgcggggcgggcagccatggggcaattatggggaaagccgcccctgagggacggctttcgacgtataaagcgcgttgtggcactaatgccggcgtatctcagccgcgcacaagcttcttgtgcaggcggtgcgggcgggccgcatcctcgccgaggcgtgtcaccttgttctcctggtaggcctggaagttgccttcgaaccagtaccacttggccgggttgtcgtcgtcgccttcccacgcgaggatatgcgtggcgacacggtcgaggaaccaacggtcgtgggaaatcaccacagcgcagccagggaattcgagcagcgcgttttcgagggattccaaggtctcgacgtccagatcgttggtgggctcgtcgagcagcagcaggttgccgccctgcttcagggtcagggccaggttcagacggttgcgctcaccaccggacagcacaccagtcagcttctgctgatcggcgcccttgaagccgaagctggccacataggcgcgggtcggcacctccacaccggccacctcgatgaagtcgaggccgccggacacggcttcccacaggttcttgttcggatccaggccctcacggttctggtccacgtagctgattttgacggtgtcgccgatcttcagctcgccgctggtcagcggctccaggcccacgatggtcttgaacagcgtggacttacccacgccgttcgggccgattacgccgacgatgccgttgcgcggcagcgtgaaggacaggtcgtcgatgagcacacgctcgccgaaggccttgtggatgtggttggcttccagcacggtggaacccaggcgcgggccggccggaatctgaatctcggagaagtcgagcttcttgttgttgcgtgcctcgttttccatctggtcgtaacgctccagacgggccttgttcttggcctgacgggccttgggggaggagcgcacccagtcgagctcgttcttcagtcgcttggcgagcttggcgtccttggctccctggatctccagacgcttggccttggtctccaagtaggtggagtagttgcccttgtacgggtacaggtggccgcggtcgacctcgcaaatccattcggccacattgtccatgaagtaacgatcgtgggtgacggcgatgactgcgcccttgtactggtgcaggaactgttccagccacaggatggactcggcgtccaggtggttggtgggctcgtcgagcagcagcaggtccggggcctcaagcagcagcttgcacagggccacacggcggcgctcgccaccggagcacacgttgaccggggtgtccgggtccgggcactgcagggcgtccattgcctgctcgagctgggagtcgaggtcccagccgtcggcggcgtcgatctcggtctgcagcttgcccatctcttccatcagggcgtcgaagtcggcgtccggattggccatctcctcaccgatttcattgaatcgggcgaccttctcggcaatcgggccgaacgccatcttgatgttctcgcccacggtcttggtgtcgtccagcggcggctcttgctgcaggatgccgaccgtgaagcccggggtcaggctggcctcgccgttgctcacggtctccaggccggccatgatcttgagcagggtggacttacccatgccgttcgggcccacgacgccgatctttgcgccgggcaggaagctcagggtcacgtcatcgagaatcacgcggtcgccgtaagacttgcgggccttgatcatctgaaatacgaattctgccatgttgtgcagttactccttaaaaaggggttgaaattccgctgtttctttagtctttagtttgtgatggatacgctgtgtgcagcgcggagcacgcccccgaatcacggatcgcggtgcgccgcgtcaggcctgtgccgccctgtccgcataacgatcgaatccacgccaaaccaccgcccaccatggtatcggaagggctggaatggcgggcgtcgctatggcttggaggggtaatggatgggcctgacattgccgtggcgcgacgcgccgggcggcgcgccgtggtccagtgatgctgtagtatatcctcttgtgcttcattgaggtacagatggccccgtagctcagttggttagagcgccgccctgtcacggcggaggtcaccggttcaagtccggccggggtcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagagcgccgccctgtcacggcggaggtcaccggttcaagtccggccggggtcgccaccaagctcctgacaaatgtcaggagcttttttgttcttttgccgtatttcgtggtgtagggcgaaatatggggttataggccaaaatgtgtgtctggtgtttagtcgtttgatggccattcgactctggcatggaagctgtttcagtcgatgccgatgccgtatcgcatggaaataccgaaggtttcgtgctggccttggggctctgctcgacacgccgatagtctgaatgacaacgtttgctattgaatgacaacgttagcgttaacagtgcttataaatggtgaaaaacgtgtgcagggtcacattggcagaacgtgcgcgagatatgacaaatcatgaaaaatacgctatgggaggtcatggcaactcgttactattttcgctgtctcgtacgccacacaagccttcaaggagtaagccatgaccacgctcgccattgatatcggaggaactaagatcgccgccgccgtctgcgatgaaaacgatagcatcatccagcgctggcgcgtccccacgccgatggatgccgacgccatcaaccagcacatcgccgaggtgtaccgcgaggctgtggccgccggacacaccgatatcgaggccatcggcatctccgccgccggcaacgtgagcgccgaccgcaagacgctcaccttctccgccaacatcccggcctggatcaactacgacctgtccgagcacgtcggcgcgctgatcgaccatgccgtgccggtcgttgtcgagaacgacgccaactgcgccggctggggcgaatacgtgcacggtgccggccagggcagctccaacatggtcgcgctgaccgtgggcaccggcctcggcggtgccatcgtgatcaacggccagctctaccgcggctccttcggcatggccgccgagctcggccacctgccgatggtcccggacggcgaccactgcggctgcggcctgcgcggctgcgccgagcgctacacctcgggcacttcgctggagaacttcgccaagtccgccgtgcgccgtcgtcctcaggacgccaagcgtcttctggaactgtgcagcggcgacatcaccaaactggaggggccgatggtgtcccaagcggctcaggaaggtgacgtacttggcctgtatgcgttcggcaagatcggcgaatggctgggccgcaccatggccgccgtttccgccgtgcttgacccggacctgttcgtgatcggcggcggcgtggtggccgtgggcgacatcctgctggagccggcccgctacaactaccagcgtttcctggaaggcagcgcctaccgcggccatgccaagatcgtcgccgccaccgccggccaggatgccggtctgatcggcgcggccaacctggctctgcgctgacgatgtcgctccggcaacgggacgttagtctaatggtgagtcatggccggtgccatggctcactgccgcgctgatagtgcggtcgatgagtttccgctgcctgaccatggaatcgaattccgggttctcagcgatttcctcgtactcgtgttcggtggtcacgccggcgatttcggcgataatctcctcataggacgtttcgacggttcgatgcacgccggtgacgtgcccctgacgtatcacgacaatgcggtcggataccgcgaacacatccggcagatcgtggcagaccatcaccacggaccggccttcggagcgcagtctcttgatatatgcgagcacttccgccgactgcatcaccgacagtgcggtggtcggttcgtccagcagaataagctgcgggtcattgagcagcgtgcgtgctatggccacggtctggcgctggccgacggataaggatgcgataggggagccgacccgaatcgccgagctcagggtcttcagcacggaacgggcacgcgagttcatcgaatcgtcatcgcgtatgccaatctgattgatctccttgccgaggaacaggttcgaggccacgtccaggttgtcgcagaactcctgcctctggaacaccgatgcgatgcccatgcggtccgcctccctgatcgagggaatggtcacctgttcgccgttgagatagatatggccgaatcccggctgcagaaatcccgcgatgaccttgatcagagtggactttcctgcgccgttatcgcccacgatggcgacgacctcctggcgttggatggacagattcaccgatttcaacgcctcgacgaagccgaacttcacacagatgtcctccagccgcagcagaggaggtgtgctcgaattcctcatggtgtgttccttcttctcactcttctcctggtaccggtcactggctgacgtcattgcgaaccgagaactcgatggcgcataatgcgccgcctagcgcgcagttgtcgttcgggtgggatgacacaagtacatcgatgggtgccacggcatcagggaacagcatgcgctgcaacgcttcattgaacggttggatgaatacgtcgccggtcatggccagcttgccgccgagcacaatgacctccggatccacgctgatgcacagatcagccgccacctgaccgatacgcacggccgtgtcggcgatgatgcgacggcaaccggggtcgccttcgttggcaaaggacaccagatcatccagcgtcatattgccgtgtgtgacgctgagcaactgcaccagcctgttttccgccacgacggtgtcaaggcagccgcggttaccgcacgaacagatggcacccagcgggtcgacctggatatggccgatttcaccggccaggccggtcacgccatgcatgatttcgccgttgatgacgatgcctgcgccaaccccgtcgttggctgagatatatacgaaattgcgtttgcctgccgccacgcccatacgggattcgccgtatgccgcgaaattcgcgtcattatcgacgtatacgggaacgttgaacgccgtgcgcaacggggccgtgatatcgacgccgtcccatccgggcagaatgccgggaatcgctatggtgtggtcgctggtggccaccggtgcggccacggccacgccgatgccgaccagctcgctggcttcggcgtcgatgctgctcagggtctcattgatgagcagcatggcgcgttccagcgttgtgtccgccttgtggcccaacggcagggggagcgtgtgctcagcgatgattgacttcgagaagtcaacgatagaaagcgtaagatgacgtcgcgcgatccaaagcccgacgccgaggccctgatgccgtgcaagggtcaccagagtggctctgcgaccgttgcgaacggtgtttttggtctccagctggtcttcgtcgacaagctgatggacgagcgtggacacggtcgcagtggacagtcctgtcacctctgccagttcgacctgtgtcatggcgccgaacttgtggatgctggccagcaagttggcgcggtttgcctcgcgaagcgaggtctgcgaaccgaaaagccttgttgccataagagttcagtgtagtcgttaccagcatgaggcacagcgaggcgcagagcgtggatttttcggcgtgtcgccttgtgatgcgcgaaaaatcgccattgcgttcattggttgaacataaacgacaggaaattcgctttcttgagtttgacaacttaactcaatacggtattctatgagatgaacctgaggttattcccaggttcgggcgaccaaggagggttcgccatcccctcgaagatgaaggagaacaaatgaagttcactaagaagatcgtcgccgtggtggcaggcgttgccatgtgcgcgggcctcgcggcctgcggtggcagccgtagcggccaggcaactggcggtgatgccaagatcgaaaagggcgccactatcggcatttcgatgccgaccaagtccgaagagcgttggaacaaggacggcaacaacctgaaggccaagctggagaaggccggatacaaggtcatcctgtccttcgccgacgataagccggcccagcagaacgctgacatcgagaacatggtcaacaacgacgccaagatcgtcgtggtcgcttccaaggacggcaccgcagtgggccccgccgttgagaaggcccgcgatgcaggcgccaaggtcatcgcctacgatcgactgatcatgaacaccgacgccgtcgactactacgccaccttccagctggagcaggtcggcgtgctcgaggccacgtggctcattgaccagctcaagcttaaggatggcgccaccggcccgttcaatatcgagctgttcaccggttccccggatgacaacaacgccaagtacttcttcaagggcgcttgggatctgctgcagccgtacttcgagaagggcgtgctcgtctccccgtcccagcacggtcagggtggcgtgaccaaggacttcaccgttgaggattggcagaagatctccgtgatgagctggaagaccgagcaggcgcagaaggacatggaatccatccttgactccacctacgcccacggcgagaagctcgacgcggtcctcactccgtacgacggcatcgcccagggtgtgatcaacgccatcgaatccaagcgtcccgacatgaagccgggcaccgactcctggccgtatatcaccggtcaggacgccatggagatcgcagttgccaacatcgccaaggataagcagggcgagaccgtgttcaaggacgtgaacaagctggctgacgccgtgtacgacatggtcgtcgagatcgccgagggcaaggaagtctccggcctgaacggcaagttcaacaacaacaacatcgacgtcccgtccaagctgcttgacccccagaacatcaccaaggacaacctccaggatctggtcacggccaactacatcacccaggatcgcttcgacgagctgactaagtagtcctcatcaggcaatccgtaaacaaacacaatgacatgcggcgcatagccgatatgcgccgcatgtccatgaacacagaactgtgacgaggagtggtgacatgtcatcaaatgacaccatcttgacgatggaaaacatcacgaagacgttcggtccggtcaaagccctcaccgatgtgaatctttccgtcgatcgcggcgagatccacgccatctgcggcgagaacggtgcaggtaaatcgaccctgatgaacgtgctttcgggtgtgtacccatacggtagctattccggcaaaatcacctttgatggcaaggaatgcaaataccatactattaatgattccgaggccgacggcatcgtaatcattcatcaggaactggcgttgagcccgttcctgtccattgcggaaaacatcttcatcggcaacgagcaggccaagggtggcgtaatcgactgggacaagacccgtgccgaggcgaagaagctgctcgatcgtgtgggacttcccgaagacccggataccaaggttatggacatcggcgtcggcaagcagcagctcgtcgaaatcgccaaggcattgtccaaggacgtgaagctgctcatcctcgatgagccgaccgctgcactgaacgatgaggattccgcccacctgcttgacctggttcgtcagctacgtgacgagcagggcgtgaccagcatcatcatcactcataaactcaacgaggtcgccgccatcgccgacaatgtcaccatcattcgagacggttcgaccgtcggtgtgatgtacgtgacgccggagacgccgctcgaccaggaagaactcatccgcaagatggtgggtcgtccgctgcacaacctgtacccgaaccacccctccaataccccgggcgaggaatacctgcgtgtcgaggattggaccgtgcatcatccgctcgacgcggagcgcgtgatcgtagaccatgcgaacatcaacgtgcatgccggcgagatcgtcggtctggcgggtctgatgggtgcgggtcgtaccgagatggccatgtccatcttcggccactcttacggttccaacatctccggcaaggtgttcgtcaagggcaaggaagtcaagatgcccaacgtgcagtccgcgattgacgcaggtctcgcctacgccaccgaggatcgtaagggcaacggtctgaacctgctgcagaacatccgagagaacgcgtccctggcctccctgaccaagatcagcaagggcggggttgtggacgacaaccttgagcgcaaggaagttgaacagtaccgcaaggacttcaacatcaagtgccatgacatcgatgtgaatgtctccaccctctccggtggtaaccagcagaaagtgctgctcgccaagtgggttatctcgcagccggacatcctcatcctcgatgagccgacccgaggcatcgacgtcggcgccaagtatgagatctacgaaatcatcgataagcttgccgatgcaggcaaggccgtcatcgtgatttcctccgagctgcccgagctcatcggtatctgtgaccgcatttacacggtgtcctacggtgtcgtcaccgacaatgttgagaagaatggatttacccaggaatacctgatgaagggtatgaccaaggaaagggaggtggcagcctgatgagcgccgcaactgcaacacctgcaaagaaagaagaaaagaccggcctgctggccacggttgccaacaatgcccgtcaatacggtattgtcggcgcactgctggtcatcgtcgtggccttcgaggtcctgaccggaggcgtgctgctgaagccgaactccttcgtgtccctgattcagcagaacgcttacgtgatcatcctggccattggtatggtgatggtcatcatcgccacccacatcgacctttcggttggttccttggtagccttcatcggtggtgtgtgtgcactgctgatggaacgcgccggagtcaactggatgctcgccatcgtcatcgctctggtcgtcggcctgatcgtcggcgtctggcagggcttctgggtcgccgtcatcggcatcccgggcttcattaccactctggccggcatgttgatcttccgtggtctcgccaccgtgatcgtcggcgaatccgtgccgattacctccctcgaattccgtggcattgcccgtaactacctgcccaacatccttggctggtggggtccgttcgatggtctgaccattgtgctcggcatcctgtgcatcgtcggctttgcctggagccagctgcgcaagcgcgcccgtgtggccaaggtcggcctggtgcccgagccgatgagcctgaccgtcctcaaaattgtgcttgccgcggtcgtcatcgccttcgtcacctacctgctggcttcctccggtaacgctgatcagggtggtaccccgatcatgctggtgatcgtcggtgtgctggtcttcatctacaacttcatcctgaccaagaccgtgttcggtcgccacgtgtacgccgttggtggcaaccgcaaggccgccatcctctccggtatcaacacccgccgcgtggacttcctgctgttcgtccacatgggcttcctgtccgcagtggccgctgtctgcatgctctcccgtctggcttccgcaactgctcaggccggtatggagttcgagatggacgccatcgccgcctgcttcatcggtggcacggccgttaccggtggtattggtaccatcccgggcgctgtgatcggtgcattcgtgatgggtgttatcaaccagggtctgtcgatcatgggtgttgacaccgccgtggtgaagaccatcaagggcctcgtgctcctgctggccgtcgccgtggacatcatgtccaagcgcaagaagagctgaccttcccctttctcctcctcgatgtgggattcgtgccggtgccgctggtgcggatcccacactgttatctgccgtcattcttgtaatcaaaggactttttccgccatgaaactcaccgcgcgctccacctcccgtatgtatgcattgacctgcttggcctgcgttatctggctctggcagtcactggtcgaggccaataacgatggctcgctgttcaattgggccactattgtcttctcgctgtgcttgctagtggtcatcggatggagtggttggaatgccgtcgccgggtggaacgccaaggagactgaggccgccacggcaggtgccaaggatgatgagggcagcactgatcggtagcgtatatacggctgttgttgccggggacatataggtcccggcaaatctgcagcgatatgtgcattgcaagccagggattccctggcttttttatgtcgaaacggaactcgacacgggcgcgcaggccgttgggtttgtctagagcctgcatatagttacttatggtaatgactattggtaactaattggaggttgggccagcgatgtgcgattcccgaaccgataccaagaccggcttgcttccggtgaatgaggtgcggagcctcctggatgtctgctggaaggccaagaccatcaccgaactgatgccggcattgccgaaaggtatgaaaccgcgctatgtccacgtgatcgacgccgtctggcatatcaacgaaccgaatgggcaagataccggcaccgcgcgcgtgggcgacgtcagcgcattcctcggcgtcactacgccgagcatcaccaagctcgtcggcgaaatggccgacctcggactcgtcgtcaaacacgccgatgccgccgatcggcgtgcggtgacgctcacgctcaccgaacgcggcttggatatccgccgtatctatgtggaggaatatcacgcgcatttgagccaactgctgggcggattgacctcggaccagtgcgaaaccacggtacgcaccttgaccgaggctctgcgactcatgcaggaagacttccaacgtcgtagtcagaatatctgaatgaatggaggagagaacaagatcgtgactcattccgcaacacagctgcctaacggcggcaagcaaccggtctccaacaaactcgtcatcgcggtcgtctcgctcgcgatcctgaccttcctcggcatcctatcggaaacgtcactgaacatcgcctactccacgccgatggaggagttctccatcggcgcctcggtggtgcagtggcttgtcaccggttatctgctcttgctgtcggtgtcgattccgagctcgccgttcatggtgcgcaaattcgccaccaaaacactgttcatcatggccatcgtgattttcaccgccggcacattactgggcgcgctcgcggtcaacttcccgatgctgctcgccgcccgactggtcatgtcgctcggtaccggcatctccctgccgcttatcaccaacatcattctggagaaggcgccacttgaacagcgtggtgcgatgctcggcatagtcggcctggccacctgtgccgcaccggccatcggcccggtattcggcggcatgctgaagaaccacttcccgcccaagttcatccttagcggcttcgccggcaccatgattatggatgtggtgttcgttgcgctgtccggcaatgtgtgggtggtggccatcgccgcgaacgatggggcggacgcggccggttcgtatacggccgcgttcccgcgcagcatgatggtgttcaccggcatggccgtgcttggcgtgattctcgccgcgctcatgttccgattctccactcgccgaccgccggaattgagagaagtcaaatagtacgcccgcagcggattggttggctttatgatggaaccgatattccatcacaggagaagcaggggaactatcatgcttgatgaaccaccagtcactccgatccgcaaggccagtgacggcctcgaactgcccgccaccggcttcggtacgtacaaggtcaacggcctagccggtgtggacgccatcaagtccgccattcatcagggctaccgactcatcgattccgccttcaactatgagaatgaaggcgtggtgggccgcgctatccgcgaatccggtgtgccgcgcgaagacatcatcgtcacgtccaagctgcccggccgccaccacgcccatgacgaggcgctgctcaccattgaggagagcgtgtgccgtatgggcctcgactacatcgatctctatctgatccactggccgaacccgagccaaggccagttcgttgaggcatgggaggcgctggtcgaagcccgtgaacgtgggctggtcaagcatatcggcgtcagcaacttcttgcccggccatattgatctgctcattcgcgatacgggcgtgaccccggccgtcaaccaagttgagctgcacccgtacttccagcagcgcgaacagctggcctacgacaacgcgcacggcatcatcaccgaggcatggagcccgctgggccgcgccaaccagatgctgcgcgacccggacctgaagcgtatcgccgccaagcacggtatttccgtggtccaggccattttgcgctggcacctccagtacggcgacgtggccatcccgaagtccttgaacccggagcgccagcgtcagaacctcgacctgaccgcttttgaactcgatgatcaggacatggccgatatcgccgcaatggacaaccccgaaggtcacaccttcggccagaacccccattggcacgaagaagcgtgattccagcatgcaacgtcctattatgacttcgcggtcgtttttgcgcacgccgtccgaagcggccgggcccggcgacgagcaggtgatcgaagacctcgtagacacgctggaggccaaccgttcacggtgcgtgggcatggccgccaacatgattggcgtaggcaaacgcatcatcgtctttgtggatgaagaccttggcgggcgcataacggtgatgctcaaccccgtgattaccgcttcggacggtgccttcgatacccaggaaggatgcctgtccctgaccggcgaacgccgcacgctgcgttatcgacgtattgaggtcaactacgagaaccgtcggttccgcgcccgccacgccaccttcgccggttggactgcgcagattatccagcatgaagtcgatcactgcaacggcatcattatctgattcatatcggtgctcattgcagcccaactcccgaggctggtcatcgcgattacgatgcgattacatcgcaaccgctatgaccagcctttttgtgcactggtggggtgggtgttctcagcggtgttggggtgccatgcgctggcaggttggcttcgctgaggggtgtgggtggtgtcatgtcgccagcggttggctggttggcttcgctggaggttctctcagcgtcggtgatgtgccaaagagtggcgggctggcttcgctaaggagcgctaccgtcggtggagaaccagtgcgtgacctgctgccgacgctaagcgttcattaagcgtcgttagcggccaaaacttggacgtgtaacgatgctgggcggttttagcgtcgttgctgtgccaagttgtggtcctctgccgacgctgccagtgcagtagcgtcggcgttgggacaggtgttgggcctttgccgactctataagcgagggaaaatcattcgccggtgcctaagtgggtctattgccatgctgaatacatctgctgagtgtagctatgcgttcgaaggcgatttcgggacctttctcagtagcaaacatgcctaatgcgcggagttatacacttcaccgtgcacttatacacgccaaacgaagcagaaatcgactgctgacagtggacgacacgccagagacgatgtggataacccagagacggtggataacagctgcgcgatcagtggataacctgcaagaaagtgcggttatccaccgacggtagccactgttatgcacattccataccctttggaatcattgggttttccacttatccaccatctcgccatgtgggcttgcgagccaccgcacgaacgtcatacagtgtgcctcacggcgggcaacgtagcccgccgtccacatcacatgaaggggaaacaccatgagcaccgcaatcactactactgccgaaaatgccggtttgccagcaatgctggacaccaaagacgtagccgagatgttcaaacgctgcaatctcgccgtctatgccgaagcgagacgcatatattatcgcgaagtgaatctgaacccatgcaaaaagtatccgaagcaggtgctgcaaaggatcgaatggtggttctgggattggtttgcctatgactgcgccgtcagcggtattggactgaccggcaatgaatccgaagatttacgtatcgaattgcagtacggtccgggcgcaggtatctcgccattcctagccttggccgaattcatgtatgacaaggacgaacgtatcggcacacgcgagatacgtgattttcgcgaacttgatgacaccaatttcgcttcgatgttctggattcgcgatgccagcgcggtcaaaggtcgtctgacagttgaggacatcattcatggtggtgtctacgaggtggcggacgtacatgccgcctcgcaatacgatggtgcgcacggcggcatgatcgtcaatcgcatcgcacatgtgagaggcgtgtggcgatcctgttccatcccgatctatgaggcacgaaggcctgatgacccgcaaatcggtgattcgctggcccgttcattccgggaaaccggatataaaccggactttgccggtctggtgcggtttttctacgggagggccaaagacaccggtctcgactgggaagatgtggaagccgcgcgccaagccggtactttggacgcgctgatcaagaaggccagcaatcggtgaaggattcgcctaacgctgctgtccaagtcggcggccgcgatcacgaatgaagagtgacgcaaccaaacagaccgcgcacacaatggcgaccgtgcggaacgaagcccgcacgccaatggccgatgccgccgcttccggcactccggtgcgcatggccgccgcggtgtgcgtgttcatgatggtgaccagcagcacagccgcagacgtcatgatcgcgaagcccagtaaggcgagcggccggccaccgatacggtcatacatcttgcctgccaccgggttcaggatgcccatggcgatgccgctcggcatcatcaccagaccggacaccagtgcattaacgccaagatcattctgcaaatatgcccatcgcgtacaggaacagctggcgggtggtgaaggtctcgatgaggaacgcggtgatcgggatcatgatgccgttggtaagcatgaatccggtggtcagccattgcacggtgctgctgggcacgtcgaactcgtgcatcaacgtgggcagggcggagatcatcagcgtttggttgaggatggccacaaacgagccgatcatcagggtgatgaccatggcggtggtgttggcgggggtggtgctgttggagttggcggggtggtggagccggcctcagcggtggccggcgaggaattgcgtgacgtcaattatcaagtctcgtttccttggctgagttgtctttcttggcttgcccatactatctgtgccttgactgcattcgaaaaccattgcaatgactagcaacacgctgagacgcggcgtattaattcaatcatttgacaaacttagttcgttcgttttattattggtcctgcaatccgtaatatcgcctactgcaaaggagcgcccaaatgggtctgtgggatgttgacaagatcgagtacgtcggccgcgccaaaggaccgaaggaagacttcgccttccattactacgatgccgacaaggtcgttgccggcaagaagatgaaggattggctgcgcttcggcgttgcttggtggcacaccttcaaccaggaactggttgatccgttcggcaccggcaccgcgcaccgcccgtactacaagtacaccgatccgatggaccaggctctggccaaggtcgactacgccttcgagctgttccagaagctgggcgtcgagtacttctgcttccacgatcgtgacatcgcccccgaaggcgacaccctgcgcgagaccaacgccaacctcgacaaggtcgttgacaagatcgacgagaatatgaagtccaccggtgtcaagctgctgtggaacacctcctccctgttcaccaacccgcgcttcgtgtccggcgccgccacttctccgttcgccgacatctacgcctacgccggtggccagctcaagaagagcttggagatcggcaagcgcctgggcgccgagaactacgtgttctggggtggccgcgaaggctacgagaacctgtggaacaccgagatgaagcgcgagaccgaccacatcgccaagttcttccacatgtgcgcagattacgccaaggaaatcggctttgaggcccagttcctgatcgagccgaagccgaaggagccgacgctgcaccagtacgacttcgatgccgccaccgccatcgagttcctgcgcaaccacgacctgaccgacgtcttcaagctgaacttggaaggcaaccacgccaacctggccggccacacctaccagcacgagatccgcgtggcccgcgagtccggcttcctcggttccctcgacgccaaccagggcgacaagctcatcggctgggatatggacgagttcccgaccgatctgtacgagaccgtcgccgtcatgtgggaagtcctgcaggccggctccatcggacctcacggtggtctgaacttcgacgccaagccgcgccgtacctccttctacgaggaggacctgttccgctcccacatcgctggcatggatgcctacgccgccggcctgctggttgccgacaagatgaaccaggacggcttcatccagaatcttcaggccgagcgctacagctcctacgactccggcatcggcaaggacatcgacgagggcaacgtcaccttggccgacctcgaagcctacagcctcgacaagccgcagtccgagctcatcgccgccaccaagtccgatcacctcgagtccgtcaaggccaccatcaacaactacatcattgatgccctggctgaggtcgagtgaccatcggtctgaccgattgaattcgctccatcgggcgtgtacacatcaattatgatgccagtgcgcccgatgggctgattcgatagtttcgccatgtgcggtgttgtgttatgcccgcatggcacctttccattccttctttctcctttctctccttccgctgaaaaaccgcctgaggcaacgtcgccaagggcggttttctggttgtggcggggctggggggtggattggggtgggggcgaacatgttcgcggaggggtgcgttgacggtgacgtgttggcgacggtgaacatatcggcggcaggagaagataagctgttctcaggggaacctcagcacaacaaaggagttacgcatgcgagatttcattttccataacccggtgaagatctacttcggcaaagggcaggcgcgccatatcgcacaggaggtggagcgtgtcgagggcgccgttctggtggtgtatggcggcggatcgattaaacgcaacggtgcctatgacgatgtgatggctgcgctggcaggaaccgggcgcaaaatcatcgagctgcccggcgttacgccgaacccgcgattggacaaagcgctggaaggcgtacgactggtcaaggagcatggcgtcggcctgattctggccgttggcggtggctcggtaatcgactgcgcgaaatttatttcgttgggttccggcatcggtgacgatgaggatttgtgggatgactacatcgaaaccggcaaaccggcacctgaagggctgattccggttggcgtggtgctcaccaccgcggcaacgggctcggaaatgggagatgcggccgtgctcaccaattgggaacgtaaccgcaagctcggctatacgtcgttcccgctgatgcccaggttctccgtgctggatccaagctacctgatgacattgcccgccgaacagacggtgtatggcttcgaggacatgttctgccacacgtgtgagcagtatttctcctatccggtggacgacaacctttccgacgaaatcgccgagggaatccaacgtcatattctgcgttcgtggcgagcgtgcttgtccgatccgaaagattatgaggctcgctccaatgcaatgtgggattccacgttggctctgaaccgcattatctcgcgcggcaaggaagaggattgggtgacgcacggcatcgagcacgcgctgtccgcatacaccgatatcgctcacggtgctggtctggctgtggtccacccgcattggatggcatacgtgtatttggtcaacgatgaggtgacggctcgctttgcccgctgggcggtcgacgtgtggggtgtgacgcccaccggcaaaaccgatcgcacggtggccgaggaaggcattgatcgctatgtcgatttcctgcgtcgcgtaggtgcgccgctgactctttctgaggccggcgtgcccgacgatcccgcctctctcgacaagtacgccgatcatgccggtgaggccggcggctcattcgtgcagattcaccgtgacgatgcccgagcgattctcgaggcatgcaaggaaccggtgtcgttctgacggttggactaatcccgtgatttgagccgccgcgtgctgtcccgcaccaccaaagacgtagaaagaaccacgcgcttctgaatcttgcgtccttcattggtatcgatgaccatgcgggctgcagtggcggccatgtcttgcaatggctggcggaccgtggtcaacgccgggcccatgtacgcggcggtctgtatatcgtcgaatccgataacggacagatcttcggggatacggattttcagttgacgggccgcctcgtaaacgcccatggcctgtaggtcattgcctgcaaagatggcggtcgggcgactttgttcgtcttcaagtaacgccatggctccttcgtaaccgcctggcgtggtgaaatcgccttcggtgatgagttcgggagaggtggggatattgcgttcggcgagggccgccgaatagccgtcaagccgggcacgtgagcagagcatttcatccggtccggtgatgatgccgatgcgcttgtggccgagttccagcagatgacgggtggcgatgacgccgcccatccagttgtccgcctgtacggagagatcatctaatgccggattgccggaagggtcgaagacgacgaaaggaatgccgtgtgattggaacatgctgcgttccttgtccgtcaagttggagaacaccagaatagcgccaatgggctggcggtcgatgatgccttcaacccaggaagagtcggggtgctgctggtcgccactttccgcaaccatgacattgatgttgtgcggcttggcctccgtgatgatgcccctgagcacctccagcgcccaaatggtctcaaaatcccgaaataccacctcgatggtgcgttgtttacgggagagggagacgcggcgaatgtagccgttgtctttcagggctttgtcaatggcctgccgggccgcctccgaaatatccgccttgccgttcagggctttggacacggtggccagtgagtagccagtctgtttggcgatgtctgcaagtttgaccttgttctcgccgttgcttttgcgctgttctgccgacgtcatcattgaccgccttcatcagagaatgttgatatcagtatattcgaaactttcgtaaagtcaatttgacgataaagaatggtatgtatagataaaaaaggttggaatttcaacgattttgatagtaaaaaagccgatataaatttcgtttgaccgtcaaactaaggctctctatgatagagatatcgaaaacataaagcgagttttcgataaagttaaagaaggttgatggaataggtgaaacggcgaggtttcactgaaaacatcattaattaccagctgttagatatgtaaccggctgatatacctttcgaaactttcgtaaatcgcggatcggtttcatgctggtcaagaacaataaggagacgataatgaagttcaagtccgtggccgccgcacttctggcggcggtaacctgtgtcagcatggccgcttgcgggagcggcggcgacacgaatgccgatggcaaggtggaaatcaccatgtggcacaactccaccactggcgacggcaaggcatactgggaatccgccgccaaggcgttcgagaaggaaaacccgaacgttaccatcaagattgaagccattcagaacgaggatatggatggcaagctgcagaccgctctgcaggacccgaattccgcccccgatatctttatggcgcgtggtggccagaagctacgtgatgtggtcgaagctgggcaagccatggacctgaccgacaagatctccgacaccgtcaagaaccagatggccactgctgaagccaccggcaccatcgatggcaagatctacagcgtgcagcagtcagtgcttcccggcggcatctggtattccaaggatctgttcgagaaggccggtattactgaaactccgaagacctgggatgagttcaagaccgtggtgcagaagctgaaggacgccggcatcacgccgattgccgtaggcggtaaggacgcctggccggccgcccactggtggtactggttcgcactgcgcgaatgctctgctgacaccttcgacaaggcccagtccgataaggacttcagcgataagtgctggacccgtaccggtgatgatgtgcaggcgctgctcgacctcgatgccttcaacgatggcttcctgaccactccggcccagcagggcgcaagctcctccgccggcctgctcgccaaccacatggcagctatggaactcatgggcggctgggagcccggcgtgatcaaggacctgactccggacaagaaggacatggccgacctcggctacttcgcattcccgaccatggacggtggcgaaggcgatccaactgccatcatgggtggttccgatggcatggccgtgggcgagtgggcgcctgaagaggctgtggacttcctcaacttcgtctccgagaaggaatggcaggagaagtacgctgaggcgttctccaccatcccggccaacaaggaagcccaggatgtggtgaccaacgaggctctgaagcaggtgctgaccgtctacaacgacgcatcctccgtgtccatgtggctcgacaccgtgttcggtcagaacatcggcaacgcactcaacgaaggcgtggtcaacatgatggccggtcaaggttccgcccaagacattgtcaagggtgttgaaaccgctgcggccaagggctgattcgctctgccccgaccgtaattcccgggccgcggcgaatgcttgcacagcaacaaccgcggcccaatttgttttcttaggaaggcctcaacaatgtcagtttcagcaggcgcgaaggtacagcgccgcacgtcgggcttaagcgacaaggttcgcaaacgtatcgaaatcaccatcctttcgcttcctgccctgatcatgttcctcggattcgtcatcctgccggtgttcatggccggctactacggattcttcaagtggaagggctatggcaagcccaccgtcaacggccagttcatcggttttgaaaactacaaggtcattctgaccgacccgaacttccagcaggcattgggacacacgctattcgtggtcgtcgcttcgctcgtcatccaggggccgctggccatcctcttcgccctgctgctcaaccagaaattcaagggccgcgcactgattcgtaccctgattttcgtgccgtacgtcgtttccgaagtcatcgttggcaccggctggagtctcatcctccagaccacaggcgcattgaacgcgctactcaagaaaataggacttggcggggcggactggatctccgatccgaaaatcgccatctggacattgatgttcatcatttcgtggaagtacatcggcttcgccgtcatcctgatgattgccggcatgcagtcgattcccgaagacctctatgaagccgcgaaggtggatggtgctggattctggcgtcagcagtggagcatcaccctgccactgctcggccccaccattcgtatctgggcattcatgtcgattatcggttctcttcagctgttcgacttggtctacatcatctggggccagtacgtgtcgtctaccgcaggaacgtccaccatggcaacctacatggtgcgcgaaggtcgactcgccaacaactatggttacggttccgccgtggccgtggtgatcttcatcatctcgctggtcattgccttgacctaccagcggttcgtacttaaccgagatctcgaaggtgcgctcaccgacgagaaggatgccaagcgtcgtgccaagcgtgcggcgaaggaagcggccaagcttgccaaggccaatggcaatgccgcagcagttgcaaatgaggtggtttcacaatgacgaccgcagtctccccgtccgtgggcaagggcaagaacaagacctatgatccgtatgcattgagaaaatccgcaaagaccccgtggggcaacccggtcgtctacttcttctcactgctgcttgtggcgctgtgcgttggcccggtgctgtacatcattatcggcggcttccgcaccaatgcgcagattacgagggacccggccggctggcccgatccatggaactttgagaattacaagacggtgttcacttcgaacatcttctggccggaactcgtcaactccctgatcgtctccattggcacaatggtgggcatcgtggtgctggccttgatggtgagcttcgtcattgcccgatacgagttcaaattcaacaaactgctgtactcgctgttcgccgccggcatgatgttccccatcaccgtggccatcaccccgttgtatctgctgctgcgcaatctgcacctgatcaactcgcatctgggcattattctgccccagatagcattcggcctgccacaggccatcatcatcctggtgccattcctcaagtccattcctaaggaactggaagaagcggcagagctggacggctgttctcgcatcggcttcttcggccgtatggtgctgccgttgagctggcccggcgtggccaccgtcggcatcctgagcttcgtgagcagctggaacgcctacatgctgccgctgttcctgctcaacgattccagcaagtacaccttgccgctcggcgtgcagatgttcagctcccagcattcggtcgataccgctcaggtactggccttcacctcgctgtcgatgattcccgcgctgatctgcttcaccattttccagaagaagatcgttggcggcctgaccggtgctgtcaagggctagtcgcagcaaccataaccgtgccgtggaaaggtacatggctctttgggccgattcctttcaacctcttcctttcctccttcccacggcacccattcttttcaatgaggagaaaaccatgaagatctccaatcccgtactccccggattcaacgcagatccctcgatgattcgcgtcggcgacacctactacatcgccaattccacatttgactggtggccgggagtccgtttgcacgaatcccgcgacatggttcactggaatctgctgcccgggcccttaaaccgcgtttcccagttggacatgaagggcaacccgtctggcggcggcatctgggcgcctgacctgtcctacgcggacggcaaattctggctcatctacacggatgtgaagatcgtcaacggcgcgttcaaggattgcgcgaactatctggtcactgccgaggacatccgcggcccgtggagcgagccaatccgtgtcaatggcgtgggcttcgacgccagcctgttccatgataccgatggacgcaagtatctggtgcagcaaacctgggacttccgtgaatatcatcatccgttcgacggcatcaccttgactgaattcgatgtcaagaccatgcaattgaagccggaaacagcccgcaccatctggcgcggcaccgatgtgaaattagtcgaagggccgcacctctacaccatcaatggctggtactacctgttttgtgcggaaggcggcacccaatacgagcatcaggagtccgtggcccgttcgcgaaccttggatgagctttcgttcgaaagcatgccgagcaatccgttcatctccaacttcgatacccccggcacctacctgcaaaagcaggggcatggagcactcgtggatacgcccggcggcgaatggtattacgcttcactgtgcggcaggccctggcggcacgagaacgagccggctcatggcgtgcgcggctggtgcacgctcggccgagagacttcgattcagaaggtcgagtgggatggcgatggctggccgtatgtggtcggcggccatgggggagagcgttatgtcgaagccccggccgacgccatcgcaactgaggcccctacggatcatagccagcatgacgagttcgaatcgagcgaactcgacctcaactggaacaccctgcgtgtgccattcaccgagaccatgggccgcgtgggcggcggctcgctgaccttgcgtggtcaagggtcgctggcaaacctgtttgaactgtcgctggtaggacgccgttggcaggcgttcgatttcaacgccgaaaccaaggtgacgttcgagccgagcaactacatgcagatggccggcctgaccaacttctacaaccacctatgctggtcgtgggtgttcgtcacttgggacgagaagcgcaacaaacgtgtaattgaagtggctcagaacgacttcgacacgtacacgtcgttcctcaaagacacagccatcgccattcctgatgacatcgaatccgtatggttgcgaaccaaagtgcgtactcgtacctacacctacgagtattcgttcgatggcaagacatggcatgagattccggtgacgctggacgccgccgtgctctccgatgatcatgtggcccaacgttatggcggattctttaccggcgcgttcgtcgggttggtggccgtggacctttccggatacggcaaagaagccattttcagccatttcgattacatggaaatatgatgacgccaggcggctttcctgataatcagggaaagtcgcctgactattcggcactggggaatgaaaggcgacacttgtggcaagcgacaatgaacattgcggcgaccgtggccgcgaatgtaccataaccgtctccaacccggtgttgcgtggcatgtacccggacccgtcctggatatgggatacgacgcgcgaggaaatcgtgctggtcaactcctcgtttgaattggtgccggggttgcccattcatacgacccgtgatcttgtgacgtggacgcgcacggcgaatgcggtggatgagacgatgtctcatcggctgctcattgatggcgtcgaggattccggcggcctgtacgcgccgaccattcgccgtatcggcgggcgatatgtgatcgtatgcaccgtggcccgcgtggatgaggtgaaggcgctcgctgcgggatgctcgcagaaggatattgataactgccgtgacgcccaaggcaatttcgtcatcgaggccgatgagttgaccggaccatggcgcggcccgtactgggtggccggggccgaaggcattgatccggacatctttgaagacggcgatggcacagtgtggtggacgcaaacgcgcccggcattacacccgcagtgggatggtcaaaccgaaatctggacgcagcccatcgccccaggcacgtggacgttgcaagaccataaaaccgtgatttggcgcggctatggcatggatgcggtatgggctgaagggccgcatttgtaccgggtgggcgattacctctacctgatgaccgccgagggcggcaccagcttcgagcacagtgagatgataatgcgcacgcacgcaccgcgcggattcgcggcggcgctcgccggttttgagaagaaccttgccgcgcaagatatctggattgagccggcgcgtgacggtgaacgaagcgtggtgggtcacgataaccggctgtttgaggcttgcaaacgcaatccgatcctcacacaccgtcatttgggagcgggggagccggtccaatgcgttgggcacgccgatctgctgctgcatccgaccgtcggctggctgctcgcgtgtcttggcatacgcgagactccgggcgaggaacccggagaaacgttcagctactgtggccgggaaacgttcgtggcaccggtcgtatggcagcacaatccggtctcgtggaagctggacggtggggagccgaataagcgtatcgatatcgtcgatcccggttggccggtcgtggctccggggcttggccggcttcccgagaagttggtcgtggacgttgacgaggatggattgccatgtgcagtgaggggtgtggattctgcggggtgtgattgcgctgctggtaataatgccgcatgccctgctgagctcatccagctcgacgatacccgcctagtcggcgttcgaggccgtgacgattaccggttcctgcgtgtcgacgggcaggaatatgccgcgttcacccggcccgaatacacgatgatgatgcatcaggattccacccatgctgtcatggtcatggcggaagcggaatccggccaattgacggccgaaatcaccgataggggagataagcggtgcattgcgcttggagcgcttggggccaacgaatggttcggattgcgcttgcatggcaatcgtttggaattccttgccgggcagcctgcacctgacagcattgatgagggaacaatgcctgatattgcactaattgcgcacgcggacgttacttatgctcgtatcatggcagattgtgatgcgcgattcctcagtaccgaatgggccggcggattcgtgggttgcctgatcggcgtaaaacggcggtaatggtctcagcccgctctacaatattgtacaatcatattgtttaatcgttaaacaaatgcaagggggcaatcgatggcgcacgatctcgaacaactcaagcaagatcacccggatgtggcgaaactgttcgccgatgactggttgcagtaccgtaagtcggagattttgccggaacttacgcgcgaggcgcagtccacgtgcgaccgcatcaatcgcatctactttgaagacaccgccgaagctgagcgactgttccgcgaactcgtgcccgaggccggcgagggcgtggacttccgcccgccaatccggcttgattacgggctgggcctgaaaatcggagaccgtacgttcatcaacatggacctgctgattgtgggcggcggcccgatctccatcggctccgattgcctgatcggcccgcgcgtgagcatctatacgccaaaccacgccatcgcccgcaagcctcgactggaaggctggcagcacaacgccgacgtgaccatcggcaacaatgtgtggctgggcggcaatgtggtgatctgccccggcgtcaccatcggagacaactcgattatcggtgcgggcgcagtcgtcacccacgacattcccgccgattccatcgctgtgggcaatccgtgccatgtgattgccgaagtcccggatgactggactcctgaagagcgggccgctgccgagggtcggtaggtttgctgctctggccaactgtcacggcgaaaccgggatacaggagagaaaggaacaatgcaatgacgcaatatcatgtttccgcgcaggcgacgaagacgaacggcgccggcagcgcggccgacccgtttctgaccatcggccaagcggcggccatcgcccgagccggcgatgaggtggttgtgcatgccggcacctatcgggaatctgtcgacccccgattcggcggagagagcgccacgaaccgcatcgtctaccgcgcggccgcgggcgaaccgcgcccggtaatcaccggctccgaacgtatcgacacatggcagcccgaaggcgatggcgtgtggaaagccgtaatcccgaacgcattcttcaacggatacaacccgtacgtggaaaccgtattcggcgattggaccgtatacccggacccaaaggtcgaggtacgccacctgggcgatgtgtatctgaatggcaaatccttctacgaagtcgcctcgctggacaaggtgcgcaacccacagcgttgggataccggccgtgacgccgccaccgattccatcgtgccgctgattgatccggatgccaccgtgaacgtgtggtgctgtgcggtcgatgatgaggccacaaccatttgggccaatttccatgaagccgacccgaatgcggaacttaccgaaatcaacgtgcgcgagacctgtttctacccgagccgcccgttcgtcaattacattacggtctccggctttgaaatggcgcaggcggcctgcccttacacgccgccgactgccgatcaggtcgggctggtgggcccgcattggtcccgcgggtgggttatcgaaaacaatcgcattcatgacgcgaaatgttcggcgatctcgctgggcaaggagatttccaccggcgacaacgaatcgacgcgcacccatcgtaagtccgggtaccaataccaaaaagaggccgtctacaaggcgctgcatgccggctgggagaaaggcgtagtcggcgggcacgtggtgcgcggcaacgtaatctacgactgcggccagaatggtgtggttggtcatatgggctgcgccttctcgctgattgaaggcaaccacatataccgcatcggcgccaagcgcgagttcttcggctgggaagtggccgccattaaaatgcacgcagccgtcgacacggtggtgcgcggcaaccgggtgcatgattcggtgctgggtatgtggctcgactggcaggcgcagggcaccgtggtggattcgaacgtgttctaccgcaacacgcgagatgtgatgaccgaggtgacccacgggccgattacgtttatgaacaacgtgtttgcctccgagttcagtttcgacgattatgcgcaaggcgcggcgttcgtcaacaatctgttcgccggtcgcattcgtcacaccgccgtcttggaccgatccacgccataccatttcccgcacgtcaccgatgtggccggcgaggcattcgtctacggtggcgatgatcggtacgtcaacaacctgttcttggctgtggacgattccgccaaaccgttgtgtaccgcggatgccgccggtgcggccggtatggcggaagctggaaccgcgttctttgacggctatccgcgctcgcttgaggagtatgaacagctgattgaagaggctggccttggcgatgaggagttgtatcgcagcgtgaagcagccggtattgctggcttcgaacgcctatgtttcgggcgcgaaggccgcttccggcgaagccgaggccgtggtgagtggtgacggctcttcgttggcattgcgcgaaaccgatgatgagctatggatgaccgtttcgttgcccgaatcgattcggtcggcaactggaccggtgatctccactgctgatcttggccaaccgcgtattgtcgaggagtatttcgagaatcctgacggttcgccgattgttgtggaccgggatatcaccggtgctgcgcgcggcgcatgctcggctcgaggcccattggcggcgtatggcgatggggaagtgctcatctggtcgaagtgacgggatcgcggtttcgactgttgcctctgcctcggcctttgtgtggcactgagtggggctgggctgccagtatttggcaggccggccccttttcgatttgcattggtaacaaatatgatatatggttaaatcattaaactaaatactgtaagtccatgcatacctacgcaacgtcaatggagatactgctatgcgcgcacatcatgttctgctgctgtcgctctgcctgttggccgcagcctacgccgtactgctattcgtttcaccagccgctgcgccgattggcgtcacgctaaccgttgttggtctggtgctggtctcgacgcgctatgcgtggcgcgccaaattcctggctctattcaacgaagcatgatttgatgaatcttcttcctctcttctccttttaagcccggccgctcgccgggctttttcttttgaccgaggtcgaagtggggaagggtgtgctatgggcactttcgtgtcgggggtgccgtgttctcgacaacggcctaccgacttggggtgtatttcgacaatatgattcggcgatgtgcctcagcggatatgtgcggccaatgaaaaagcgggataccgatgtcgatatcccgctttcagcgaataggtaaggccagagcttacttcttcctggctttcttgacgcgcttgggggtgggagccattttcttgggttcgaagaacggccacttgtgcaaagcccaggcgtgcagtgcggggatcttggcaacggcgaagccgatgaccagaccgattaccatggcccaggtctccagatcatggcctgcgaccagcaagccgatgaacactatggcaacgatgaagctcaccatctgcgaggcctttgactgcttggcggtcaccaggtcggccttcatgggaacaagccccagaaacaggccgcaaggtatgcagatgacggccaatatcgcgctgagggttattgacaatgtggttgcatccatgatgttcctttagtgctgtgggttgtggttttctttggcgtctgcggtgtcggtgtctgcggtgtcggcaacgtcgtcgtgttcgttttcttcggcttgttcggcttcggcctcggcgtccgtgctgtcggtttcgtcgtcatcagccgcgtcatccttgccgggctggcgccaccacaggattagcgcgttggccgcgcagtagatggccgcgatgccaatgcataccagaaaaatgatgttcgaagtgctgatgatcgtgccgtcgttcatcgactctttgacagactgccatatccacatcacgcaggcgacggcagtcagggcgtacagcatcatacgggagcggtcgttcataggatcatctccagacttgttcaaacgacttgattatagccgtatttgtggattgcgtgggaaacgaaaaatgccgccatgtgtgcttcagcgaggagcgcggtataacagcggctcttcgcgatgctcgccatggtggcattcatcaggaatcgttattcagttgttatctcatggatttgctggcagcgtatcagccgcgggccttggcataagcctcgtacacggcttcggtgggctcgccggtctccacgccctcgatggtgagctgccaggtcggcggttcggcctcgccggacagcacccaggcggcctgacgggcggcgccgatggccacgtattcgtcggtggtcggacgggtcacgtccatgccgaggattgagggggccagcgtgcggatggccacggacttcgcgccgccaccaatgagcaggatgcggttgatctcggcgcccagcgagcgaatcagctcgaggcagtcgcgctgggaacacagcaggccttcgacgaatgcacgagccagattctccttggtggtgttgtgcagagtcaggccagtcagcgaggcggtagcgtccgggcggttcggcgtacgctcgccgtcgaagtacggcaccagggtgatgccgccggcacccggctcggccttgaaggccagttcggccagttcgtcgtagtccacgcctagggcggcgcgaccggcgtccagaatgcgcgaaccgttgattgtgcaggcgagcggcagatagtggccggtgcagtcggcaaagccggaaatggcgccggtcaggtcgtacaccgggttttcagcgatggccgcggccacgccggaggtgccgagcgatacggacacatcgcccacggccatgccgaggcccagcgaggccatggcattgtctccgccgccggggccgatgatgcagccgccttcaacgtccttgccggcaatggcggggtcggccttgacggcggctgcctcacgcgggcccagcacggtgggcagcacaatggcgtcggcgtgggccttggcggcttcctcgccctcggcgggggccagtaccatggcgatgagatcgcggcggtactcgtcatgcgcggcatcgtagtaaatggtgccggaagcgtcggaacggtcggtgaacagggcttcgagatgagcgtcctcgccctcggccaccgggccatagccggcgatacgccagctcagccaatcgtgtggcagacagacggcggcaatcttcttggcgttctcaggctcgttctcggccacccacgccaccttggtcagcgtgtaggaggcgacgggggaggagccgacggccttgacccagcgctgcttgccgcgggcggtcacgtcgtccggttcgtcgccctcggccggagctgcaccgagcttgtcgatcagggcggcggcctgcggggcggagctgatgtcattccagagcatcgcatcgcgaatcacgttgccctgcttgtcgagaatgaccatgccatgctgctggccgccaaccgcgagggccgcgacatcgtcgagcccgccggcctgctcggcggccttggtgaaggcctcccaccagaattccgggttgaccgaggtgccatccgggtgcttggcctgcccgaaccgaacctgttcgccggtggcggcgtccgtaatgcggacctttgttgattgggttgacgtatctacgccggcaaccagtactctcgtcatgcattcctcctcgatgagggtcgcgctcaaaagtttcggcgcgccatagccaataagttagacgattaaactatactgtatcaacgttcgattgcaaacggaaacacgcgaaggtgcggtacggttcaatcgtttgacgcacaatatcatggtgtggtagacggatgtgagcgcctgtgcggcgttcgagactaggggtgcgaggaggtaggggccaatggcaaatctacgcaggatcaatcaggaggatctgcgcaaccataacctgtcggtgacgctcgacaccttgttgcgtgcgcagaaaccgatgagtcgtgccgatctggccaaggagacgggcctgaccaaggccacgctctcgctgttggcctcgatgctcattgaaagcggcgtggtgcaggaaggcgagccggtcgtttccgccacatatgggcggcccagcacgccgctggagattcgcggcggatccatcgccggcatcggcctgcagatcaacaccgatggttacggttgcctggcgctcgatctgaacggcgacactctcggtcgggagtgggtgagtgaggatatgaccggcactgatccgtacgagatcttcgccaagctcgatgcgatggccttcccgttggaaagccggctcaaacgacgcggctgcaaggtggtgggagccgggcttgcgctgccgggcatcgtcaccgacgacatgtggctgttggtggcccgcaatctgggttgggaaaacgtcaatctcacccggttcaacgtggtgcgccggctggatgtggtggccggcaatgaggcgaagatggccgccatcgctcagattccggggtatgccaccgaacgtgcgtccttcctgaatgtggtggaccgcacggactcctttatttacctgtctaccgatatcggcatcggcggcgcggtggtgcgcgacggcgaagtggtgatgggctcgcacggattcgccggcgagatcggccatctgtccgtggcgatggatgggccgttgtgcagctgcgggcgtcacgggtgccttgaggcgtttgcgggccgtcgcgctttggtcgaggctgccggcattgccgaagatggggatgccaccagcagcgaggccatcgatatgttcctccagcgttggcgcgccggggattcggatgtggccaaagtggtcgatcaggccgccgatgcgctggtttccgccatcgcttccgccgtgaatctggtggatgtcgatacggtgctgttgggcggactgtggacgcacttcggcgacgagctggccaccgtgcttgaaggccggctgcgttcggaaattctgggatacccgaatgtgaagattcgcgtgtttgtgccgccggtggcgctgcatccctcgctatatggcgcggccgaaatgggcttgcgacggttcatcgagaacccgttggggtacatgggggagaagtagcgccgggagatgctgcttgttgctggcgggtgcatggtaggggtgcatggcgcgcgtgccggcgttagcgggctcgtgctacactttggcaagttggctgttttgtgcagcgaacgtggggccgtagctcagtcggttagagcatgcgactcataatcgcccggtccagggttcaagcccctgcggccccactcttttgcgtcgtctcctgcggcggcgtagcgcgtcttcacgtccagataggcgcgtacaatcccttaggttccggttcacgtcttgccataggggcatgacgacccgggtcccccgaatccataggagacgtaaaatgcagcagggtatccatcctgattaccaccccgttgaggtgacgtgctcgtgcggcaacaccttcgtgacccgcaccgctggcaaggaagatcacatgttcgttgacgtgtgctctcagtgccacccgttctacaccggcaagcagaagattcttgacaccggtggccgcgttgctcgcttcgagaagcgctacggcaagaagagcaagtagcatacttcacgccagtccgattcgatttggcatgctccggcatacccgatcgaggactggcgttttttgtattctttgacaagttttgttgcagcattgacctgcgcaatcgaataatcgaacagaacagcaccatacagaagaaagtgtgttatggcagacgaacagttcccggcggcggcaaccgcgcttgaggagtaccagtccatcgaagaacagatggcaagccccgaagtcgtgtccaacccggacaagctgcgcaagctgggtcgtcgtcacgccgaactgggtgccatcgtgggtgcctacaaagcctggttgcaggtgaaggacgatctggcagccgctcaggagatggccggcgaggacgccgacttcgccgaggaagccaagcgtcttgaagccgaactgcccggtgtcgaggagaagctgcgcaccgcgctgatcccgcgtgacccggatgatgcgcgcgacaccatcatggagatcaaggctggcaccggcggcgaagaagccgcactgttcgccggcgacctgctgcgcatgtacacccgttacgccgagaagcgtggctggagcgtgaacgtgcaatccgagaacaccaccgagctcggcggcgtcaaggacgtgcagatcgccatccgcgccaagggcacgcccgctcccgaagacggcgtgtgggcttcgatgaagtacgagggcggcgtacaccgtgtgcagcgcatccccgtcaccgaatcgcagggccgtatccagacttccgccgccggcgtcatcgtgttccccgaggccgacgaggatgacgacgagatcgagatcgatccgaaagacctgaaaatcgacatcttcatgagctccggccccggcggccagtccgtgaacaccacgtattccgccgtgcgcatgacccacctgcccaccggaatcacagtgaacatgcaggatgagaagtcgcagattcagaaccgtgccgccgcgttgcgcgtgctgaagtcccgcctgctggccatgaagcatgagcaggaggccgccgaggccgccgacatgcgtcactcgcaggtacgttcgcttgatcgctccgagcgaatccgcacatacaacttcccggaaaaccgtatcgtcgaccatcgcacgaattacaaggcttacaaccttgacgccgtgctcgacggcgacctgcaggccgtcatcgattccgacatccaagccgacgaagccgaccgtctggccaatcagaaatgactttgccggatggctcacctcagcctcgctttgcgagccagctcccctcagggaggggagctgtcagcgaagctgactgaggggagcctaatgtccgatcaacggagaccgccagtgcttattaccgacatcatcaaccaagcctcttcgcaattgcgcgaagcgggtattgagacgcctgagcatgatgccaagttgctccttgccgaggcggcaggcgttgaactgcgcgacgttgacagggctctgcttatgggggaggaacttggcacaaccggacagcttgccatcttccgtgccatgctcgaccgccgtgccaagcgcgagccgctgcaatacatcaccgggcatgctcctttccgctaccttgacctgaaggtcggtcccggagtgttcattcctcgtccggaaaccgaaaccgtggtgcaggccggccttgactggctgacaaaaaacggcatgatccatccttgtgtggtcgatttgtgcgccggctccggcgcgattgggctgtccgttgtcagcgaggtgcccggcagccaggtgtgggcggtggagctgtcgccgaacaccgccgaatggacgcgaaggaatctgtcggaaaccgcgaaaaagtacccatccattgcctcgaattaccatctggaaatcgcggatgccacgtccttcgccacattggcccaattggacggcaccgtcgatatcgtcatcaccaatcccccctacgtgccgcagaccgatattcccgagcagccggaagtgcgtgattgggatccggaattggctttgtatggcggctcgatggacggtacgttgattcccgagcgcattatcgagcgggcctgccgtcttctcaagcctgggggcgcgcttgtcatggaacatgacgtgacccagggggatcgtctcgtggcctttgccagggccaccggattcgctgccgcatcgaccggccaggactggacgggtcgcgaccgctacctgtttgcagtgtcctaagccgcacgcatcccacatttccttgggattgcattctcgtttccgtaattgcgctgtctcataataagaacaatttattgcgggttcaaagctggtctggttataacagtccgcgacaaacatcgaatgagagagacgtgaatgacggtcacaagccgtgtgatgtagttctgtggtatgcgaattatgtgagtggaacgtctcacgcgcacatcccgcgcgttggttgacagatgaacgatgttgaaatatcccaaggaagaaggaagaggatgaacgtgaagttctccactaagttcgttgcggccagcgcggccgctgttatggcgttgtccctcgcgggctgctccggcggcagcatggatgattcctccagctccagtgccaaggcctccggcgactccatcaccatcggcaccgtgaccaccaactccggtaccgccgccgcttacggcgaggccgaggtcaagggcttcgagctggcggtctccgagatcaacgccaagggcggcatcaacggcaagaaggtcaagctcgagtccatggacgacaagggcgacgccaccgaagcctccaacgcctacaacaagctcgccggcgacaacaacgtgctcgccgtggccggcccgaccatttccgccaccaccgcagccgtggccccgctggccgaccagtccaagctggtcaccatcgccccggccgccacttccgactccatcgaaaccggcaattacctgttccgcacctgcttcaaggactcctaccagggtgaggtggctgcacgcttcgccgccgagaacctgaaggtcaagaaggtggccgtgctctacggcaccggcgatccgtactcctccggcgtgggcgaggccttcgccaaggccgccgaaaagctcggcctcgaagtggtggacaaggaaagctcctcctccgccgacgacaccgagtactccgcccagctgcagaagatccaggcttccggcgccgagctgctctacgctccgtactactactccgtggctggcccgtacatcatcccgcaggcccgctccgtgggtttcgagggctacgtgatgggacccgacggatacgatggcctcaagctcaccggtgacaagtcccagtacaacaagacctactacaccacccactactctgccgacgacaacaccaacaccaaggtgcaggacttcatcaagtcctacaagtccaagaacaacgccgagccgaacacgttcgccgctctgggctacgacaccatctacatgatcaagcaggccatcgagaaggccggtaagaacgccacccgtgaggatgtgcgcaacgccgtggccagcatgaccttcgacggtgtgaccggcaagttcaccatggacaagtccggctcgccgaccaagtccgtgatcgtgctggaaatgaaggacggcaagccggtgtacaacaccaccgtgcagcccaagtgaattccatgaattcccaccgcataatcacgatgtcctagcgtgactttcgcatgaacaggagagcgaccggttttgccggtcctctccctttcgtgttttcacgggctcggatgcataaggacagccgtcgatatgcggatatcgccaggcgcgggcgtatcgcgccatcaatcgcaagacatacgaatatctctacgcgcgcagcggtagagaaccacaacattgatagaaagggggagctatgaccgatcagatcatcatgttcatcagccagctgttcaacggtctgaaaatcggcagcgtgtacgcgctggtggcattgggctacaccatggtctacggcatcatccgactgatcaacttcgcccacggcgatttcatcatggtcggagcctacgtgctcatgctcaccattccggccatcgtggccatgggactgcccgcctgggtggcggtcattcccgccatcctggtatgcgtggccgtcggcgtgatcgtcgaaaaggccgcctataagccggtgcgtgaaaagggcaactccatgaccgccctgatcaccgccatcgccatgtcgttgctgctggagaacggctcacaggccatcttcggcgccgacttccagaccgtcccgaccatcttccacctgccgtccatcgcgttcggcaagctcaagctgccgggagacaccctgctgaccatcgtcatcggcctggtcatcatggtgggcctgcagctgttcgtcaaattcaccaagcagggcaaggccatgcgcgccgtctccgaagacaaggaggccgccgtgctcatgggtatcaacgtgaactccaccatcgccctgacattcgccatcggctccggtctggccgcggtcgcctcgctgatgtactgcgccgcctacccgcaggtctcgcctatgatgggcgccatgctgggcctgaaggcgttcgtcgccgccgtgctcggcggcattggttccatcccgggcgccatgatcggtggtctggccatcggtctgatcgaaagcctgaccaaggcgtatatcggcaccatcacggcgggcatcatcacctcggcgttctccgacgccatcgtgttcgccatcctgatcatcgtgctgctcgtcaaaccgtccggcattatgggcaagaacgaaggggagaaggtctgatcagatgaagaagacaatgctttccaccaaacagtcctatcttgtgtgcttcatcggcatcctcgccgcgttcggcatcgtgatggcgctgtgcgaatccggcttggccgactcctacatcaagggcatcatgatgaccgcgtgcatcgccatcatcatgaccacctccctgaacctcaccatcggcgtgctcggccagctgacgctgggatgctgcggtttcgaggccatcggcgcctacgtggccgcactgacctccaaatacatggtcgccgccggcattgccatcgaccccaccgcccgcttcctgctcaccacgctgatcggcggcgtggtggcctgcgtgttcggcatcctgatcggcattcctgccctgcgactgcacggcgactacctggccatcatcacgctgggcttcggtgagatcatccgcgtgatcatccagaacctcaaggtagccggcggcatgggcctcgacaagggcgccgccggacaggcgctgatcggcatcgaacgcaccgccaacctgtacgtcgtgttctggatcatggtggtcaccgtggtcgtactcttcatgttcggccgctcccgttacggccgtgcggtcaaggccatccgcgacgacgagatcgccgccggcgcctccggactcaacaccacgtacctcaaggtgctcgtcttcgcgatctccgcgttcttcgcgggcatcgccggcggtatcttcgcccagtacatcggctcgctcaaccccaccatggccggttggctcaactccatcaactacgtgatcatggtggtgttcggcggcatgggttcgctcaccggctcgatcgtctccgccatcggcctgaccatcctgcccgagctgctgcgcgccttcgccgactaccgtatgctcgcctactcggtggtgctggtgctcgtcatgatcttccgcccgcagggcatcttcggatcctgggagttctcactgccgcgtctggtcaaccgcatgctgttccgcggcgccgccggcaagggcgcgaaacccgcggccagcgccaagcagcatgaccagtccgacgacaagaccgtgaaggaggcctcacgatgagcgacgcaacccagcccatcctcaaagccgaacatctcggcatcaccttcggtggtctgaaagccgtgtccaacttcaacatgaccatcaacaagggcgaactcattggcctgatcggccccaacggcgccggcaagaccacggtgttcaacctgctgaccggcgtgtacaagcccaccgaaggcgagttctggctggacggaacccggatgaacggcaagaagacctatcaggtcgtgcgtgccggcatcgcccgaaccttccagaacatccgcctgttcaagcagctcaccgtcgaggagaacgtgctcgtcgccttcgatgagtcgttcacctaccacatgggcagcgccatcttccgcaccccgggcttctggaagcaggagaacgagatgcacgagaaggccatcgacctgctgcgcatcttcaacctcgagggactggccaccacccaggcggccaacctgccgtacggccagcagcgcaagctcgagatcgcacgcgccctggccaccggcatgaaactgctgctgctcgacgagccggccgccggcatgaaccccaccgaaaccgaggatctgctgcactgcatcaacacgatccgcgaccgtttcggtatcgccatcctgctcatcgaacatgacatgagcctggtgatgagcgtatgccagcgcatccaggtgctggactatggccgcaccatcgcatccggcacgccggaggagatcgccaacaacccgcaggtcatctccgcctacttgggcagcgacaacaacgatgacgcggacggcgattccaccaccaaggcggaaccggagccaagcattgccaagacactgacggaaggagcgcgctgatgctggaaatcaaggatctatgcgtttcctatggcgcgatcgacgcggtcaagggcattagcctcaaggtgaacgacggcgagatcgtctccctgatcggagccaacggcgccggcaagaccaccaccctgcacaccatcaccggtctggtgcctgccaaatccggcagcattacctatgatggccacgatctgctcaaaacgcatgcgaacaagatcgtcacgctgggcatggcccatgtgccggaaggccgccacgtgttcacccgcatgagcgtgcaggagaacctagagatgggcgcgttcagtctcaaagaccagtccagtctgggtaaggatcttgagatggtgttcgactacttcccgcgtttgaaggaacgtcgccgccagctggccggcacgctttccggcggtgagcagcagatggtggccatgggccgcgccctgatgagccatccgaagaccatcctcatggatgagccgtcgatgggtctgtccccgctgctggtcaaggagatcttcgacatcatcgtcacgctgcgcaagcgtggcatcaccgtgctgctcgtggagcagaacgcgaagatggccctgtccatcgcggatcgcgcctacgtgctcgagaccggcaagatcaccatggagggcaaggcctccgacctgctgcacgacgagaaggtgcgcaaggcgtacctcggcgcgtgacgtctcacattactatgctcccgctggcgggagctacctcacgaagtgaggctgagggtggttatcggagatttccggcaaccaccctcagtcagctccgctgacagctcgccagcgggagcattcatatatcactgcgcgtaatactgtagcgcggaagcatccttatccgtaatctcgcgaatcggacgggccggattacccacggccacggtgtgcggcggaatatcgcgcgtcaccaccgagccggcaccgatcacgcaaccctcgccgatcgtcacgccgccgattaccgtcacattgccgccaaaccagcagttcgagccgatgacaatcggcttgccatactcgcagtcgtatgcggaaccatcaggtgcctgcctcacgttacgatcctgccaacgcaacggatgcatcggtggcagcagcgaaacgttcgggccgaacagcacgtcgtcgccaatcgtcaccgggcaacaatccagcacagtgaagttgaagttggcgaacacgcgctctccgatggtgatgttgcagccatagtcgaagaaaatcggccccatcacgtcaaggccggcaccgtggccgggcagcagctcatcgagaatcgcggcacgggcggcatgatcggtacgcgacgcggcgttgaagcgcgcgcacaggtcgccggccttctcgcgcagggcattcaattcagggtctaccgaattgtacagtttgccggcgagcatctcctcgcgctcgctggcgcgcggcatacgcagttcgacgggaggcatggtggtggattcagcattgatttcgctcattgaacactcctgtaatttcgcgaaagagcatggatggactcattgtatctacggtctgtgcgtgtggggcgaatcggaaaacggcagtacggcaaacgagcgatgatgaactatgcaagtcggggcgcaatggtgcaatggtagattgtgaatacacaagcgaacggaggtggcgtgagcgtggaaggcggaacaacgctgaaagtcacggatgaatcgctggcacaggcggcgcgtgtcatccgggatggtggattggtcgtcattccaacggatacggtatatggagtggcgtgcgatccgcgtaataaggccgctatcgaccgtatctaccggctcaagcgtcgcccgcgctataaggcgttgcaggtactgctcgcatccaccgaccagcttgatgagctcggtctcgacctgccgtccccgctgaatcgtttgtcggcggcgtttctgcctggcgcgttctcgccgattgccgtagcccggcccgactgcacgttggagactttggccgacaccgccgatggtcgccccggcacgcaaggcatccgcatccccaattcggcgctgtgcctcgcgattctcaaggcgactggcccgctggccgcgtccagcgccaaccgttccggcgacgaaagcgcgcagaccgtccaggaggcggttgacgcgttcggcagcgaagtcgacctgtatctggacggcggtcccacccaaggccatgtctccagcaccgtcgtcaaagccgatccgtacgcgcgcgacggcatcgagatcctgcgtgaaggcgtcatcgcccaaaacgtgattcgcaaggccctccacctcaacggcggtggactcggcgcatgagaatctacctactgattgccgccatcgccggtggcgtcacctggctggtgactccgctgattcgccacgtcgccatcgaaatcggtgcggttggcgaggtgcgtgcccgagacgtgcacaccattcccacgccgcgcatgggtggccttggcatgctgatcggttttgccgtggctaccgtattcgccagtcggctgccttttctctcgggattgttcaacggcaattaccagatgtgggtgattcttgccggcggcatcatgatcagtctgctgggcatggccgatgacctgtgggatctcgattggatgctgaaacttgccggtcagctgctgatttccgtattcgtggcttggggcggattgcagatcatctcactgcctttgggcggttcgctgattaccgcctcgccgagtctgtccatggcgatcaccgcattcctgattgtcgcctcgattaacgcggtcaatttcgttgatggcctcgatggcctggcggccggtatcgtggcgattggtggcatagcgttcgccgcctattcgtatatcatcgcccggtcttccccgagttatgcttcgttggccacgctgatcgacgtgatgatggtgggtatctgcgtgggcttcctgctgcataattggcatcccgccaaactgtttatgggtgattccggttcgatgctgcttggctatctcatcacctgcgcttcgattgtgatgaccggacgtcttgacccggcctcgattcatgccagcatctatctgccggtgttcatgccaattctgctgccgattctggtgttgttcctgcctgtgctcgacatgtgtctggcgattgtgcggcgtttggccaaaggccagtcgcccatgcatccggaccgtatgcacctgcaccatcgcatgctgaagatcgggcattcggtgcgtggcgccgtgctgatcctgtggggatgggccgcgctgatcgcattcggttcgctgacgattctgttcttcaaagcgcagcatgtggccgtgggcatgcccatcgccgtggtggtgctgaccatagccacgatgtacccctatctgcggcatcgtattcccgagatccaagccgagaacctgacgctcgaatccgcacgcaagaacgcgcagcatgctacggttaagtcgcagtctgcagtaggggagagccgggattcgattggctctcaggcagcggattcgatgactgattcgcctgcggattcgcgggactcgcaggcgggtgaggtgcaggacccggcagcggataagtgagcgctcacaagcgtgtgtcgtgaaggtcagcgcgtgttcatatagtgtttgtatggctacaaacctcgatgaattgaacgcccaatcggcgtatgctccccttcctccgattttcgccaagctcggccttgcttatgacgatgtgttgctgctgccgaacgagacggatgtcattccctccgaagtggacaccagcactcatctgactcgcaagatcgtgatgaaggccccggtcctctccgctgccatggataccgtgaccgagtccgagatggccatcgccatggctcgtaacggtggtatcggtgtgctgcaccgcaatctgtccatcgacgaccaggccgctcaggtcgatgtggtcaagcgttccgagtccggtatgatcaccgacccgctgaccgtcaaccccgaggtcactctggccgacctcgacaagctgtgcggcaagttccacatctccggtctgccggttgtggacaaggaaaacaagctcgtcggcatcatcaccaaccgtgatatgcgcttcatcgcctccgaggattacgacaccctgaaggttaaggatgtcatgaccaaggagaacctggtcactggcccgtccaacatttccaaggacgacgctcaccgtctgctcgcccagcacaaggttgagaagctgccgctcgttgacgaggaaggccacctgaccggcctgatcaccgtcaaggacttcgtcaagaccgagcagtacccggacgccaccaaggatgagcagggtcgtctgcgcgtggccgccggcgtcggcttcctcggcgacgcctggcagcgtgcctccgctctgatggaggctggcgtggacgtgctcgtggtcgacaccgccaacggtgaggctcgtctggcactcgacatgatttcccgcctgaagcacgactccgccttcgacggcgtgcagatcatcggcggcaacgtcggcacccgctccggtgctcaggccatgattgaggctggcgcggacgccgtcaaggtcggtattggccccggctccatctgcaccacccgtatcgttgccggtgtcggtgtcccgcagctcaccgccgtgtacgaggccgcccaggcctgccgtgccgctggcgtgccctgcatcgccgacggtggcatccactactccggtgacatcgccaaggccctcgtggccggcgcctcctccgtgatgctcggcggcacgctcgccggctgtgaggaagccccgggcgagaaggtgctcctgcacggcaagcagtacaagctgtaccgtggcatgggctccctcggcgccatggccccgcgcggcaagaagtcctactccaaggaccgctacttccaggccgacgtgacctccagcgataaggtcgtgccggaaggcgtggaaggcgaagtgccgtatcgcggcccgctgaacgccgtgctctaccagatgctcggtggcctgcaccagtccatgttctacatcggtgcccacaacatcgccgagatgccggagcgtggcaagttcatccgcatcaccgacgccggtctgcgcgaatcgcacccgcacgatatcgtgatgaccgccgaagccccgaactactccggcttccacaacaactgatctgactgccgaggtgctttgacatactgaggtgagcggaggagccttccgcttgttcggagggttcctcctttgcgttttcgcgtcgttgccgtattaccaagttgttgctgcagcaccgggcgcctcatcatacggtgaccacgacacgccgaggttcttaaaacaagtaattatatacctgcgtaattcatgatgccttagcgtgggcggcattcgatgccatgtaatcagttcaacgagggaggacaacgatgtcgaagctgattcgattcatcgacaacaggaaccagtccctgggggatgtgcttcgtcaggtcgcggccgacccggcatataaagatttgtccatcgtcaccggctattgggacatgattggtacctcgaggctgattgacctcatcaagaattaccgttccgtcaggattctgattggtgccgaacccttttccaggcgcaatctcggcctgacgaacctgtacaaggactttcccgatgcggacatctccgaggatctgcgcaagttgggggagcttcccgacgatgaggtggcccgctatcgtgaaacggcacgtatcctagcggttatgattcaggagggacgcctgcaggtgcgcatctgccgcaagccgttcatccatgcaaaggagtatgtgttcggttcctacgacactgcgggtgccatcggcatcatcggatcctctaacttcactggaaggggattgtccgacatcaccactggtggcaatgccgagctgaactatctggaggaccaggaaggcatcgtcatccatccggcccccactgaaggacagcaatacggccacctatcatggtttgacatgatgtggaacctgccggaggtccaggaatggacgggtgacttccaggagattttgagcagttctccggtaggcaacaaaacctatggcccatatgacgcatacatcaaggcattgatgcgcctgttccccgacgagatggacccatcgttggaggacgggagcgacgatgacgacgatggcgaggacgtgttgtattcataccagaaacgcaatgcgggcatactcatcaacaagctcaacaggatgggtacggtgatactcgcggactccgtcggcctgggcaagacagtcaccgcaggtgctgtcatcaatcatttcaggaagaacggccggcggaacatcgccatcctgcctccggccaagctgaaggatcaatggaagtccgatctgcaggaatttttcggccttgacgaatccagctatagcttggtgtcgcagcaggatatccaggccatccgacggttgggggacgcctaccgcaggtcgtatcccgccgatctgatcgtcattgacgaggcacacaacctccgcaacaaacgttccgaacggttcaacgccattctgaagttagtcggggataatcccaaggccaaggtgttgctgctgacggccactcccatcaacaacgggttcagggatttggtcagcgagctggagcttggcttgggcggtcgcatgcattccggaattatggtgtcgtatcaggatcctggtggcgcatatgtgccatcccaggatttctttgagttccttgaggaactcgacggcaagaagaaggttgccgagagcaagggaaagtcatttgactgggaagcgtatcgtcagccactgtcccagggcatcagccggttcgtggtccgctcgacccgccagggagttcaggaagaggcggagctgatggcgaatgggaatggtccggtgatgcgctttccggacaacgtgttcgtcacaatcgattatgcgtttcccccgcgggccgtgcagaaggttgaatccaccatcgaccgtcatgccgccgtgttcgagggcatcgatccacttgccgtagatgatgacgagctgtccgccgagacgcaacggttgcgacaccctctggatatcatctcgcaggacgtggggagattccaaggattgagggagccatcgtcactggtgcgggatgtgttctccctggtatcgctgctgggattccctatgtaccgagctgagctgtattcttggcagtacaggaacatgggcgtgaaagaaatcggattgctggaccttccctccgatgatctcatgcggttgcgctccgccatgacgatccacaacatcctgcagaccctctggctgaagcgtctcgaatcctcgctgcaggcgctacggctgtccgtggaacgctaccggtaccgtctgaacaggttcgccgaatgcttggggaagggatacgttatcgagtcgtccgcgttgtcgttgctggaaaatgacgaggaggaacagtcgcggttgtcgttctgggacgaaccggtgaaggatttcgaggaggagctcaagggtcggggcatatcttatgccaaggcggacgaggacgcctttgatatgcgtggcctacttcgtgacgtggagcgtgaccaacgcatcacggatgttatcctcgatgtgttgaaatcatgcatcgagggagagctggatgccaagcttgatgcctttgctgaggagttcgccaaggcccttcatgatggacgattcggtgggaaggtactggtcttcagcgcttacgccgacaccatcgattatctgcggatggctttgccggtgcgactgaaagacatcgttcccgatttcgacagaaaggcggccttcctgaccgcatcctcctccgacctgaacaatatcgtgggacgcttctctccggtgtccaagaagcgtgtgctttccggacccgaggaggaattggactacctgttctcgacggatgtgctgtcggaggggcagaacctgcaggacgcggccatcctcatcaactatgacctccattggaatccagttcgcatggtgcagcgcaacggacgcatcaaccggctgggctcccggttcgaccaagtgctcatcggcaacatggctcccgccaaggatttggactattacttggggctcatcgatcgcttgcagggcaagatcgacaccatcaagaactcgatcggcaccgaccaaggcgtgctgactgtcgaggacgagaaccccattgaatacatccaggacctgtacagcggtgacgatgccagaattcaggaggtgatggataccgtcgaggcggacaacgacatgctgtcgtggaggaacacccatgtgtatgcgctgcgggagttcctgcagcatgcgacgcagaaagacctcgaccgcatcaacgcgatgccaaggggcaagtggaactatctgccatccgattcgcaactgaagaaatcggtggtgatgatgtgtgagcaggccggtggcataggcaacgggatgaactaccggttcatccgtgtggagaccagggcacggctcttggccgaaccgattacgagcgaggaagccttgggtctgctgagaaccaaccccgaggacaatgcgagaaaaccggacaatgctcagctggaccggtccgtcatggagaagttggcaatctccatggctgggatgcgtgcggcctccaaggcctcggggaagttcacgccaagaaaaaacgagatggaaccgctggcgttgctgcagaagcagttgggtgtcaaacagctgcggaaagcactggcccccgtgcaaagcctggtacaggccaagcagcggtacgatgcactgatgagccggctgcggaaggaagcccagatgtccggaggatttgcctcgctggaaatcagtgaacagctgctgtccgattggagttccttccttagggacatcgaccaggatggcgacaaagatggcggcaaatggcgccccgtcatggccggcatgtctgtcgatctatgatggcgtggccacggggagcgcgtcggtatacaatccttaaagctttgggcgcatagtcggaaggaatggcatgattacgttcactggtctgcagcaggcccttgacgagtatggcgagcgcacgtccaccgacacggaggacgttgaccgcaagattgcggccatgcgcgtggcgatgcaggtgctcgccatccttcgtggcatcggagccgatgacatcgacgccgaaatcgaggaggctttgctccgtccggtgcccgtggacaggcacggggaatggttcgtcacccatccacagatgctgcgcacagctttcgtctgtgatctggccgatgagaacgagctgttccaagctacgttcagcgcgttgaggggaaccgccacgaaggcacgcatcagcgcatgcgtggcgatgtcccctcgttgggaggacggtgagctctttgaggacgagccggtcggggtgagtttttttgccccagccaatgttccctccattgtcatggtggtgtccagagcgggcaacttgcgtaccatggagctgcgcggtgaattgtcgaacacgcagaagcgcatcctggacaagctgcatggggtactggccggaggcgagccggatgggtccgtcgaggaatcggacaaggcgcgtgcgcatgcggcgatgtgggatgcgctcaacgtcgccgaggtcaaccagcgcttctatgctggtatcgccgcacggttcaacgaattggtcaaggcgcttgttgccgccggacatgacgagggtgacgcgaagatgttcgccagccgtttgatcggacgcattctcttcgtctggttcctcaaccagaaggaattcattaatccagatgagcattatttggagattggggacctggactctacggagtattacgaacaaaagttgaagcgtctgttcttcgcaactttgaatacggcgaagaatcgtcgcggagaagacggagataagcttacgccattcctgaatggtggtctgttcgaagagcaatgtactgatttcccggatgagtcgattccatttccggaggggttctttgccggtctgtatacacattttggccaatatgattttactaccgacgagtccactccggattacgagcaagtggccatcgacccggagatgctagggcgtatcttcgagtcgctgcttgctgagcaaatggatgacaccggcaagacggcccgtaatgccagaggcgcgttctacactccgcgtgagattgtgacatacatgtgccgtgaagccttgcgccaatacctgtatcgtacacttggcagcggcaatggtatccatcaaggtattgataagttgctggatactcccgatggcaagtgggaaagtgacagcgatccccgcaggtctttgtggaactcgaataccgccacgatgttgccacaggccatcgcggcacttgagagggtccgagtgttggacccggcctgcggttcaggcgcattccccatgggaatgctgcagttgttgatgaggtgccgtgtccggctgatggggaaggcggctactgttgacgcctatcagcagaagttggagattttgcagaacaacgtgttcggtgccgatattgagccgatggcggtggagattgcccgtttgcgtgtttggttgtccatgattgtggaacgagaatcgattggacaagtcgagccgctgccgaatttggactttaagtttgtctgtgctgattccttggtgccattggccaacgaggatgtatctggtactgatcaggtcagaggcatgacgattgctgacgtgtcgttgaagaaagggattctggatcagggggccttcgatttagccgacgagagtgaattacttgaacagctgaagaagattcgttcacgctactttgccgccaccgattctgagcgtaagagcgagctaatgcatcagtttgaagagatttcaaaccagttgggcggcggtgtatcctcttcaagaggtcggcaaattgccgattttcatcctcattcgtccactatatccgagaccggtcatgcaccgttctttgacccagattttatgttcggcaccgatgcattcgatgtgattataggcaacccgccatatgtgcagttgcagaagatgaagaaccaacgtgttgcatacgaatcattgggataccaatcatacaacaaaaccggtgacttatacgagttgttctatgagcgcggattggaactgttgtccaagtatggagtactgaattacattacatcgaacaagtggatgcgtaaccggtacggcaaggagctgcgcgagtacctatcccggaatgcggaggtgatttcgctcatcgatttgggcgcaggtcgcttcagcagcgccaccgttgatacgaacatcgtgttactcgccaagggtcgctcggacaaggtgtttcaggccgtgaagtatgcggacgactcgttggcggacattgcggcatatgtcgcggagcgtgcaacaacgataccgttcaagtttgttgatggtaacactgcgtcagatgttggcaagaaggtgccggacggtggaccatgggtcattctcactgacatagagcgtgatatcaaggccaaaatggaagaggttggcactccgcttaagcagcttgatgtacgtatttaccgtggtgttctaaccggcctcaacgatgccttcatcatcgataaagcaaaacgtgatgagttaattgccgctgaccccaagagcgccgagatcatccgtcccgtgctacgcggtcgcgacattaaacgctatcactatgaattcgcggatcagtacatgattgcaacccacaatggttacaagtatgatgacactgtttttccccgcgtggatgtagaaaaatatccggctgtcaaggaatggctgagttcgttcgagcctaagctctccgaacgtgccgatcaaggagacaccccatataatctacgtaagtgcgcctatatgggcgatttttcgcaaccgaagatagtgtggggtaacttatgcctgcgagcccaaaactgttagaattacaggaccaacaagggtgttgcacttctaaatagacatcggggatggactcctgtaactcgaaatagttgataatgaaggaaaggtaaacatattcgagcaaacccattccatatcacgccttggacttggcggtttcgatccacttgttgaacagggcttcagccttgccggagtcgacagcatcctcggccagcttgtaggcctcggcgaagcgctcggccagtgtgccgttgccgaccagattgccgtcagccacgatggcggaggcagcgttgagcagcgcggtggtgcgggacgtaatgtccttgccggccaggaagtccttaaatgcgttggcgttgacgtccggcacgccgcccttgagctggtcgacggtaatcttggcgagacccagatccacggtcgggtcgaactcggtttcggtgaccttgccgtcgcgaatctcccagacggaaaccgggccggtgggggcgagctcatccatgtcctcatgcgaagtgtagaccaagccggactgaccacggctggcgtagacggcagccatgatcgggctcaccttgcggttggcgcagccgatggccacgtgtgccgggttggcggggttggtcaacggtcccaggatgttgaagacgcacggaatgccgagcgcggcacgaatcgggcccacgaagcgcatggccgggtggaaggtgcgggcgaacgcgaaggtgatgcccacctcgtcgcccacttcgccgacggcctccggcttcaaatccagcggcaggccgaggtcttcgagcacatcggcggcaccgcacttcgaggatgcagcgcggttgccgtgcttgacgatcttcacgccggctgcagcggcggccacggagcccatggtggacaggttcacggtggcgaagccgtcaccaccggtgcccacgatgtcggtggtcccaccggaaacgttcagcggcacggcgtgggagaccatggccttggcggcaccacgcacctcgtcggcggtcagtcccagctgctgctgcatagcgagcgcggcacccacagcggccggattggcgttaccttgcatcaggtcgtccacgaaccactccgattcctcagcagtaaggtggtctcccccgaccagcttggtgagaatcgacttccatgtgatctcggccatgatgccctccttggcgtttcctacgccgtgtgatgtatgttcgccgctcattgtaatggttcgtcatttcaaggccctgaatcttccatattgcaaaatatggcgctattgctgttttcgtggatgtcggttcgtcgtcgagccgttggtttcgtaagcgtgaggggcgttcccgcgtattctgttttccgaccaaagaaatgaatcacgaagaacgcctgggcaaaagcccattcaccggattgccgaacgtcaaaggcacggttgcagaggatgcgcggatcacggattcgccgccgcgttccgaacccgtgctcgagatccgggtgcgtccacgtgcgggtatgctccgatgctcccgatgcggaaggaggtgccgcgggcatgaccagggcggcggcgtgcggcgtcgtggtcgcttccgtgccgtgggccgagccgggcagccggtccacacgcgatttcgaatcggaacgcgcgtggccgatgagcgtcgcgaaccagaagaccgtaagcggttttccgcacgtcgcgtggcgcgccgccggaagacgccgcccatagggtcgctgaacggttgaaagcgtcgatgccgtctccgttcggcggcctcacgtcgatcggcgtggacgagaccggctaccgcaaaggccacacgtgcatcaccgtggtcgtcgaccacgaacggcatcgggcgatatgggcgcacgacgggtacggcagggacgtgttcggcctgttcttccaaacgttgacgcccgaacagcgcgcctccatcagggtcgtcgccggggacggggcccggtggatcgactcatgcgtgcatgagtggtgcccgaacgccgaacgcgcgcccgacgggttccacatcgtcagttggacgagcggcgcgcccgacaacccacgaaaacagcagaagcctcttttttgtgctatcccgtaaaactgcgggacggcagctcattttcgccgtttgagccgtgccgtcccacatcaccctttgcggaccgtgacaccataacaccgagaatggcggaatttcaacgattccgtaattcgtactgcgggacgccacgctagtcaatcgattgacactcgtgccgtcccgcgcgtacggcaccgcacgaatacatgctgatgaaccgcatagaaaatggctccccgtgtggggagccatgagctagttactaactagcgatgcgtcacttctcgttctggccgtggcacatcttgtacttgcggccggaaccgcacgggcacggggcgttcttgccagtgccagggaaggtgcggccgtcggcccacggcgtcttgagctcttcgctcttcggacgcttggaaaccgggaccttgccttcggcgtggctgatcggagccggtccggcaacaggcagcgtggactcgccggccccggaggcggctgcggattcggcgatcgcctgcttggcgtccgtatcctcgtcctcttcctcgacttcgccctcggcggcctcgaccacggattcgccgttctcgtcggggccggaggccacggcgatggtgtcggcgctttcggcggtctcctcgacctcgtcaacggcctcgtcggtggtggcgacctgcttgatgtcgatgtggaacagcagctggacggtctcctccttaatggcctcgatcatggagttgtacatctggtagccttcgcgctggtattcgaccagcgggtcgcgctggcccatgccacgcaggccgatgccgtccttgaggtaatccatctcgtaaaggtgctcgcgccacttgcggtcgagcacggcgagcaccacgcggcgttcgagatcacgcaagccggtctcgccgatggtctcctccatttcgccgtactgctgcctggcgtcctcgacgatcaggtcgcgcacggcctcgacggccttcgcacccttgaggccgccgacgatcttcctgacctcgtcttcgtcgaccttggtggggatcacggtgttgagcgccttgaacaggccctcccaatcccagtccttcggtttctcggatcccttgttggcacccttgatgtaggactcgacggtgtcggaaatgaaacgcaggatgtccttgtggatgtcttcgcccttgagcacggcctgacgctcggagtagatgacggtacgctgcttgttcatcacgtcgtcgtacttcagcacgttcttacgaatctcgtagttgcgggattcgacggccttctgtgcggtgcgcacgcccttggtcacggacttggcctcgatcggctggccttcctccatgcccttggccatgacctgggccaccagctgggtgttgaacagacgcatcagatcgtcttccagcgacaggtagaagcgggactcgcctggatcgccctgacggccggaacgaccgcgcagctggttgtcgattcgacgggactcgtggcgctcggtgccgagcacgtacaggccgcccagctccttgacctcctcatgctcgtccttgacctgggccttgatctcgttcagggtgcccggccaacgcttctcatactcttccggggtgtcctccggagagtagccctcggacttcagcttggcgtcggcaaggaactcgacgttaccgccgagcatgatgtcggtaccacggccggccatgttggtggccacggtgacggctcccttgcggccggcgacggcgaccacggcggcttccttctcatgctgcttggcgttcaggacctggtgagggatcttggccacgtcgagcagggtggagaccacttcggagctttccacggaagcggtaccgagcagcaccggctggcccttggcgtgacgcttggccacgtccttgacgatggcggccagcttctccttcttggtgcggtagatgaggtcgtcctggtccttgcggatcatcggcttgttggtcttgatcggcagcacgcccagcttgtaggtgttcatgaactcggcggcctcggtttcggccgtaccggtcatgcccgcgagcttgtcgtacatacggaagtagttctgcagggtgatggtggcgaaggtctggttctcggccttgacctccacgccttccttggcctcgatggcctggtgcagaccctcgttgtagcggcggcccggcaggatacggccggtgtgctcgtcgacgatgagcacctcgccctgggtgacgacgtagtccttgtcacgcaggaacagttccttggccttgatggcgttgttgaggtagccgatcagggcggtgttggccggctcatacaggttgtcgatgccgaggaagtcctcgaccttggtgatgcccgggtccaggatgccgacgaccttcttcttctcgtcgacgtcgtagtcctcgtcgcgggtgagcttcagcaccagcttggcgaactgacggtaccagcgggtcacgtcgccttcggccgggccggagatgataagcggggtacgggcctcatcgatgaggatggaatcgacctcatcgacgatggcgtagtggtgaccgcgctgcacgaggtcggccttctcccatgccatgttgtcacgcaggtagtcgaagccgaactcgttgttggtgccgtaggtgatgtcagcgttgtactgcttgcggcgctccggcggcttctgctcggtgatgatgcagccgacgttcatgccgaggaaacggtagatacggcccatcagctcgctctggtagctggcgaggtagtcgttgacggtgaccacgtgcacgcccttgccttcgagagcgttcagataggtgggcagggtggcgaccagggtcttgccttcaccggtcttcatttcggcgatgttgccccagtgcagggcagcaccgcccatgagctgcacgtcgaagtgacgctggccaagggtgcgcttggagacctcgcgcacggtggcgaacgcctcgggcatgatctcgtccaggctcttgccgttttcgatttcctgcttgaacttcggggtttgggccttcagatcctcgtcagagagggcggagatctcgtcctcaagagcgttcacggccttggccacgttctccagcttcttgagctggtggccttcacccattcgcagggctttgtcaataatatcgaccactgggttctcccttgactgataagtggtggtgtccgcgtatcaggatagcgcctcacaccgtcagcagtcgaatttttcgacctttttacgaaaaaatggaccgcctccatattggaagcggtccatgcggtatcagctgatcgtgtcagcaggccttaccttcaggctttcttgacattctccggagtgtcgatttcgaacacgccgtagctccaaccgtgacggtggtagacgacggacgggcgtccggtctccttgttcacgaacaggaagaagtcgtgtccgatcagttccatctcgtacagcgcctcgtcgatgctcataggctcggcgatgtgcagcttgcgacggatgacaatcggcgtatccccaacctggacctccacggattcgccagggccaagatcggaggcgaccgcagcctgcgggctgttgttcggctcttcctccgacacctccggctcgggctccggggcgataacacccagatccaccgggaccgggttcgcgtaaccacgacggtgatccttgcgacggtcacgagtacgacgcagacgcagcgtcaacttatccagcgccatgtccagcgcgctgaattcatcggtgctggaagcctccgcacgcaccacggtacgtccggcgataacggtgatttccacgcgcttggcggtatcggcctgacgcgggttgccctcatgggtcagcacgatctgcgcgcgctgagcatccggggcgatagcggtcacacgattcatcttggtctcgaccacatcacggaacctttgcttgacctgcgtgtggcgtccggtaacgacgatttccatgttgacctcctctaactcaagcggtgtaacccgctatatgtgttccgaacggcatcatcaccgaccgggtatgtttcattgtagacgaacaatgggtgaacggccggaaactcgcccagagaatatatgtttattcccgggcttttctctgcaatgaaacgatgtatatactggggctttggcagcagtctcctataagaagatttgataccggtttatcaggctggctcgtttgttcgtcatggtaaatactgcaatggataggcagcgttttcttgctctttctcgcacataccaagctcttacagatttgattcgtctccatacgacacgccacaacacgcccgacacgccccatccgatattcggcgcgtcgttcacgaatcgcccaactatgcccaaccatggagaaaacaggataaccgggcaacggcatggcctcaccgcagggcgggatgccgccttttccgcaccttatgtataattgcaagcttgagacctcttgatggccgcggccgtgatcttcattgggatcggctgaggaacttccgggctccatagagcacgatggcggataacgtccgcccagggtgacctgagagatagcgcaacagagaacagaccgcccgtcctcgacgggtaagggtgaaacggcggtgtaagagaccaccgggcctctggtaacagtaggtcgcatggcaagcctcatcgggagcaaggccaagcagatggcggtaagggctgctcgcccgtgtcatcgggtaggctgctagagcctggcggtaacgtcaggtcgagatggatggccatccgtgccgtgcgttcgcgcacggcacgacagaacccggggtataagaggtctcatttttttcttggctacaccaacaattcggcggcgactcgacggagggtttcggggctgtggcctttgcggccgccggcggaccaaagccgacgctgacggacccgacgatcgaggccatgggttttgcgggctatttggcggcccaattcccatgcggcatcttcaaagatgccattttgctcagcttcgtcacacacctgttcagccagcttgcggtccacacctttgcgagcaagttccatgaccgtaccacgacggcccatcatgcgaccggcacaatagcgtacggccgattcggcataagcgctgtcgtcaatcagttgcacgcgaatcagccgttcgatgacctcgtccacgatcgcctcgccgtaccctttggcaagcaatcgttcgcgtaacgcaccggatgcacgcggggccgcgtccagcaaacgcaatgcagcctcgcggcaagcgtccaaatcattgggatcttcgacaacggcagcgtctctcccccgtcgagaaaaacgtcccgacggtttcgactgaacatgctgctcggcaatgggcatgtcttgcgacgcaacaggattgcgccgcaagaacgctccggcactaatcatgttcaggccttagctgtgccggccttggcacgggtcgttttggcagcaggcgccgctgcggccttgctgtccttggccacgtcagccgcagcagcctcgctgacggcggccgctgctgcggcttcgccatcttccgcgaactgatcggcggaaccgatcagaccgaactcggccttgaccttgttctcaatctcctcggtgatggccgggttgtccttaaggaactgacggaccttctctcgtccctgaccgagctgatcaccctcataggtgaaccacgaaccggacttcttgaccacgccaacctgctgggccatgtcgatcaccgagccctcacgggaaatgccttcaccgtagagcatgtcgaattcggcggacttgaaaggcggggccatcttgttcttgaccaccttgacgcgcgtgcggttgcccaccgcttcgtcgccgttcttcaaggtctggatgcggcggatgtcgagacgcacggaggcgtagaacttcagagctttaccaccggtggtggtttcagggttgccgaagaacacgccgatcttctcacgcagctggttgatgaagatggcggtggtgccggcctgagccaacgcgccggtcatcttgcgcagcgcctgactcatgagtcgggcctgcaaaccaacatggctgtctcccatttcgccttcgatttcggccttcggcaccaaagcggcgaccgagtcgatgacgatgacgtcaagcgcaccggagcgaatcagcatgtcagcgatttcgagggcctgctcgccgttatccggctgggagacgatgagtgagtcggtgtccacgccgagcttgcgggcgtaggccgggtcgagcgcgtgttcggcatcgatgtaggccgccacgccgcccttcttctgggcattggccaccacatgcaatgcgagcgtggtcttaccggatgattcggggccgtagatctccacgatgcggcccttgggtaggccgccgatgccgagcgccatatcgagagccaacgaaccggtgggaatcacctcgacgttctgctcgggctggtcgcccagtcgcattgcggaacctttgccaaaactcttctcgacctgcgccagcgcggtgtccagcgccgccttgcgcttgggatcgagctcgtgcttgtcctcggctgccgggtccttggccggcttggtctcaagtgccatgatcttctccttgtcgaagtcgtgtgcgaatcggatgcctccaccgtatgacggacatgccatgtgaggcaatccaaaccaaccattgtggttccagcttgcccgagcttggccacctggcctccttaaaccctactgcggtaaggattatggcagatggcaagcaccctgtgcacacgtatgcggcttcttgtcactgtggataactataaccacacacacgaacatttgttcgaatttggcgtgcaacacgccgaaatcgccaatttcacgattcagcgactccgtaatcccgcagtgtcagacggcgggcatgggcggcgcgttatgatcgtggccccaacgcttggagtccggaacctccatttggtcgcagagcacattccagaccacgcgtggctcctcccccgcgtccagcgcctcgaccacggtcatattcgccagtttgggcatccgttgatcacgcgacagcgaacgaccgtaggtccgaccgaacacctcttcaagtaattcccagaattcccgttcacgcatacacgccagtgtgccaccaaccgcaggacagcaaaaacccgcatcgccacaagcgatacgggttcacagctagacatagattacgggacgcggcttcacaccgccaaccgatcagccctcgaccgagtcgagataatcagccaccatgcgcagcatgcgcgaagtggagactccgagcgcatcggcgatggagctcagcagttcggagctggcttccttctgtccacgttcgacttcggaaaggtagcctagcgaaacgcctgccttctcggagacttcacgcaacgtgcggcgatcgcgcgtgcgcagctcgcgcagcacatgaccgatagcaccacgcagcgaaaactcgcgaggctcctcctcagccaccacgggctcggcggcggcagtcggcttgtacgacggcgaatcctcatcccacatacgttcacgaacggcttgacgctgatccttggccttcttggcggcctgtgccttgagcacctgctgctgggcgaacatcaccgcacggcgctgggccggagtcagttcacgcatacgggcgacacccggctgcacagccatcggcttcttggcggccacatccatctgttcgttcactcgggtcatcgtttccatcgccatcgccccttcccaggtcggttcagtgtttccactatgtacaacacgacaacccaacggttttattccttaaaacttgctgtgaatagactcaagttttgcagaacgtggaatacggtgaggcgacgaatctcttcgcgcatgccatcaagatggagttcgacggctttgagcacttcggcatggtccggggtgaggcttgcggggatgcgcaggcccacatacaccagtccggccggcttgtcaccgtccggaccggggccggccacgccggtggtggaaaggccgatgattcggtcgccgtattccggctggctgtataggcgagcggtaccgacggccatctgccgggcgacttcggggtgtacggcaccttctcgatccaatagggccttgtccacgtgcaggatcgaggccttggcattgatgtcgtaagtgacagcggagcccaacaacacgttggaagcgccgggaatacgcacgaacgcatcggcaagcaggccaccggtcagggattcagcgcaggcgattttcgtattgttcgcctcgcaaatcttgaggatgccggccgcgagactgtcgcacaattcccgcattggaatatccgtcacttccgcttcggggcgacgaacgtgttgtacaggtacacggcacccgagtagaggcacaggaccaatgccacgtagatgatggcgtaggtcaggaagtagtaagcggtcatccagaacggcgtggcttgtccgttacccagagaccagaacggcagcagcagcatggacagacccacgcactggaatacggtcttgagcttgccgggccatgcggcggcgatgactttgccgcccggacgctccatgacgaagaaacgcataacggtgataccaatttcgcgaatcaggaacaggatggttacccaccagccgagctcgccgaacgcggagcatacaatcattgcgccgcaagtgagcagcttgtccgcgatcggatccatgagcttgcccatttcggtgacctgattgtatttgcgggccatccaaccgtcgattttatcggtggacgcggcgatgatgaacagcaccgcggcgacccagcgcatggtcaggttgttctcaccccaggcaccggcgagaatgtcgagtgtcaggaaaaacaccacgagtacgatgcgcgagtaggtgaccaggttcggcggcgcgttccatccgtcgaacagcgatgatttgggcgatgactgcttgtccattgtgttctcatccatagtgttcacgttacccccacacttctaccttgagtgagtattggctggatattgactgccattattcgggaatcaggttgcgtgctgatggccgcgtggccgcgcttctctccctccgccccttcggggcacctccctcatcagaggaaggtcgatggcgaattattcgccgagttcgggctgttgcggggcggtggcttcgagcgagctggtttcgcctcggatgaaggcgagcacctgcggcaggtcctgcggctggacgagcacttcgcgggccttcgagccttcggacggcccgaccacgccacgcgattcgagcaggtccatgagtcggccggccttggcgaagccgaccctgagcttgcgctgcagcatcgaggtggagccgaattggctggtgaccacgagttcggcggcctgcagcagcacgtccatgtcgtcgccgatctcctcgtcgggctccatgctgtctttcttttcggcttccttggccatctgttcgatgtcttcgcggtatttcggcttgcgctgggtgcgcacgaactccacggccttgcgaatctcggattcggacacccacgagccctgcacacgaatcggcttggcggaacccatcggcaggaacaacgcatcgccctgaccaatcagggtctcggcaccgaccgtgtcaagaatgactcgcgaatcggtggcggatgaggtggcgaacgccagtcgggatggaatgttggccttgatcagaccggtgaccacgtccacggacggacgctgggtggcgagcaccagatgcacaccggcggctcgtgccagctgggtgatgcgctggatggagctttccacatcgttcttggccaccatcataaggtcggccatctcgtcgaccaccacgaggatgtacggatagggggccaccttgcgctgggagccggcgggcgcatgtaccttgccggcgcgcacggcctcgttgaagtccttgacgtggcggaatccgaagaattcgaggtcggagtagcgtgcatccatctctttgaccacccattcgagggcctgtgcggctttcttcggatcggtgatgatcggggtcagcaggtgcgggatgcctgcgtaggcggacagttccacgcgcttgggatccaccatgatcagacgcacctgttcgggcgtggcacgcatgatgatcgaagtgagcatcgagttgataaaactcgacttaccggaaccggtggcacctgccaccagcaggtgcggcatcttggtcaggtcggcggtcacgaagtggccttcgacgtccttgccgatgccggagagcatcgggttcgggtcgcccacggccttgtcggagcgcagtacgtcgcccaagtgcacgatttcgcgatcctcgttcgggatttcgatgccgatggcggacttgccgggaatcggtgaaaggatacgcacatccgaactggccaccgcgtaggcgatgttgcgctgcaggttggtgactttctccaccttgacgccggggccaagctcgacctcatattgggtgaccgaggggccacgcaggaagccgacgactttggcatccacgttgaactgttcgaaggtggaagtcagcgcccggatcacgcgatcgttggccggggtgcgcatcgcatggggctggcctttggtcagcaggttcaggtcgggcaactgatacggcctattggcgtcgtcgtctgtatcgttgccggcggtggcattcggctggccgcccgtattgggcacgccctggccgactccgctgccgtccgcatcggcacccgcgtaggctccggtcgcggctgccgcagccgcggcaccggcggctccggccgctcccatcgcaccggctgcccctgcgagcgcgacagtaccggcctgggcggcactgggtgcccacgggtcgtctaccgctcccccaccgggcatggcgacggtctggccactggtgatgacgcgggttcgggaagcgtcgccatcatctgcatcggcagcaggcacagggctggataggtgcggacggccgtcgtacgaagacgatgcaatggttcgcgcaccgataatctcgccggtcatcggatcgaccaccggggtttcggcggtggcaccatgctggctggcggcacggtcgaatggatcgtcggcagcatacttgtcaagagttttgtcgtcttcggtcttggatttgcggccgaacagtcgtgcgaacaggctgggccgtgcatcgccggcctgatcgtcgtcgttgccgtcatcgtcgccgtcatgcgagggaacaccgtcggcaaaggcgagagtggtatctcccacacggacctcgttggggaactggctggcgctcccatccgtctcctggcccatcggcacatacggtttgcgctggattttagcggcgattttgcgcgcatcctccggcaaatcggtgacgtgggtgccggtaatcatcagcaaggagaacaggccgacgaccacgaaaatgatgatggcgaacacgttggaaaggccccaggcgagcggtgagccgaggaagaagccgaacaggccgccggcggattgcagaatcgtgatgtcgaatccggtgtggtcggcggcgatcgccacgtcgatgatcgaacaaatcgaccacatgagcagcacccaaccggtgaccacacgcgggttattggaccctttaccggaattgcgcatgagtcggaaggccacggcggcgagcaacaccggcagcacgacgctcatcagaccaagcacaccggccgcgatggcgtgaagcagctggccgaatggaccgctgacgcggaaccattcggacgcgcagaacagtacggcgagcacgagcagcaggaagcacaaaccatcacgacggtaggctggatcgtattcgccgacgccggtgacggcgcgtacgccggagccgaacgcgcgcggaatcgcgagcaggatcttcttccacaacggctcaggttcgaggtcaagctcgggctggaccttggtttcgccatcatgggtagacccgttgtctttggatttacggggtttggtgctgttggaggatgctgttcgtgccatatcgggtctgattctactagtacgggggtgcatggttggtgacgacaccgtgacgatatggtcgattgacgaatcccgacagccgattcgccgcgttcgtctgagtcgattccccgctggggcgcgaatatgccttatcatgggttgcatgacacccgcagagcgtgcgagcgcagtcgcatttgcactcaagaactgcgcactggaagcgatgacgccgggcgaggcaacgatgcgcgccgcggctgcctacgaacgcggcttgaagcccgtgacccatctcatcgacgtggcggacgaacagaccgccatgcgtctgcgcgccgccgccgaccctgccggaaaggatcgtctggctgccggcagtctggatgatcatgccacggatcgggcggatgcggtgttcgcacgtaccgtgttgttggcggaacgtcgatggaatccgtctggcgacttggatgagctgaccgccattcataaggggctgttcgaaggcgtgtttgaggatgcgggcaagttgcgtacctcaaacaccacacgcgaggtgacgaacgaccgggctcgagccgcgaatcctgaggcgttcttcccggctgggctcattgagaccggcgcgcacaacatcgcgatggagttggcggacaagcgcaacctgcatgcgttggatcgcgacgtgttcgttcacgcgttcgcttctatttatgatgagctcggttatctgcatccgttccgtggcggcaatgcgatggtgctgcgtatattcggttcacgcttggcgcatgacgccggctgggatctcgactggggctcagtgacgcgcgaagagtatcgctccgccaagcactcggcatatcggggcgacacgtctgcactggagacgatgttcgacgcgatactacgcccggcgaatccgacgcgtgtgttcttgatcgccggctggaatcaggggcctgcacactgattgcgggtgattgcatcggcctttggctgattcctacgccgtgatatcgcccagatgatgctgggtgtattcgtcggctcgggcgtcgatcgggtcgtagtcgccggcgtcggcgtgcgcgataatggccatcgcgttgtcgaccagtttcgggttcagggcctgcagccagtggatgcgcgggtcacggccgaaccatcccatctgtttgcgggcgagtcgcttggttttctgtgcgatgtccgcgaaggcgtcgttcacatcccagatgccgtccagcaggtcgatgatctgctgatagccgagcgcacgtacggcggtggcacccagatgcgggcgcaaccgttcgacttcttcgatgaacccatcgtcatacatctgcttggtgcgcaaatcgatgcgatggtccaaatccgggcggtccaggtcgagtccgatctgcacggacggaatcacgtaccggtagcgtggcagactggccgaatacggtttgccggtaagctcgatgacctccagcgcacggatggtgcggcgtggattgcgtgggtccatgcgcgcggcggcctcggggtctttggcccgcaactcgtcgaacaaagcaccggcaccctcggttttctcgcgttcctcaagacgtgtgcgcacgtcgggatcggtgccggggaaggtgatgtcatcgatggccgctctggcgtacaagccggagccgccgacgagaatcggccggatgccacgtgattgcaggtcggcgatggtctcgcgcgcaagctgctggaatcgggccacgctcatcgtgtcttcggggtcgatgatgtcgatgagatggtgcggcacggccgcctgttcctcggcggtgggtttggcggtgccgatatccatgccacggtacatctggtaggcgtccgcgttcacgatttcggcccgctcccccgcttcggccagacgccgggcgatggcgatgcccaaccccgtcttgccggacgcggtgggaccgacgatggagacgactcgttgcgtcatatacgccccctcagtgccgcacggaataggtctggccggcggccacgtcggggtcggcaagcagattatggcggccggcgtgtgtgacggtggccgtgacgaaatcgccgatttcaggtaccggttcgccttcaggcacgccgatgtgcaccagcacgccggttttctcgcggccggtgacacggtgggtgtcggtgtccttcttgccgagtttgccggtgatcatcacttcgacgtcgcggccctcgaatgtggcgaggttctcttcggtgatctgctcctgcaacgccaccagacggtcgaaccggtcctgcaccacgtcgcgcggaatctgttccattgcggcggccggcgtgccggggcgtggcgagtagatgaacgtgaacgccgaggagaagcgcgcctggcgcaccacgtccatggtctgctggaagtcctcttcggtttcgccggggaagccgacgatgatgtcggtggagatctgcgcgtcgggcatggcggcgcggatgcggcccagtatgtcgaggaacttggcggagcggtaggagcggcgcatcgcgcgcaggatgcggtcggagccggactgcagcgggaagtgcagctggtgcatgatgttcggcgtttcggccatcgcggcgatgacgtcgtcggtgaaggcggccgggtgcggcgaggtgaagcgcacgcgttcgagaccgtcgatggtgccgcaggcgcgcaacagcttgctgaaagcgtatcgatcgccaataccataaccgaacgaattcacgttctggccgagaagcgtaacctccttggcaccatcggccacacattggcgaatctcatcaagaatgtcaccggggcggcggtccttttccttgcctcgcgtggtgggcacaatacagaacgtgcaggtgttattgcagcccacggaaatcgccacccacgagctgatgcgggaggcgcgggcggcgggaagctggctcgggaactgccgcaattgttcagtgacctggacctgcgccttgccggtcgcacgattctgatccaacagcttgggcagatcttcgatgttcttggtaccgaacaccgcggaaacccatggcgcagtatccgcgatcttcttgcggtcaagctgggccatgcagccgccaacggcgatctgcaggttcggccgaaccagtttgacgcgattgaatcggccaatggtgccatacatgcgttcggctgcgttctcgcgtaccgcacaggtattgagcaccagcaaatcgaggtcattgtcattgatctggtcctcggttgcaggcacgtagccattggcctccagcacgccggcgatgcgctcggaatcgtgcacgttcatctggcagccgagcgtatggatatggaacacgcccttgccgcgtttccccagcaaaccatcggttccatcggctgcaatcgaggcgcgctccgcctcggtcatcatgtcttcattcataacgaccgattctatcgacggggttcgtcatgctccggtcacgtatgccattggttgtcacgatgtcaaattatgggttcttggaaagattccccgcgaacgtccagattggctggaatccgccgagtatattggtggacgtgatacttgaccgacatagccgactcaaaacctccgatctgcaagcccgtctcaaagcgttggatcttccgggaggcaccttcactcccgaacaggtcgttgaattcgttgacctcatgcaggtgtatgaaggcgcgatgtacgagatcagcaccaaactggagattctcgacgacgagttccaggtgcggttcagccatgacccgatacatcatatggaacgccgtctgaagtcggtgagctcgatcatcggcaaactggagcgcaagggtctgccgatcggcgtcaattcgattaaggacaatctgttcgatgtggccggcatccgcgtgatctgtaattaccgcgacgacgtgtattccgtgtccaactatctgtcgtcgcagtccgatattcaggtgctgcgcgtcaaggattacatcaagaacccgaaacagaacgggtatcgttcattgcacgtaatctacgcggtgcccgtgttcctctcctcgggcgcgcattacacgccggtggaggtgcagttccgcaccatcgccatggattattgggcgtcgctggagcatgcgctgcgctacaagaccgatttgccggacaacaagctcgccgagcattcccagacgctgctcgactgcgcgcgctcattgcagaacatcgaggtacagatgcagaacatccaccgcgacatcaacggcgcgccgcaagtgggcgaagcgcctaagacctcggactgaggtgctatggaatcggcctgcggccgattcattcaccgttgcggccacttcggcagcctggccggcgcttgggccagtagggtgccgaggaagatgagggcgcagccgaggtagccgcgcggggtcatcacttcaccgagaagcaacgcaccgcctaccgccgagaagaacgattcgaggctcatcagcaggctggctcgcgtcggtggcacccattgctggccgaccacctgcaaggtgtacgcgatgcccaccgagccgatgccggcgtacagaatcggaatccaggaatgagcagcgccggcccagtcgaccgagccttcgatcagcgaacccgcccagctcagcacggcggtggtgcagaactggccgaatgaaagcttgatggcgtccacggtgccgcccaaagtatcgatcaccagaatatgcacggcgaacagcacggccgtgaacacgagcaggatatccgccaggccgatcgaaccgaaaccatcggtgatgcacagcagatagaagccggcgatggacagcgccacggccacgaacaccagcatgccgatgcgccggcgcaggaacacgaaggccagcaacggcaccatcacgatgtacatggcggtcagaaatcccgcacggccggccgatttgccgtacagaatgccatactgctgcagggtgctggcggtgaacagcacgatgccgcagatcacggaaatgaccaccgggttggcgagcaatcgcgccacggccgaatcgggcttgttcgcattcagcttggcaccggtgatggtaacgacgtcggatgcaccgttcgatgcggcatctgtggagacggccacggatgcctcggtcccaacgacatcggccccggctgtatcgcccttatccgcgctcccccggccacgcatccacagcagaatcggcaccaaagacagtgctcccagcgtgaagcgcgcggcgttgaagaacatcggcgacatcgaatccatgccctggacctgcgccacgaacgcaaaaccccagatcagcgcggtcaacaacaggctcagcatgcctacgagttcttgtcttttcacggggagccagcctaacgtgcgaatgtgacagacatgaaaaagcccggccacaatgtggtcgggctgtgacgtttgacgggcaggctacatgccgctcgccaatcggctgtcgaggctagtccctgttgccgagcagctgcaggatgtacaggaacatgttcacgaagtcgaggtacaggttcagggcgcacaggatggagatcttcttgaccatttccgggccctgggcctcgtattcggtcagcagcgcgcgcgtggactgcgcgtcgtagatggtcatgccggcgaacaggatcaggccgatggcgcagacgatcttggtcatgccgtcgacctgcacgaaggcgagcacgatctgcgagatgatgagcacaatcaggccgatcatcaggatcgggccggccttgagcatgttgaacttggtagtcatgccgaacatggtcagcgcaaagaagaacgcggcggtgacaccgagtgccacgccgatcgagccgaggtcgtagaccatgaagatcgagctcaaggtgaagcccatcaatgcggcgtacacatagaacatgacgcgcgcggtggccgacttcatcttggtgacgcgcatgccgagcaccacggccagggcaatctgcaccacgcacaggccgatgaggcccaccatgccggtggccatgaggaagctgtagtaggctccagtgatctggccgagcacggcgaccacggcggtgacgaggatgccgatggtcatctcgccgtacaccttggtcactgagactcggcgggcttcctcatagttgtaggtcatcgtcgtgttgatggtggccgcacccgcaccggcaccagtaccctgcggcacgtattggtaggtgggagcgccctgcggctgggcatagtagttctggccgtaaccggactgtgcgtattgctggccatatccagactgttgggcggcgttgtaatcaggcgtgttgtattgcgggttgtattgcccgttgttctggggctgctgaccgaatgtcataatcgctcctttagcgtttgttccagtaccaatcttagaggaacaaagctgaacattccatgaatatgatcgatcggctcgttctgctcatctcaaagcgtaacgggcgtttccaccatgcgcgtggcatgcacttgagattcgattgacattcgatcgcagcttggaccgccgcgcgattcactgcaacgtgaaggtatgcgtcaccttggtgtcttgatccgttgataggaacgcagtgacatccaccgtaatcggcgaatcgtcttgcagcacatagcccagcgtcaccgttgccgcggtcccgggctgtgcttgggccaaatacgaattcgcgtcatagccttcaggctgatcgaagtatactgccgtctccagttcggtgccgttctggaacacgttcgggtgagccaaagtggcgaacgagttgttcttggacgtgttgttcgtccattcataagtcaccagagcggtgggcttgccgttatagtcgttgacgcttttcacggcggagactattttcacgtgggcaccttcgatatcaccttccaaatcctgctcgccctgcgctttctgctcggatgccttgctcttggaggcatcagacgatttgcccgcggactttgatgatgaggattgtgacgtgtcgatgcccttggactccttaatggaatcgtcaatggccttgctggcagcggactgcatggccagcgtgatcacaatggccaacaccgacagcaccgccgccacaatggacagcaccttgccgcgtttcttgccccggaaggtgcccactatggcgataatcgccagtatgacgccgatgaagccaaggattgcggcgatattgttgacgatgggaataaaactcagcaccaaacccaacgcgccaaacaccacggccgcgatgccgcagatggtggtatgcagatgttgcggttgcggcggctgaggctgaggctgttgtggctggtactgctgtggggatgagggaaccggctgcggggcgatgttgtggttggacatgatgtgctccttctcgtatcttccccgaaatagggatgtgagcacgacgctaccggccgcgaaacagcgacgttagtggacgaacggtcattgttcgttgcctgttcgggcaatacggaggtgataacggtgcccgcatgtccagtggcgggggccggatgcaggtcatacagtggaaagcatgacgaacccacaacgcgccgccgggccataccccggtttccgacccggctcacggcctgacgctcgccctatgcccggcacggggtccccggttcctacaccggatacggacgaggtgcccgtgactacgcgcgtatggtgttcggtcgttatggtgccattggccagtttcatgtgcatggcgcaaacctcgttcttcgcccagaattttgcgcaggattccgcaggatacacgctgatggtcctctgcaccttgctggcattcccggcagggttcctgctcttggcccgcagcgaatacccggaggcgacgttctggatcgcctgcgcgctggtggtcgtgttcccgtatgactcgctcatcgcactgatggcgatgacctcattgctcgcccgtcgttcaaaccggaacacgaccatccgcgccacggttggcggcaccatcgtgacgctcatctcccagctccgcgacgccctgcaacagcccaaagcctcgatttggcatctgattttcgctcaaccgcataccggcggcgattcaggctccccgatggtgatgctggtggaggagccgaccgtcatcatcaccgccacggtggcctcactggtgttcgtgaccatcgctacgctcatcggcctgcatatccgttcgcgcgcccgcctgcgcacggcgaatgcggtggccagcgcggccaccacgcatgccgcgaccctgcagaccgacctgaccaaccagcagctcgccgacgccatcgcagccgaagcgcacgacaccctcgcgcattccctgtccctgatggccctgaacgccagcgcgctcaaggcggaggcggccaagctcggcgactcccccgaagcgcaatcgttggcggataaggccgaggacatccgtcggtagtcggccggggcattggacgaggcccactcgatcatcgacatgctgcgcaacccgcaccaggcatgggagcagctcgccccgtccgacgacacgtcgctgacccgcgaatcgctggatgcgctgattgcggacacgcgcaactcgggcacgtcgctcaacacctggatcgatatccagcagctgagcgtgatggatgagtcaatcggcaaggtggcctaccgcgcgatccaggagggattgacgaacgcgcggcggcacgcgcccggagcgccggtgtcgttggaggtctccgccacgccgcaggcgggcgtacatatccatatcagcaatccgatcgccacggatgcgaccgagacgcagcgggcccatggggccggactgcctggtttggcagcgcgcgtgcactcggtcaacgggcaatgccggtatgggatggacgatcggcacctgttccatgtcgacgtgcaactgccttggcgcagctaagatggctagcgtgagtgagaagaacgggaatagtgtgtctggtggaaagcccgaacgcggcggtctgaccggaagcggcaccggcttagagcccaagccgatccgggtcagcgtcatcgatgacgatccgatgatctgccaggcgatgagcctgatcctcaacgattattcccacgggcgcatcgaagtcgtctccacgtccaccgatggcgagacctgcgtgaggcgggctgccgaggaaaagccggatgtggtgctgatggacatcgccatgcccggcgtggacggcatcgaggcgacccgtctgctgcgctcgctctcccccgcgccgcacgtgctgatcctgacctcgttgagtccgtccggcaccgtggaacgcgcggtggaggcgggcgccgaggggttcgtgtcgaaaaccgatgcggcggacgatatcatccgccgcatcatcggggtatgcgagggcgcgccgcagttcaacacggccagtcagaaacagctgatcgacgatctgagcgtcacgcggccgcgttcgcgccgcgatgaggcgcgcgccctgctcgacgcgctgcccgaccgcgagcgcgaggccgtgatgctggcggccgagggctatacgaacgccgaaatcgcctcccgcatgttcatttcggagcgtacggcgaaggcgcatctttcttccgcggcgaacaagctcgacatgggccgcgtgcagatggcgcggctggtggagcgggccgatctgccggcgcggctgtaagtcgtccggttgttgagccgtatcagtcataatgggaatatgagtgaagcgattattcgaacattacgtagggatgactatccggcgctgatcgacctggtgcgccgcacctggtatgccgaattcgatgagcggaccggtctgctggcggccgaagcggactgggagaactgtctggcgcgcaccaccaacgcgttcgtcgccgaactggacggccagccggtcgccctgatcgtggggcgcgtcgatgcgctggaccatcggagcccgctcaactcgcatcggatcaactcgtggaacgcgctggcgcgtctcgtgttcgcgaagggcggaatcaaggccgccggcgagattctgggcattctcggcatcgacaaacggctgcgcgcccaggccgcgagcgccgggcatgactatgcggcggaagtggtgctgttcgtacttgacccggcggcgcgcggccacgggctgggccggcgcatgttcgagacgctgatggacgcgttccgcctggccggcgtgcgcgactacttcctgttcacggacaccacatgcgatgtcgggttctatgtgcatcgcggcctgacgcaggtgtgcgagcagtcactgcccgcatccgtgccgggagaaaacccgtcttcgttctacttgtatgaggggtcggtgcccgagccggcgtgatgtgcccgccgtcgggcaaacactggtaggcttgagcacaagttggtatgccggcataccgtccacaggccggcgacgaaggggctgacatggcaatcagtgcgaaggaactaccactcgggaaagtgttcaccccggatttccggttcacgatcccctcattccagcgggcctacatctggaagaccgagaacatcctgcaactggtaagcgacttggatgacgcctgcaagtcgcccggtactccgtacttcctcggctcgctaattctggtgcgcgagggcgataaccgttacgacgtaatcgacgggcagcagcggctggtatccctgtcgatcatcatcgccgtgttgcgcgatctggagcgagacccggacctcatgcgccaactcgacgcgctgctggtggagcccggcgacaagctgcgcggcatcgtcaccgagcctcgcctcacgttgcgcgagcgcgacgcggcgttcttccgcgaacacgtgcaggaggacaacctcgaatccgtgttcgacatgaacgacgacgatctggcgaccgctgcgcaacgcaatatcgtcgccaacatccgcaagacgtacgacgagatctccaattggtcggatgccggacgccagcaattcgcgcagtatctggtcaacgaggtgacgctcgtcatcgtgaccaccgacgatctcgacggcgcgcatcgcatcttcgacgtgatgaacatgcgcggcctgccgctcaccccgtcagacgtgttcaaggcgcgcgccacggccagcctgtcgaccgccgaacttgacgtgtacgccgcccgctgggatgacatcattgacccgcttggcgacgatccgcatgactgtgaggaattcttcgcctatctgcatctcgtgctcacgcacaagccggccaccgacaagctcatcgaggatttcctggccgacgtgctgcaaccgtacatcgacaaaggcacggtgcccacgttcatcaaccaggtgctggcaccctacgcgatggcgtggcggattatcgcgcgccccagcgataccgtactgcccgccgaggtgcgtagccggcttgagggattggacgattaccgcagccacgagtggaagcccgtggccatgtgggcgttggtcaattcgtatcgcgggctgggcgacgccgatttgtcgccgttcgtggttcgtgcctcgcgtatcgccagaaccacggccacgttggaatcgttgggcgcccatgacgagcgtcggctgctggaaattctgaccgcattggaacaggtgaccggcatccgcacgctgaatcgcgctggaacgttggagcggcgcggttatgcgaacgccgccatccgtgatcttgacaagggctatttggtccagcgcgtgaacgggttgcatgtctcggacggcgaccgtgaaggcgcattggtccgtttgcatggcgagatgcagggtgacggcgatttggtccgtctgctgctgattcgcgccaacgagcagaaggccggcatgcagttggatcgaccacgccggttcagtgcgctgccgattatgccgttggatatcgaacggtcgaaatcgtttgcggactggccgcaggatcagcatgatttctggatgtaccgactcggcaatatggcgctggtgcagggccctgaggatcagttggacaggttgagtgaatatccggcacgtcgcgaccgcatgctgttgcgcgcggattcacgtcgtttcccgctgaccaatcagttgaaggatttcgctgactgcacacctgccctgctggaggcgcggcaggaagagtcggtccgactcatcgtggaatactggggcatccggtatgacaaggacgcccgtgatctgaccaagcagaatgtcgatgagttgtcgaagacttctccacggccgtctcatagttcgcggcgcgtcacgatccggcaggtgattgacgctggtctgctggtgccgggcgagcgtctggtgtgggatcggccgcgcaagggcgagcgctggtttgccacggtcaccgaaaacggtcgtctccgtctggatgacggctccgaatatccgactccgaccgccgcggcccgtgccgccgccggaggacgtcgcggcggcggtctggacgtgtggaagcgcacgcgcaacggtcagaagctcagcgacatctggaagcagttccgtctacaggcgcagtaggctacggtggccggcacatcattggtggctcccctccgtgagggaagccaaccgctcattttttccagtgccgccacgatttcagccggtgttttgcaatattcgggaaaatgactgattagttcggcatccgatgtgaccacacagttggcaccggattgttgcgcggcaacgatgatcagatcatcttcaaaatcccgatgccgtttttgcagggaaaaagccttatcacatgtcgactcatcgacagcgacgatgtcacacatctccttcacctgctcgatacaacgccatggcacccgtgacgacagaaagccgcgagtgaaattctccacttccgattcattcggtttgaattccctacgaatcgccgatgatgataggtatgcgatatccttcagcgacaatgacgcgcacaacaacgtaatgttgttcttcgcgccaagttccataaccgcttccgccatcttggcgtgatcatcgcgatggagcaaatagtccaacagtacgttggtatcgagcaaaatacgctgcatggaaacgtcggtcatcaatcggccctcttcatgttgtaatacgcatcaagttgctcgtcgtacattttgtcgcggaactgcttgtaggtaaggccttccatgaggtcggtgtcttctgagatcagtccggccttgaccagttccttgtgtacgtatccggcaccttctcgaatcagtttcagcttgcgctgcttttcctcctcgcgggcttgctcttcggcggtcgtttccaatgccggcacttccttgcggtcggcgatgtacaaccacagcgaccggattacgtcactcaccgatacgcctttgcccttgaggacttcttcgacctcgttcttcagtttcgcatcaatgcgaacgttcatttggaccatggtcatggcaacctccatttcgaagatgctatacagtatagcattttggcatgcgtggaaaaggccggtatccgttggcggataccggccttgctctcctcagtcagcttcgctgacagctcccctcaagagaggggagccaagaaggtggttacttcatgaggttgcgcagcacgtactggaggatgccgccgttacggtagtagtcggcctcaccgggcgtgtcgatgcggaccaccgcgtcgaactcggtcttggagccgtcctcgtgggtggcggtgacgtggaccgtcttgggggtcacgccctcgttaagcttctcgacgccggcgatatcgtaggtctcggtgccgttgaggcccagggactcataggattcgcctgccgggaactgcagcggcagcacgcccatgccgatcaggttggagcggtggatgcgctcgaagctttcggtgatcacggccttgacgccgagcatcaccgtgcccttggcggcccagtcgcgcgaggagccggtgccgtattccttgccggcgagcaccacgagcggcaccttgttgtcgatgtagtcgcgggaggcttcgaagatcgtggtcggcttcttggcgaggaagtcgtaggtgaagccgccaggcgtcacctcctcgcccacggaggcgagcagctggttgcgcagacggatgttgccgaacgtgccgcgcaccatgatctcgtggttgcctcggcgagaaccgtaagagttgaagttcttcggctccacgccgcgctcggtcagatacttgccggccgggctggaggccttgaacgcgcctgccggggagatgtggtcggtggtgaccgagtcgcccaggagggccagcacacgggcgccgtggatatcggcgaccgggtccggcgtggccttcatgccgtcgaagaaggtttgcttgcgcacataggtggacttgtcgttccacgcgaacagctcgccttccggcacgtcgaggcccttccagcggtggtcgccgtcgaacacggaggcgtagtccttgaggaacatctcgcggctcacgctgccgtcgaccacggcggcgacctcggcattggtgggccagatgtccttcaagtacacgtcgttgccgtccgcgtcggtgccgagcggctgggtctcgaagtcgaagtccatcgtgccggcgagcgcgtaggcgatgaccagcggcggggaggccaggtagttcatcttgacgtccgggctgatgcggccttcgaagttgcggttgccggaaagcacggcggtgacggtcaggtcgttggcgttgatcgcctcggaaatctcgggcagcagcgggccggagttgccgatgcaggtggcgcagccgaagccgacgagctggtagccgagtgcatcgaggtcgtcctgcagccccgcggccttgaggtagtcggccacgacctgcgagccgggagccagcgaggtcttgacccagggcttgggcttaaggcccttggcatgtgcgttgcgggcgatcaggccggcggcgatcatcacggacgggttggaggtgttggtgcatgaggtgatcgaggcgatggccacgtcgccgttttcgatgtcgaaatcgccacggaagtcggtggacacggccaccggatccttgacggtcttctcggtctcgtaggcgggggcggtcttctcgaacatgctcttggcttcggacagcagaatgcggtcctgcgggcgcttcgggccagcgatggacggcaccacggtaccgaggtcgagttcctcgtattcggagtactgcggttccacgtaatccgggtcggaagcgtcgccccacagcttgttggccttggcgtaggcttcgaccaacgcgacctgctcttcggagcggccggtcaggcgcaggtagtcgagcgtgacattgtcaatcgggaagatgccgcaggtggagccgaactcggggcccatgttgccgatggtggcgcggttggccagcggcacggaggcgatgccttcgccgtagaattccacgaacttgccgaccacgccgtgcttgcggagcatgtcggtgatggtcaggaccacatcggtggcggtaacgccctccgggatggagccggtgagcttgaagccgaccacgcgcggcacgagcatggagatcggctggccgagcatggcggcctcggcctcgatgccgccgacgccccagccgagcacgcccagaccgttttcggtggtggtgtgcgagtcggtgcccacgcaggagtcgaggtaggcgagcgtgttgccgttggcctcggccttgctcatgaccaccttggccaagtattcgatgttgacctggtggataatgccggttcccggcggcaccacgcggaagttcttgaatgcctgctgaccccagcgcaggaactggtagcgttcaccgttgcgctggtattcgatgtccatgttctgctggaccgcgtcggcgatgccgtacttgtcgatctgcacagagtggtcgatgaccatatcggactggacctgcgggttgatgacctccgggtcgccgccaaggtccttgaccgcgtcacgcatggtggcgaggtccacgatgcagggcacgccggtgaagtcctgcatgatcacgcgggacggcgtgaactggatctcgtggctgggttcggcgttcggatcccagtcgagcagggtcttgacgtgttcgtcggtgatgttggcaccgtcgatgttgcgtaccagattctcgaccagtaccttcagcgagtacggcagatgatcgatgccgtcaagattggcgatgttgtagtaatcgaagtccttgccggctgccttgagggtagccagctggtcgtcgcgtaaggacatgcttcctccgaaatcatgaatcggcttatgatgccgttgattatccgatacaaatggtacgggtacgttactttggctctggcgtgtcggcttgaagtgtgagacaattcgccgctattagatattgaaaccgtgctggcgcagtagattgccgaatattctgccgaccagcggagccagccatagacagatcacgaaaatcatggccgcgccgcccaacgcaatcagcgtggccaccaacgcagtgccggtaggcagaatcagcgcgaagaagttcgccacgaacgggatgaacgcgccgatgatgccggccgccgcgaaccccgcgaccagcgcacctcgccagctgttgagcggcctcgccacacgggccagcacaaacacgcccatcaaaaacagaataatggcgctggtggcgcgcaaagccgacagatcggcgtcattgttcaccacatcccagcccatgacgttcggcagggtccatgaagccagcaacaccgacagcgcggtggcgatgccgcccggcagcgcgaacgtgaccacgcgcttgaggaatcccggaatatagcggcgcgtgttcggcgcgagcgccagaatgaacgcgggcatgccgatggtgagagcgccgatatacgtgatatggcgcggcaggtatgggtatgggatttgcgtcagcactacgccgagcgagatcagcgcggagtacacggttttgacgaggaacaggctggccacgcgctccatattggccatgacctgacggccccgcgccacgacgtccggcaggtgcgagaacttcgaatccaccagcaccacctgggccacggccttggtggcgggcgccgcattgcccatggcgatgccgaggtccgcctccttgatggcgagcgcgtcgttgacgccgtcgccggtcatggcaaccacgtggttctgcgtgtgcaacgcctgcacgatggccttcttctggtcaggcagcacgcggccgagcacatcgacgttttcgagcacgcgggccagttcgttcacgtcctcgggcagttcgcgcgcgtccatcgccaccggctcatggtcgcctgtcagtttcactctgcgggcgatggcacccacggtcactggattgtcaccggaaatcacacgacagcgcacaccctgctcacggaaccaagcgagcgtccgctcggcgtcctcgcgaatcttctcagagcacaacaccaacgccatcggctcagccttggggtcgagctgcgggtcgtcagatacattggctccctcaactgctcccctcagtcgcttttggcgacagctcccctcggagagggaagccagctcgctcttctcggctcccctctccgaggggagctgtccgcgaagcggactgaggggcgctgtagaccgcgcaaccagcaacacacggttgccgtcattggcatactcgttaacctgctgcaacaccgacgaatagtcaccctcaagcgcagaaataataacctccggcgctcccatgtaccaggtctcgccggatttacgcaccgcactccatttgcgcgccgaagagaacgggatacgagactcaaccgcacctgccccatatccttgggccttgagcccggcgagtacggcttggccggtgccgttgggctgctcttcgttgcagcagtcgtagagagcctgcgtggctgcctgttccgcagccgcattggcggaatcgagcatcacgagccggttgaaggcgataccgccatcggtgatcgtgccggttttatcgaggttcagcgcgtccacgcgagccagtgtctccacggattcaagctcctgcaccagcgtattgtgacgggcgagacgcatggcggccaccgcgaagttcagcgaagtcagcagcaccaagccttcgggaatcatgcctactacgccggcgaccgcggaaaccacggcttgccgccattcgccggtggagagtgccgtgccccaaccgccgaccgtatgaatctgcgaaagaatcagcagaatgcacagcggtaccacgaggaaggtcatgaatttcagaatcgtgttgatgcccttgttcaggtcggacacggttttcttgtataccttggcctgcgcggtgagcgtggcggcgtaggaatggctgccgaccgcattgaccttgaccaatgccatgccggagaccgcggtggcaccggaatacacctgctcccccaccttgtggcgcacggtacgagattcgccggtgagcatggattcgtcgagttccagtccccaggtctggatgatctgcccgtcggccggcacctgttcgccggcgcggatccacagcaggtcgtcgagcacgatctcgttgtggggcacctccacgtccctgccgtcacgatgcacgaggaagtcggaggccacgaggatggatagcctgtccagcgtgcgcttggccctgagttcggtgacgatgccgatgcccgtgttgatgatgatgacgaaaccgaacaccgcgtccctccaggaaccggtgatcagcaccagtaccatcgcggcgaagatgatgccgttgaacagcgtgaacacgttggctcgcacgatatcttgaaccgaacgcgagctggaggttttcaccgcattcgattggccactttcgatacgctgcaccacttctttgggggtaagaccggtcgctccgatctcaggcatttccacggctgttgttgcactcatattccctagcctaccgcgtcttgtttcgcaatccactaaggctcagggatgattcagggtgctttctcagcttcaaggggctgattcggctcaggagacggtgactttgatctcgcgttcgtggggttcgtcgcgcgtgatggtgagcacggcgtcagtaatagtcattggcttggtatcggcagtgtcgccagaatcggcactgttggtgttgaggtgaaggatgacggcgtacagcagttcatcttcgggcgcatgctttggatcaatgagagcgactggaataccggcttcacgcgcattggtcaacgtctggttccagctctcccggttggcgtcggtaacgtcgatgccgctgataaccacgattttgaccgcgcgagctacgaaatcggcaacaccctgctgtgcggtggccgcattcttgtcgacgccagtatgagcatccatactatcggcaccgttttcgctggtagtgccggcgtcagaagattcggtttcaccggatacaccatcagttgcgtttgccgagcttgcggatgtttcgagcgaggcatagtagacattgagtttgtcatcagacagcgcattgatgacgaactcgtctgcggcggtgtcagtcgaccccacaaagccgactgtgacatccgtgggatgtgtggaatcgtgggcgacttccggcatgctgtcttgggtatcgccgaccgccctaccggccggcgtgcaggcggccagggacaacacagccgccatgcaggccagcaatccgagaattcgtcgtgtcatatgctcacctgtcagcgggtaaacagggccaccgtctcaacatggtgggtcatcgggtagatatcgaaggcacggatgtctttgagctcgtagccttcgccgatgagtgtcgcggtgtcgcgtgcgaggctggtgggatcacaggcgatgtagaccacgctggatgcgccggccgcggcaatctggcggcagaccttggcacgagcaccggcacgcggcggatcaagcactacgacattcggcttggccagatgcgccggcacatggtccagcgtgcgcgagacgtcacccgcgcgggcgtccacgtcgttcaggttcatggcgcgcagattgcgctgggcgttcttgacggccacacgcgcgccttcaacgctgagcatgcgggtgcgttcaccggtcattgtggccagcggcagggtgaacaggccggaaccggaatacagatcccagattacggcgtccgccgctgactgcagctgcccgttgaccaggttgatcacgtgcgtaccgagggcgatcggcgcttggcgatgcacttgccagaaaccgttggcgtcaacctgatagtcgaaggtcgtgccgttgatggtcacctgttcggtgagcagctgggagccggcgcgcagttcgccgtccacaagtacggcgtaattgtcgtctgctgccgcggtatcgacgatctcgccgcgcggttcgggcacggaaagacgaatctgggagccgggttcaaagccgccctcccacacgtgttcgcgcttggcgacgtccagcagcgtgcgcgtggcaagcggcatggtgtcgatggccacgcggttgtgtgtgccgcgccggcgcatggatggcatgccgttgtcgtcagcaatcatttcgatgcgggtacgccaattgaggccgccggctgccttgtcgccgggcatgcgctcgatgggaacggccacgtcgatatggccgagtcggctcatctgttcggagacggtgatggccttccacttgagctggccgggcaaagagacgtgcacgagatccgcgccgcccactcccccgcccatcgccaagggaccggcaagtggccatgccggggtgactcggtcttcagacggctcgagaacctcgacgacttcgccggtccagaaccggtcgtcccggtcgtggggctcgtcaagctcgactcgcacgagttcgtcgggcaaggcgaagcggacgaacaccacacgaccgtcgatatgggccacgcagcggccttggtcggcgtatcgttcgatacgaacttcagcttgcatcatcgtcctttccggttgcgctcggttcgagttcggcatcaacagcgacttcagtctgtatcttcttagccgcgaccttatgccggtgcatcggcgtggcaataatgaggtaactcacccaaatcgccaatgcccagaacggaatgcccatgagcaggcgggtcacgccaagtgcagctacatggttggtcagatacagcggcacctgcaccaccagccgcagcaggaacagaccgacccacaggccggtgacaatcatataggcgcgtttcagggccttgtcgtccatccagtcatggaaccatgccttgaaatgctcggtgggcaggctacggatgaattcgacgaccaaacccagtccgggcacgcgcgcaatcagcgacacggcaagcaacgcggcatagccagcattggtaatgaatccgaagatgtagtaattgcgggcctcatgagtctgccatgcccaaatcaggcagatgcctaccgccaccagaccagagaccgcgcccattaccgactggcgctgaatcagtcgcacaataacctgcaataccgccagcacggccgaaaccgcaatggtgagattcagattgctcgtggccacgaacagtacgacgaacaccacgccgggcagcatggattcgatgacgccacgcgggccaccgatggcgtcgatgacggagaaatcctcgccttcattgccggcgtcggctagagcggacaggccggtgcgtttgttgtctgccaagtctcttcctataaatcagcgaacttcggagaacatcgggccgcgagacagcgtggtcttcacttcggtctgctggtcctggctcagcggacccttcggcttgttgttcggaatgtccttgaagtgttccttgccgttctcctcgccggcttcggccgcggccttggcggccttacgctcagcgggggcgaccggcggatgcatcgggatcagatcgcgcggcgccaaaggctcctcgccacgctcgacgacgatgtcggcgaagaacttgttcagcgcctcggtctccgggctgtccggatcgatagcagccttgccggagaagatgccacgcagcatccagcgcgggccgtccacaccaacgatgcgcgtgttcacggtcttgccgcccttgacattgaccggcagcttcagttcggtgccgaacacaccgtccacttcagaagcggccttgttggcttcaagcaggtcaccgcgaacgtcatcccacagtcccagggtcttgggtgcggcaaaggcttcgatctccaggctggaggagccgaaggtgatggtggaaccaagcacttgctgggtggcgcggttggccttgatgcgcagctggatgccctggaggaagggcaggtagtaggcgccgagatccagataatcgtcataatcgggcacgtcctcatcgttgacatcccacgggcctcgctcttcgccgcggccctggtattcgctggccggctcggcgagcacggtctccgcgctctcggcctttgcggcagcgttcgcttctgcggcggccaccttgtcttcatcgacaggctcaatggccggctcggcttccttcttgctcttcttcttgccgaatccgaacagtcccataattcctcgtttcatgtaacggttgcaaccttgctaacactagcactcaggcttagagaaagctgagcatcgcggccgccgatgtccggttcgattcgtagggaggccaaaatagtatggccgcatgaccatcaccattaccacgtctaacgtcaacggcattcgtgcggccaagcgcaagggcatcgaggattgggccggcaagcatgcgccggatgtctggtgcatacaggaggttcgcgcgcctcaagacgatgtcgattctattttcgatgaatttggtttcgaatacgccaccgccggcaagatcgaggcaccggccaacctccatgccatgaacgaggtctgccgggtgaaaggccgcgcgggagtcggactgctcaccgacttggaagtgcttgacaagcgatatgggctgccaggtctgagcgaggatgtggattcagggcgttggatcgaaaccgatgtcaaaacgcctgagggctacgcgatcaccgtggcatccgtatatgtgcatgctggcaacaccgattatccgaccaaaatggaacagaagtaccgttttctggacacgatgctgaagcgcatgggcgcgttgcgggacgaggctgcgcatggcggcaaacaggccgtgctctgcggcgatttcaacatcgcgcacacgccgcttgatatcaagaacgccaaggccaatgagaagcacgccggatttctgcccgaagaacgtgcctacgtggacaaatggctggacgaatacgagttcgtggatgtgatgcgttcgttggccggcgacattcaggggccatacacctggtggagccagcgagggcgcgctttcgacaacaatgtcggctggagaatcgactaccagttcgccacgcccgagttggcggagaccgcacgcggattcgtcatcgacaaggctcccacgtatgacaaacgctggtccgatcacgccccactcacgatcacatacgaggtatgacgtattccgtgggacaacatccgaaaatcgacgattttcgcgggccgtcccacaccccacagcatgagtaattatcgaccacactaagaatggcgtaattccgggcttcgtgagaaatctgctgtgggacaacactcatgtctatcgattgatgttgatgttgtcccacaatttgtgggacaacatcgggaaaacaccaatttttgcctttcgtcccacgcgaaccatcatgcaaacctgcgcatacgaatattgggttctttccacggatggaaagaacccaatacaatgcgctcaaacgcagattatcagtccagaccgagttggagcttgccgccggggatggcgtcgagcaggtctcgggtgtactgcttctgcgggtggtcgaagacctcgtcggtggtggcatgctccacgagcttgccgtgctgcatcaccacaacctcgtcggcgatctgacgaaccacggccagatcgtgggtgatgaacaggtagctcaggcccttttcggcctgcagatcgttgagcaggcgcaacacctggtcctgcaccagcacgtccaaagcggacacggcctcatcgcacacgatgacgtccgggtccagagccatggctcgtgcgatggcgatacgctgacgctggccgccggaaagctcgttcgggtaacggcccatcacggaagccggcatctcgaccatgtccagcagttccttgacacggttggcacgccacttcttgtcgccgatcttgtggatgcgcagcggctcctcaatggaacggaagatggagtacatcgggtcgagcgaaccgtaggggttctggaacaccggctgcacgtggcggcggaaaccgagcagatccttggacttgaacgtggaggtgtcgcgaccttcatagaacaccttgccggaagtgggcttcaggaggtgaagcaccatgttcgccacggtggacttgccggaaccggattcgcccacaatggccagtgtggtgccacgcttgacggagaaggacacgtcatcgacggccttgaacatctccttcttgcggggcagcttgaattccttggtcaggtggtcgacggtgatgatgtgctcgctcttttcgagcgtgctttcgccggcgatgtggtgatcgagcagagcgtccgcatcctcaccacgctccttggcggagatgatgcgctgggaggccagcgacggggcagcggccaccagtcgcttggtgtacgggtgctgcgggtgctggagcacttcaagggatgggccggattcgacgacctgacccttgtacatcacgacaatgtgctgggcgcgctcagcggcaaggcccagatcgtgggtgatgaacagcacggcggtgcccaacgagtcggtgagcatgtgcaggtggtcgaggatgcgcttctgcacggtcacgtcgagggcggaggtcggctcgtcggcgatcagcagatcggggcggcaggccaagccgatggcgatgagcgcgcgctggcgcataccaccggagaactcgtgcgggaactgacgggcacgggtagcggcgtcgggcagaccggcctcggacagcagacccgcgatacggtcatccattgtggagccggtgacgtacttcttagccagataccaggcctggtcgtcggccacgccggccttgatgaggtcgtcggccacgcgccaacgggtttcggagcccggaacccattcgttggtgaagcgggcgacggccttgtcgaaggcctcgccggacacgccggcttcagtcaaagccttcttggcctcggtcatgagctcgggcagttccttggctccgaggaaggtctcgtcgtcgttgcccttgacttcgacctcgtcgccggccagagccttggcaagggcggagcgcttttcgtgagccacgtccatgttgttggccttcagtgcttccttgacctgggtgccgatacgccacaccgggttgaggttgctcatcgggtcctgaggcacgagacccatcttggtgccgcgcagcttgtcgaactcgctctgcttggcgccggcgatttcctcgccgtcgagcttgatggagccgttgaccacgtgaccggtgccgggcagcagacccagcacggccatggcggaggtggacttgccggaaccggactcgcccacgatggccacccactggccagggtagacggtgaagttggcatcgcgcaccgcgtgcaccggcttgccggtgtcagtggtgaagtcgatggccagatccttgacctcgagcagcggaccatgctctttctgcatagccagcatcttggcgttggtgttgtcagtcataatgtttctccactcccctcgctcaggccgtacggctcttcggatcgagggcgtccttgacggcgtcgcccatcatgatgaacgcaagcacggtgatggccagtgcggcggacgggtagaacagcaccagcggatcagtctgcaggttggtctgtgcgctggagatatcgccaccccagctcaccgtggtggtcggcaggccgacgccaaggaagcttagggttgcttcggccacgatgtaggaggccagcgaagtggtggcgatgacgatgatcggggccagggagttcggcaagatgtgacggaacaggtttctggcaggcgtggagccgagggccgtggaagcggtgttgaattcgaggttcttcgattccagcacggcgcttcgggcgatacggcatacgccgacccagccgaagagcgtcagcaccagcacgatcttccagatggacttggaggtcttgaacatctgaagcaccacgatggcgccaagcagcataggcagcgcgaagaagatgtcggtgatacggctcagcaccgcgtcgacccaaccgccgaagaagccggcgacggcaccgatcagggtaccgacaatcacgaccagcagcgtggagagcacgccgacggacagtgaggtacgggtgccgtagaccacgcgggtgtacacgtcgcagccctgcaggtcgtagccgaaggggtgtccggcggaggcggggctcaaggagttgcccagatcgcaggcgttcggatcctgcttggtgaacagaccgggggcgatggccaccacgatgatgaacaggatcagcaagccggagatgatgaacaacgggttgcggcgcagggttcgccatgcgtcggcccacatgctggtggccggtgcggattcgtcgacggaatcgacgtcctgcaacggggtctcgtcgagaggagctacgtaacggtcctgaccgggcagggtttccatgaagtattcggttcctggctcgccggtctcgttgagctcgttttcagtggtttcgtttgccatgtgactcactcctccctatcacgcgtaacggatacgcggatcgagggccgcgtacaacatgtcgacaacgaggttgcacactacgaaaatcagcatgagcaacgtgacgatggacaccaccaggtttgcctcgcccttcagaatggactggtaggtgaggaagccgatgccgtggatgttgaagatctgctcggtgatcatggcaccacccatcagggcgccgatgtcctggccgaggtaagtgacgactggaatcagggagttacgtaacacgtggcgcagcatgacctgaccgttcgacatgcccttggcgcgtgcggtgcgcacgtaatcctcggcgatgttggaggagatttcggagcgggtcagtcggatgatataggccatcgacaccgaaccgagcaccatggccggcatgagcagatcaaggaagccggggtcggcgcctgccgtcaccggcaatatcgcccactgaataccaaagacatattgcatgacgaagccggtgacgaaggtcggcacggaaataagcagcagagagacgatcaggatgacggtgtcgtaccacttgcccttcttgaggcccgagataatgccgaagacgacaccgaaaatcgcctcgaacacgaacgccatcaagccgagcctgatggtgaccgggaaggcgcgggtgatttcgtcgagaacgggctggccggcgaaggtatcgccgaagttcagggtcagtgcattcttcaggtagataaagtactgaacgatgaacggctggtcgagatggtattctgcgcggatctgggctgcgacggcctcattgacgggcttgtctccgaacatggccttgacagggtcgcccggcagggcgaatacaagggcatataccagaagagtcgtaccgagaaccacgggaatcatctgcagaatgcgtcgcagaagatacttacccatacggttgctccttatttcctagaccggccagaaagggtatagtacgcccccgccggtcgataaatactccgacagtttaccgcatgcccggactgtgatatgtaaatttgcgttaacgcaaggtttgagattgggcaatgttggtggatatgtccatggttgcggtcggatagtggatactttaacttggttcccgatggcgtgagcaagcacccctcacacaacaaaaagggcggggatcttgcgatcctcgccctttatttccgaactacctaacggtatccgttcagtgagtcagactcacttcttggacatctcggtgtaggtcgggaggttctgccaatcgaaggcgtagccggacttcacgttgagggaagccacaccggaggcgttggagtagtacagcgggatggccggaaggtcgttgaggaggatttcctcagcctgctggtacagcttgttggcgtcatcagtgctggaagcggcagcagcctgcttgcacaggtcatcgaaggccgggttcttgtagtcaccatcgttggagccgttgccatcagcagcagcggtggagtacagctgccacaggtagttctcggcgaacgggtagtcaggctgccagccggtacggaaggcgcccttcatctgacggttggtgaccgcgtcacggaattcctggaaggtcgggatcgggttggtggccgcgtcgatgcccaagttgttcttgagctggttcacgatagcatcgtagagcggcttggcaccaccatcggcgttgtaggagaaggtgagctggccgtcgtacttggagatggcgtcagccttggcccacagttccttggccttggaggcgttgaacttcaggttgtcggcacccttgagggagtcggagtagcccggggtcttcggggaggtgaactcggtggcggcggtggcgttgccgttgagcaccttgtcgatgagctggtcacggttgatggccatggagatggcctgacgacgcagctggccttcctcgtcgttcttgaagtggtcaagggaggacgggatggtgaaggtctggatgacggagccggcctcggagtaagcctggaccttcttgtcggtcttgaaggtcttggtgaaggcagccgggacggattccatcacgtcgaggttgccggcctgaatgtcacggtaagcggcggagtcgtcggtgtagaccttgaaggtcacgccgtcgttcttgggctgctcgttacccttatagtcagggttcttgacgagggcgatttccttgttgtgatcccagtggtccagcttgtacgggccattggagacaggcttctcgccgaaggccttcggatccttgtagaaggattccggcagcggggcgaaggccgagtagccgaccttaatcgggaacacggagtcggactggttcaggtcgacggtgaaggtggtgtcgtccacgaccttgaggccggagagctgctcgtcacccttgaggccatccttctgcagatcgtcatagccggcgatggcggagaagaaggaggagcacttctgggcgttcttggcgttggccacgtaggaccaggccttggtgaaggactcagcggtcaccggagtgccgtcggtgaacttccagccagacttgatcttgatggtgtactgggtggcgtcatcgttcggggtgatggactcggccacttcgttggaagccttgccgtccttgtcgaaggagaccagacgggagaacagcaggtcgaccggcttgccgccgccggtttcgttggtgttgcccgggatcagcgggttctgcggttcggagttgtacgcagtgatgatgttggagccagcggtgtcaccggaggcagcgttgctgttggagccgccgcaggcgctcagcagcatggccacggagcaagccatggcagcgaaagcaagagctttcttcttcatatgatttctcctattcattaggttgcaggacgtctcagccccgcctcatgcgaacggggtcggatttcctcatcgtcgggacacttacgcttcccgccgcttcggacacccaaccccgttgctgttacctgtcatttttgcgcacttgggagacaagcagtgtattttttgttacacccatgtaaaattccggggttcttgccggctaggttcagtctttgctgagtttgttaaccaatgtccacatagtggtcatgcccgcggaaaggcctgtccgtaacggttcttgagctgctcgatggagacgtgcgtatagcgttgtgtagttttcaaggaggaatgcccgagcatctcctgcacctccctcaaatcggcaccgccgtccagtatgtgcgtggcggcggaatgacgcaacgcatgggggctgatgtccggcacgccggcctctcgggccgctctgtgcacgatgtcacgggctatgcgttggtcgatacggccgcctcgtgcgccgaggaacagggcgttggcagcacgggacttgactgcatccgttgccgtacgggccagtaccggccgcccctgttccagccaagtctccagcgcacgctgggcgggtagtccgaacggcaccacgcgttgcttgttgcctttgccggtgactttgatggtgcgattggagaagtcgatgtcggcgatatccatcgacaccagttcggcgacacggatgccggtggcatacagcagttcgagaatcgcggcgttgcgctgcgattcggcggtgactcgggcgttgtcgcgcttgtctgcacgggcgggtgcctcactgcggtttacggtatcggccgacttatcagctgtcttgccagctgccttgccgctgccggacgcggctgccgctcccccatcgcccttgtactggtttgttgcaacggcctgttcggcgacatccaataactgctcagcttgagattcggtgagcaccgcgggcagcgtgctgggaatcgagggagtcatcagtgtggcggccgggtcggtgtcggtcaccccatgctcataggcccacgcgaagaacccgcgcacggccacggttttgcgggccatgctgctgcgggcgtgatcgcgcgattccaccgccatccagctacgcagatcatccagcgtgatctcgttcagatcggtcacgccgcgcagctcgaacaggtgcagacatgccgtgagatccgcgcgatacgctttgagcgtattcgctgacaggccgcggttggacttcagataggagacgaaggagtcgatatcgccgtcgaactgcgtagatgacactctcgttctcctccgaattctttatggccttgggttacggccggggtggcgtgttgcgccgctccggcacgggtttcaatgtggcaatctgttcctgatggatggtcacgttctgggccgggcgcgaaccattggcggcggcgtcacgcaccatctccaacgtgtatccgtcccaggaaaccacgtgacccacatagtcgcggaacttcatacggtggtcgaccgggtcaatgccatcggtgatgcgcaccaccacgcgggcaccggccggaatctgccttggtaacgtcatacgtcatcatcccccttaaccattcgccgcatcaacttcgatgcgtttcccgaaaaacggtacagactaccttactcctttgggcctttcgaacagcggagccacacggtcttctcacgaaaacaagcgggaacttcatccccctcgcgcggccttcttcgtgacaggcggcgaggggaacctgcgcacgggcctacatggcggtacgcagttacatggcggggcgcagttggatgatggcctgacgtggatggacgaagccggtgatggcttctcctcggcgtgcggagaacagcaaggtctgctgccagccggcttcggggacggcgagctcgcgttccgggaatccggcggcagttgtgccggcttgcggcgcagcggtggccgtaccgtcttgtgcagcggtgatgccggcatgtgtcacggcggccttgtaccggcggaaggggtcgccttcggcgaagaatcccatcacatcctgctcgccggcggcaccagcgtgcagttggtcggccatatcggtcagacgtgccgccatgcggcgcagcagcgcttcgacgttcagcgagtcttcctcgaccatcgcgcgcgtgcggtccgggtcggtcagggacacgcgggtcatgtccctccagcagccggcggccagcgcggcggcgatgttgcggtccgggttggcgaccagttcgttgatcagcgcggtggacaccacatgcggcatgtgggagatcatcgccgcggccttgtcatgcgtttcgtcgtccacgacgatgacgcggttgccgacgtccttggtgatcatcgcggcgacgtcgaggaagcggcggtagtccgtggactcgtccacggtgatggcccatagggcaccgtcgtacagatgcgggtcggcggcctgccagccggacagttcgttgccggccatcggatgggcgccgacgtagcacttccccagcccggcagccttgacctgatcgcggaccatgcccttgaccgagcccacgtcggtgagcgtggtgttcggatggtcgcccatgagcgggcccaggacggcgaggattgcgggcatcgccttgagcggattgcacagcacgaccacatccggctcggcatccatgagttcggagagcgtgctcttgcagaaaatgccatcggcttcggcctgggcgtaggggtgcgggcgatggttccacgcgacgacgcgcacgccgcgctcggtcaggcggcgtgcgagcgagccgccgatcaatccgagtccgacgattccgactgtatctaccacagcagttccttccttgcttcctcggtgtactgccagccttccggcgcgcgattggtgatgtggacgccgccctcgggcagcatccaggcgtcgaccggcgggttcgggcgttcgcggcgtgggtagacggccagggtttttgcccagtcgccgtgtccggcgatctcttccagcgcggtgcggaatctcggctcccagggggcggcgtcaagggtggcgatgaagctgtaggttccgtcgtggcctttgatcgggcgcgagatgaagctggtcatgttcagtcccgcatcgcgcaggacgtccagcaggtcggcgagtacgccggggccggtgaccagcgggatgaaggtgatgatggtttcgaagtcgccggcgtcattgctgtgggcgcgggcgttgagctcctggaccacctcacgcggggcgatgacaaggaattcggtgtgcgcgccatcgaaatcctgcacatgttcggcgagggtgtcgagatcgtagagttcgccgcagaggctggggccgagcgccacgcggccgggcttcaggtcgcggcaggcggcggcgttggaggatgcgggttcgggctgcaaatggtgttcggcgatgaaccgggtgcattgggccagaccgtgcgggtgggcgctgacggggttgccggtgcagtcgtagatgctgtggccgcgcacggtgaaggcgttgaaggccacgtccacactgatccgggcgaagccggccgcgttgggggcgtcgatcagcgcgtcgagattcgggaccacatagccttcgacgttgttttcccatgcgatgacgccccagccttggcgcgactgtacggcctgcatgatcgcaggcacgtcgggcagagcgatgaggtcgaagtcgccgagtgtggcgaactggtcggcggccgtcattgccgcctgatgggtgaaggtgccctccgggcccaagtaaaacagtttcatgcgtgccataaagttctatggtagcggccgtaatcccctacgcccgccgatacgcgacgcattcccgggaatgtatcgccatatatagttacgcgcgcgattcagaatgagtgggaatgacgaaccagcgggcgggaagaatgagcaggacgacttggaccagtatcaggccgtacagccagatgtagccggcatgttgggagaagaacggcatgtcgccttggaatccggcgacgatgagcgctttgccggatgtggtggtcagcgccatgccccatgcggtcagtgaggaggcgatgaggtgcagggccagtccgaccgcgcccatgcgcgaacgggcgcaccatgtcgataggccgatcagcagaaacgccagcaccagaccatacggaatattcagttccgcacccatacggtgggcgaacgtgcccacaaaggcggaagccacgcccgccgcaatcgtgatcaacgatttgaccagcgcgttctggcgatacgaccacggacgcaattcagtagtgctcttcacagtcatgcgtttcagtataggtggggatatgacttggtgaggaataaacttagctcccctcagagaggggagctagagagaatggtcggctacagccgcaccaaatcacttaccctgctgggcggcgttctggcggcgctgcttggcgcgccacttgtaccagtcctcacggccgaggatgatcttgcgcacgcggatggactccggggtgacttccacgcactcgtcctcgttggcgaagtccagggactcctcaaggctcatcttgatcggcggggtcagggtttcgagcacgtcagcggtggaggaacgcatgttggtcatgtgcttggccagcgtgatgttcacgtccagctcgtcgggcttgttgttcacacccacgacctggccttcatacaccggggactgcggttcgacgaagaagttgccacgggcctgcagacgctgcatggcgtacggggtggcgatacccttgcgatcggaaaccatggaaccgttctggcgaatggtgatggcgccagcccacggcgcgtagccggcagagatggaggaggagatgccggtgccacgagtggcggaaagcagcgcggtgcggaagccgatcagaccacgggacggcacggtgaactgcagacggacccagccggagccgtggttggtcatgccatccatacggcccttacggtcggccatgagctgggtgacggtacccatgtactcttccggcacgtcgatggtggtgttttccatcggctcgttgatcacgccgtcgatcttcttggtgaccacctgcggacggccgacggtcagctcgtagccttcgcggcgcatctgctcggcaagcacggccagcgccagctcgccacggccctggacttcccaagcgtcgggacggtcggtgggcagcaccttgatggacacgttaccgatgagctcgcggtccagacggtccttgatcatgcgggcggtgagcttgtggtccttgccctcggtgccggccagcggggagtcgttggtgccgaaggtcatggagatggccggatcgtccacatggatgagcggcagcggcttcgggtcgttggggtcgacgatggtctcgccgatcatgatgtcgttaacgccggcaacggccacgatgtcgccggggcctgcggattcgaccgggatacgctcgaggccctgggtgcgcagcagttcggagacgcggaagttctcgagggagccgtccacacgggacaggccgtaggtcttgcccttctcaagggtgccgttgtagatacggaccagaccgagtcggccgaggaagtcggaggagtcgatgttggccacgtgagcctgcagcggggcgccctcctcgtattcgggggccgggatggtggagatgatggtttcgaacagcggctcgaggttgtcgttgtccggcaggccaccgtcggcgggctggttcacggaggcgtagccggccttggcggcgcagtagatgaccggcatttcaagcagctggtcaaggtccaggtcgatgccctcgtgctgcacgtcgtcggccaggccgagcagcaggtcggaggtttcgccgacgacctcttcgatacgggcgtcggggcggtcgaccttgttcacgcacaggatgaccggcagcttggcttcgagggccttgcgcagcacgaagcgggtctgcggcagcgggccttcggaggcgtccacgagcagcacgacgccgtcaaccatggagatgccgcgctcgacctcgccgccgaaatcggcgtggccgggggtgtcgatgatgttgagggtgatgccctccgggtggccgtacttggcggccagcggaccggtgtattccacggccgtgttcttggcgaggatggtgatgcccttctcgcgttccagatcgttggaatccattacacgatccggcacttcctcacgctcggaaaacacgtgcgactgctgaagcatggcattgaccagggtggtcttgccgtgatcgacgtgagccacaatcgccacattacggatatctccacgaaccgccatcgaaacctctcttaatactgattcttttgcgtaatcgttcggtacttgcgttctcgagtacttaagtacttactctgaggtgtttattcatacctacacacaaaccgtcacgatggtactcgcacaccttgactatgtcggaacatagaaaagcacctcacaacggcagaactcccgcgtctcgacgaacccctcgcgggatttctgccgtttttacggccttcaaacggcagaacccccgcgtccctttcgccgggacgcgggggttctgccggtaatcaggcaaatatctgttctcccgtcatcgacttccgtcagtcttcgagatcgaggcctttgcgttcgggcaggcagagggcggcgacgcaggcgatgatgaaggcggcggcgaagatgatgaaggccacggccttgttgccgccggacagggtcaggaaccacggcatgaggagcggcgcgatgatggcggcgatgcggcccaccgctgcggcggcaccggcggccgcgccacgcaggcgggtcgggtagatttccggggtcacggcgtacagcacgccccacgcaccgaggttggaggcggacagcagcatgccgaacacgagcacgagggccacagatccggcctgcgagaacgcgaaggcggccacggcggagacggccaggaagatgctcagcgtcttgcggcggccccagacctccaccagccaggcggctaggaagtaaccgggcagctgggcgatggagatggcgagcgtgtagccgaatgacttggtcagggagccgaactggtcggcgagcagcgacggcatccatgtgaacgcgccgtagtaggagaagttcacgaagaaccacgtggcccagatggcgatggtgcgggccaggtacttggagccgaacagttcgcgcgtcttgatcttcggcagcggcttgcccttgggagaggttaccggggctactcccccggcttcctcgaagtagcgcacggccttttcggcttcgtcttcgcgacccttggcttcgaggaatcgcacggattctgggatgtgcacgcgggtgacgattgcgtagagcagtggcagcgcgccgatggccagcgcccagcgccagccccagtcgccggtgttcgggatcacgaagtagccgatcatggcggcgacgatccagccgacggcccagaacgattccagcagcacagtcatgcggccgcgctgtttggtcggcgaaaactcggagaccagcgtggaggcgaccggcagttccgcgcccaagcccagtccgatgatcagtcgggcgccgagcagcatgccgagtgaccaagatagggccatggcaccgttggcgatgccgaagataatcagtgtggcggtgaacacggttttgcggcccacgcggtcggcgatgaagccgcccactgccgcgccgatggccatgccgacgaagccgatggacagcacccatgacttttcggtcggggtgaggttgaagtgcgggtcggcggcgatggcggcgactacgaaggagacgaggccgacgtccatggcgtcgaatgcccagccgatgccggaggcgacgaggagtttgcggtgcgccttgttgaagggcagccggtcgaggcgctcgttgcgggtgagctgcgcgggttgcgctgaagtggtggtgctcacgtcgtttcctttctggtaagtggcgtcagatttaatggcgggtcaggtcggtgtaggactcttcgatggccaagctgatgcgttcgacttgttcgcgggtcagcggcttgcggaaggtcatgcgtaatgccgatttggcgatggacggttcgaggcccatcgccagcaacgtggcaggaatctcgtggcgcccgatggcgcaggccgagccggatgaggcagcgatgccgcgcgcgtccaggtcgacgagcagcgcttccccggtgacgccggggaagatgaaggaggcgtgaccgggcagacggcgttcggggtcgccggtcaggtcggcgcgaggcgcgacccggcgaaccgcgtcgatgagcatgtctcgggacgcgaccaactcacggtactgcgcctgcatgcgcgcattcgattcgttgagtccgatggcgagcgccacggcaccggccacgttctgcgtgccagagcgcaggccgcgttcctgcccgcctccggacagcaccggttcgatgggtgtgcggccgcgtaccagcagcgctcccagacctttgggggtgccgaatttgtgtccggatacggacagggcgtccacatcccagtcacgaaaacgaatcggaatctgcccggcggcctgtacggcgtctacatggatgggcacgccgtgcgcgtgggcgatgcggaccagttcctccacgggttccacggtgccgacctcgttgttggccagcatggtggagaccatcgtggtacgttcactggcctcgccgtcgagctcgcgttcaagtgcgtcgagatcgagatgtgcttgcgcatccacgggaatgcgcacgacttcgaaaccgaaccattcgtgcagccatgccgccgattgggccacggccgggtgctcgatagcggaaatgataatgcgcgggcgacaatttgccggctgtttgccatcggcttcggcgaatccgcagaccggccgcaagcccagtttgcgcatgcgcgccatggcgatgcctttgatggccagattgtccgattcggtgccgcctgaggtgaagatcacgtcatccggccgggcgcccaatgccgcggcaaatgatgcgcgagccgcgtccagcgcgcgggccgcggttttgccgggctggtgcacgctggccggattggcgtaggcctcagtcaggaacggggtcatggcctcgatgactgccgggctcactgattcggtggcggcggcgtccaggtacagttcgccgggttcaccggatgcgttgggggtatcggccatgactagttccaatccaatccgaggtcgatgctgcgcacagagtgggtgagcgcgcccacggagatcacgtccacgccggtgacggccacggctggcactcgctccaggctcatgttgccgctggcttccacgatggccttaccgtcgatgagctccacgccgcgacgggtgtcgtcgagcgagaaattgtccagcatgatggtgtccgctccgccggcgagcacggcgggaatctggtcaaggcggtcgacttccacttcgatatgcgtggtgtggcccacctgttcgcgcacgtggcggatcgcgccggccaggtcgatgccgcgcgcggcgagcgccgccagatggttgtccttcatcatgaccgcgtcggacagtccgtaacgatggttgtggccgccgccgcagaccacggcgtatttctcgaacgggcgcaggccgggcgtggttttgcgcgtatcgacgatgcgggtgcgctcgtagcggcgcggccgggtgacgggtccgtcataatcatcgccgtagatggcgttcaccgcgtccacgaaggcggcagtcatggtggcgatgccgctcatgcgctgagtgaagttgagggcgatgcgctcggcggtgagcaggtcgcgtaccgggcctttcacggtggcgagtatctggccgcgctggaatcgctcgccgtccttgatggcggcggtgacggtgacggccgggttctgtgcggcgaaggctgcggcgaacacgtcgatgccgctcatcacgccgttttcgcgcgcggtgaggtgggccgagccggtttcgtccgcggggatggtggtctcgcaggtgatgtcgccgtagggcgcgtcttcggcgagcgccgcttcgacggcgacgcggatgatgtgtgatgtgagcatgggtcagtccttgatgtaggcgacggagtgggcccagttgtcgactggctcgctgtggtcggtgcgggcgtgggcgcctctcgactcggtgcgggcgagcgcggcggtggcggccacatagcctacggtgagcatgttgcggttctccaaagcctcaacgctgcttgcagcaccatcggcgtttacatcagcctgggcgtttgcggcggcgaggccttggccgagttcggcgatggcggttttcagtccggcctcgtcgcgcagcacgccgacgccatgccacatggtgttctggatgcgggtacgattccacaccttgtcggcggcggtatcgtcagcagcagccgtagcggcaggggcggccagcgcgatcggcgcatggtcgaacacggcaccggtggcggagttcaggaacggttcgggtgcccagaccgcgtcgtcaccgtccgcgacggcggccagaccggcgcggcgtccgtagacgagcccctcgagcagcgagttggaggcaagacggttggagcccatgacaccggtacgagcgcattcgccggccgcatacaggccgggaatggaggtccgggcgttcagatcggtgcgaatgcctcccatgtagtagtgcgcggcgggcgccaccggaatcggctccttgctccagtcgaagccaagcgaacgcgtataggcgtcgatggtcgggaatcggtgggccaagaagctggccaggtcggggttctcgcgggccatcggcgagacgtcgagcatcacgggcttgccgccttgcgcctgcatcacgcggaagttctcgcgggccacgacgtcacgcggcgcgagttcggcgcgcggatcgatgtccttcatatacctgtggccatgctcatccagcagcaccgcaccttcgccgcgcacggcttcggagacgaggaagtgctcgcccacggccatggcggtgggatggaactggtagaactccagatcggcgacctgggcaccggcacgccatgcgacggcgaggccgtccgcggtggcgaccggcggattggtggtgtacgggtacatacggcctgctccaccggcggccaagatcacccggtcggcggccagatccttgtcctgcccgtcgatcagcaggtggacgccggcgatgtggccgccccgcacgatgagatctttgaggaaggcgttctcgatgatgtggatgcgcgggttcttgcgcaccatggcggagacgtccagttcaaacactttgccggtggcgtctcccccggcatgcaccacgcgggcgcgcgaatgagccgcttccaggccgcgcagcatgtgtccatgcgcgtcgcggtcgaagtggacgccggccgcggcgaactcgcggacgcgctccgcaccctcacgggtgaggatgtccacggccttcgggtcgcacaggccgtggcccgcggccatggtgtcggcggcatgcagcttcgggtcgtcgtcggagaagatggctgcagcgatgccgccctgcgcatgataggtgtttgattccaccagttcggccttggttaccaaggtcacgtcgtgtccggtgccggccacggccagtgccgcggacagtccggcgacgccggcgcccacgacgacgatttcagtgttgctcattgtgttgctttcctctgtttttgcgtcatctgctcccttcagtccgctacgcggacagctcccctcatgtacgaggagcgccagggacgaatcacgggtgaacgcgcagcatgcgctccagtgccaccttggcttcgcgggcggtgtcttcgtccacggtgatgcgattgaccacgttgccggcttcgaggttctccaaagcccaagccaggtaggccgggtggatgcggtacatcgtggagcaggggcagaccacggggtccaagcagaacacggtcttgtccgggtactgcgcggccagacggttcaccaggttgatttcggtgcccacagcaatggcggatccggcgggcgcgttggcgatctccttgacgatgtacgcggtggagccagtaccgtcggcggcatcgaccacctgcatcgagcactcggggtgcacgatcaccttgacgcccgggtatgccttgcgggcacgttcgacctgttcgacggtgaaacgctggtgcacggagcagaagcccttccacagaatcatcttggcgcgggcgtaatcggccggatcggcggcgccgccctgtgccttgaacggatcccacagcggcatctcgctcagcggaatgcccatcgcgcgggcggtattgcggcccagatgctggtccgggaagaacagcacgcgcttgccgcgggcgaacgcccattccagcacggcgtgcgcattggaagaggtgcatacgatgccgccgttgcgtccgcagaacgccttcagcgcggcggatgagttcatgtaggtgaccggaatgatctgctgcaagccatcggagtccggctgggtgccgcagatctcgccgagctggtcccagcattcctggacctggtcgatgttggccatatcggccatcgagcagccggcggacaggttgggcagggtcacgctctgttcgggcgtggagaggatgtcggcggtttcggccatgaagtgcacgccgcagaacacgatgtggtcggcgtccgggcgttcggtggcgttcttggccagctggaaggagtcgcccacgaaatcggcgtgcttgatgatctcgtcacgctggtagaagtggcccagaatcaacagtttggagccgagacgctgcttggcgtcggagatgcgctgctgcagttcctcgtcggaggccttgcggtattcgtccggcaacacctgctggcgcggcgcgttggcgggcagacggtcgagcatcgaggcaccgggaccgtagctgggtgtggtggtgtcgaagtgccatgggtcctgggtcagtcctgcatcgcaggtgctttgcgcgcccagcttggcgatgatctcgtcaacggacggcgcagtgaatagtgcggtcatagtggttcctttcctatatacgtctgtgataccggcccgaagcgggtcggcgggaaaaatcagatgcgcgcggatgggatcagcgcgtcgagagcgtcttcacgctcgccttgtctggacagttccacgatgtcgtcaccatcggattcgtggggcgtaccgttctcgacaggtcgtttggggatgtagcggtagacggtggccggtcgttggcggccttcgcgcatcttctccccggtgtcttcaaggtcgcccgaggcaagcattttgcggcggaagttcgccaagtcgaggggttcgccgccaatcgcctcatagacgccgtgcagttggcgcagggtgaacgtggggccgagcagtcgggtggccacgtcggagtattcgattttggagcgcaggcggagcagcgcgtagtcgatgatctggcgatggtcgaacgccagctcgggcagttcgtcttcggggaaccatcgtacgttgtcaccgtcctcgaagcccgcggcctcggtctggccgacgagcgcccagtacacgacggataccatgggcaatccgccatgggaccgggtcgggcctccaaaggtgtacagctgttcgaggtatcgcgggtgcaggtctgtggtcgattcgagggccgcgtaggcagactgttccaacgaccggtcggagcgcaggtcaccgccgggcaacgcccagcagcccaggaacggctgacggacgcgcttgaccaggggcaaccagagacgggaatgggccgagttcgcggcgttgccggaatcggcggcactgttgccggtatcgtcttccgggccgagtgccagaatcaccactgacacgccgacctgtggcggtgcgctgcggcgctcggacacattgccgaatcccatgccatgcctctttccataccggttgttctccctgcattgagagcatagcactacttatagtcacaatgaccataaatcacatatcggatggtctagcgcacgaatattggtcaggcagcgggccccaatcgctacgaaatcacgtccgtatcttccgatttcgactgtgtcatttcggcgacggacgggaggaatggcgctagggagggtagttcgtcgagactcttcagacccatttggtcgaggaagaattcggaggtgaccaagagggccgcgcgggattcggggtccacgccgtcttccttgataaggccgcgtaccgtgagcgagcgaatcactccatcggagttgacaccgcggatcgcggccacttgggctcgggtgacgggttggcgataggccacgatggcaagcgcctccagtgcggcctgactgagtctcgcagtctggccgtcggtgacgaatgatgagacgaccggctcgaacgcggcgcgactggcgaactgccagccacgagcggtgcggcgcagttcgaagccgcgcgggcggatgtcacgggattcatcgccctcatagtcatcgtgcagggctcgcaatgcctcttcgactgtgttgcgatccaatgccaaaatacgggccagctcggtggcggtctgcggctggtcggcgaccatcagaatcgcttccagacaggcgggcagcccgccgggaaaatcgtctaccgcgaaatccacgtattcggggtgagtctcctccactcccctcaccgcggcctttgcggattcagccgtcgattcggcatccgccatgtgttcggttgtattcgttgcgtcaatctgttcagtcaccaatcgccgtccttacgcaaaatcaccttcggaaatgttcacgtcgctcatcgtttcggctacgccgggtacccacctcaggtgcagttcggcaaacggaccatcttgctgatactgcagcacaccttgtttgaagaacacgagcacggccatgaaccgagccaccacctcaatacgagaagtgcagtcccgggtcaattcgctgaacgatatcgactggtcgcccttggattccaatgccgcgatcagccggtcgcgcaccaccagcgattgggcccgcagatcgaccaacggcacgtgcagctgatggatcggcacttcggaggcgggcgcgttggcgatgacctgggcggtcagtcgggcgagttcgagcggagtcagcgtccataccagctcaggcagcatggcggcaacgccctcgtccatggccgccgggtgcgggaatcggccggagttggcggcgatacgcgcccggaagtcacctgcggcctgcttgtaggcgcggtattggaggagtcgggcgaacagcaaatcgcgttcgcgcagcacttcgaggctctgctcgtcgtgctggctgtcttcgccgccgggcagaatcgccacgcttttggcctcgaccagaatagaggcgatatcgagaaaggcgctggcctcatccatgttttttgtgaaatcgagcccgcgcacgtatgtcaggaattcctcggtgatcgaggagagggaaacttcggtcagctcgagtctgttgttggcgatcatgccaagcaaggcatcaaacggaccggaatagacttcgaggttgacccggaagccggaagtggcggattcctccgtgctgatttcggcttccgcggagctcccctcagcctcgctacgcgagccagcttccctcagagaggggagccgagaaagggaagtctcattcatcgtttatcgaaacaatcgttacgccacgatgccgcgagcaatgagctcacgtgccacctcacggtattcctttgatgtcttgtgctcaggggcatagaccaccacgggcgcggcggcaaccgtggaatcgggcagtttgatggagcgggagatgaacgtgtggaacaccttttcgctgaacgcctcgtaaacgcgctggcagacctcttcgcagtgcagtgtcttggtgtacatggtgatgagcacgccatccacttccaatgcgggattgatgcgggactgcactttttcgatggactgcataagcagggccacaccgcgcaaggcgaagaattcggcggccacgggaatgatcacgccatcagctgcggcaagcgcgttcacggtgagcaggccgagcgatggctggcagtcgacgatgatgagatcgtattcagacttgagcttgcgcagcacgctgttcaggatctgctctcggcccacttcggtgaccagctggacctcggcggcggacaaatcgatgttcgccggaatcacatcgatgttctcgaatgcggtgtgctgcaccacatcatgtgggtccacggaaatatcgaacagtgcggtgtaaatcgtgttctccacggtattcgcgttgacgcccagtcccacagtggcggcaccctgcggatcgaaatcgacgataagcacgcggcggccatactgggccaacgcaccggcaatattgatggagctggtggtcttacctacgccacccttctggttgcacatggcaatgacacgcgccggaccgtgctgttgcagcggttcgggtgcggggaaggtttcgtattcacgtccaagcaaatcggtaggcatactgtctaccttatcaacatccgggttcgctgggggtgcaacgacatacgttcctgtcataggcagcgttccttgacggaatgcgctgtctttatcgcgggtatctcgccagtcgtccatcgttgccctcgccccctttgtcgggaatacctgctcgcccatcctaatgtactcgccgggctcgcctcggaacaccgttttgccgctggtattccagtgttccgaggtttatggatctcgtctcgtactatgtcgatgcgcttactcggtgcgcagtgcggtggccgggtcttgcttggctgccttacgcgagggaatcaggccgccgatcagcgtgagcaccacgcttaggatcaccagcaccacgccaccggtcaccggcagggcggcattgacgtccgcattgccgatgaagtggtgtagcacggcgttgatcggaatattgagcagcacggtcaagcccacgcccaacaggccggagcataggccgatgatgccggtctccgcattgaacacctgggatacgttgtgcttcgaggcacccattgcgcgtaggatgccgatttccttggtgcgctccagcaccgaaatgtaggtgatgatgccgatcatgatcgaggagacgatcagcgagacggacacgaacgcgataagcacgtaggaaatcacgttgacgatggtggtcaccgaactcatcatgagcccaacgtaatccgtgtaggtgatcttgtctttcttcgagacggtgttgttgtagtcggtgatcgcgtcggcgatgtggtccttgtcttcgaagctgtcggcgtagatgttgatcgagctgggcgcgtcacgactcaccacaccgaatgcggcgaggttgtcgtcgtaggtgccggtcgacacgtactggtcgtagatcgcgacaagcacgtcgttcgaagccgtggcgatatacgcgtcgaaactgtcggcgagctgctgttcgctcatcgcggccatggcggcggcctgatcgccggcacccgccgcgccagcgacacctgcagcaccagcaccagcggcgtccgatgcgcccgtgccggactgctgcccggcgctcatcatcgacttggccatgttcgccttctgcgtcacgcccagcgaagccacgtaggtgcgcgcgtcggccaccttggtggcatcgtccgagggcgagaacgtcatgccgttgagcacgttcgtgttcgggttggccttctgatcggtaacgatggcgctggaggccgcacggtcgatcaaatcattggtcagagcgcgcgcgtaccccacaccagcggccaacggcgtggccgaagcatccttcttcgccttgacgacgcccaccaccttgagtttggtggccgtttcgaggcgctgttcgatttcgtccttgtcgttgccgatgaaacggtagtggccgtcatcgcccttgacgtactggtcggatgccggaatcatgtacagcgtctgatcgagggccttagcatagtcgatcttgtcttgtggagtgctgaccttgtcgccggcgttgagcttggacatcatctcgtggtaatcggaggcgggcagcaggccgagctcgtacagcgtggtcagcggcacgctgttgttgtcgtcaagcaccagcaccacttcatccttggacttcggccatgaaccgttgaccacctggtagttgtcggtgataaccttgcctacgagcttgctgtcgtccgctcccggcatgatctcgttgaacgagtcgggcgcggcgttctcatcggttttgccggtcagcatcgacatctgctgcgaggtgatcgacgaggtgccggacatgccggacgagcttgtggacgccatctgcgaggctatcgaggcagagtcgctggatccgatcgtcacgccgtccgcattgaccagcgtgccgtcggggtcgtggtcgaacacggagaatttcacgtcatatgtgtactggatgccggtggaacccacatactggtgaatctcgctcttggaattatccaggtatttcttgaagcgggtcaggttgttttcggtaatcgaactggtcaggctggacgcctgcttgacgctgcggtcgtccgggtagatgccgtcggttttgtgcgtcttgccgccgtatccgtcatcgccgcccatctgtccgcccatcatgctgctcaggtcgaaggtctgggagtcgacggtgatcgggtaggcggtcatcgtgtcacgctggatgtcactgatgtatgtgttcacgccagtcgacaccgatagaatcagcgcgatgccgatgatgccgatcgagccggcgaacgaggtcagcagggtgcgcgccttcttggttttcagattgttgaagctcaacgccagcgacgtggcgaacgacatcgacgcgcggcccatcgtcttgtacacggccggctgttcggccgtctcgtccacgacgaacgggtcggagtcggagcggatcacgccgtcgcgcaggttgacgatgcgcgtggcatattgttccgcaagttcggggttgtgggtgaccatgaccacgaggcggtccttggccacgtccttgagcaggttcatgatctgcacggacgtgtccgaatcgagcgcgccggtcggctcgtcggccaggacgatgtccgggtcgttgaccagtgcgcgggcgatcgccacgcgctgcatctggccgccggacagctggtttggcttcttgttgatgtgttcgccgagtccgaccttctccagcgccttgcgcgcacgttcgcgacggtcggccttgccgatgccggaaatcgtcagcgcgagttcgacattcgacagaatcgtctggtgagggatcagattgtagctctggaacacgaagccgatggtgtggttgcggtacgaatcccaatcgcgatccttgtattggcgcgtcgagatgccgttgatcaccaaatcgccgtcgtcataccggtcgaggccgccgatgatgttgagcaaggtggtcttgccggaacccgagggacccagaatcgcgacgaattcgctgtcgcgtaggttcaggctgactttgtcaagcgcctgctgaacgaaatcaccggttttatagcgcttcgagatcgatttgatctgcagcatgaatacctcttcctggctgacggttcgctgttatgtactgtattgtcacgccttgaatttccggccgactttggtgctcccccgccgcgattccgctatgggcggacgcgtcgcaaaatggtgtgtctcaccgcgctctgggatgtgaggtcagatacgtttcgatcagggtttcagggcttacgtgcgtgtagatctgcgtggtggtcacgctggcgtgcccgagcagttcctgcacggtgcgcacgtccgcgccgccttggatcaggtgcgtggcaaaggaatggcgcaaggtgtgcggatggagtggtttggtgatgccggcccgctccccggttgctttgacgatttcccataccgattgccgcgagatgcgcttgccgcgtttgttgagaaacagtgcgcgcctctcgggaatcttggcgctggagcgctgttccaactcgccacgccccgcattgaggtatgcggtgatggcccggcatgcgtaactgcccaatggcacaagccgctgcttggagcccttgcccatgagtcgcgcgatgtgctcgtccaggtcgatgtcgtccagattcgcaccggtggcttccgagacgcggcagccggtggcgtacatgaattcgagcagggccttgtcccgtaataccaccggatcggttgagccgccgactgccgccgcgtcgagcagacgggttacctcgtccacggtgagtacgtcgggcagggtgctggcgcctttgggcgccttgactgcggccgaaacatccgccgtcaccgcgtgctgaccgagcgcgaaacggtggaattcgtggatcgaggccagtcttcgggctttggagcgggcggactcccccgcctggtcaagggcggcgatgtagtcttcgacgtcttgtttggttatggcgtccggttcgtggatgccgcgggtttcgagccaatcaatgtatttggcgatgtcggattcgtaggcggtgacggtggccgtggcgagccctcgctccacgccgatgtggacgaggaactgctcggtgagtctggtgaatccgttggtcatagtgcccatggtacaaagaaaccccgctcggaagcggggtttctagtgtgaagtcacgacttcaagcaatcaggcctcaaccggagcgttgacgtcctcaggcagggcggccttggcggcgtccacgatggtcttgaaggtgtccgggtcggagacggcgatctcagccagagcgcgacgatccagctcgatgccggcgagacgcaggccctggatgaagcggttgtaggtgatgccctcagcgcggacggcagcattgatgcgctggatccacagcttgcggaagtcgcccttgcgagccttgcggtcacggaagttgtagttaaaggagtgcagcagctgttccttggccttgcggtacaggcgggagcgctggccacggtagccggaagccctctcgagaacaacgcgacgcttcttgtgggcgttcactgcgcgcttgacacgtgccataatctattcctcagctttctaaagtcttgttatttccgggtaagccctatgctcacttctgcagaagctggtgcagcttcttggcctggccgccgcgcagcacatcgtcggcggacagttcacggcgcttgcgagcggacttgtgctcgaggttgtggcgcatggcggaaccgacatgcttcaccttgccggtgccggtgatcttggcgcgcttggaagcggcggaattagttttcatcttcggcattgctgccctccttgctggtttgcttcttgtcggaagtcttctgagaaatcgcggactgcgcgtcggccgcggcctgagcctgagactcctgcttggccgcgagacgagccgcctggcgagcctgacgctcggcgcgggactcggcgccacgacgacgctgctcggactgggtgtgcaccttcttgcccttcggcgcaagggtcatgatgatgttgcggccctcctgcttcggcttggactcgacggtgccgtattcctcgacatcgtcggccagacgctgcagcagttccacgccaccaatcgggcgggagatctcacgaccgcgcaacatgatggtgaccttgaccttgtcgcctccgttaaggaagcgggtcacatggcccttcttcacgtcgaaatcgtggtcgtcaatcttcaggcggaaacgaatctccttgatttccgcggtgctctggttgcggcgagcttcacgagccttgatcttctcgttgtacttgaacttgccgtaatcaatgagcttggcgaccggaggcttcgcgttcggggccacctcgacgagatcgaggtttgcctccttggccaggttcagcgcgacggaagtcgcgatgacgcccacctgctcgcccttcgggccgatcaggcgtacctgcgggacgcgaatctcgtcgttaatacgtggttcgtcgctgatgatgactccaatcctctacttcaattccgtggcgagggcctttgctggagtcctgttcaatgctttgggttcatggcaagccaaagcccgcgccaatatgcgctcagcttctgcagacgcatatcagttctttgcgtcattcctgattacgcgttgtatatcgcaatcgctaggctgtttgccttgaacccgaggccttgaaaggcttccaggtggggttgccccgctttcttgatttctcaagccaaatagaaagtctaccatacgcccggacattcgcggtccgtgtgtcgaacctactgcacggcgcgcagcagaccgccgaagccttcgtctttgagaatctgccgatatgggccggcctcatcggcgatgatttgatcgatggcatgcatgccgagtacttcgaccggcgccttgtcgtcggtgagaatagtcgacgctgagtccggttcgttcaccttccggaatcgagaggcgacctcttccatataccattcgagatcttcgctgccggtgcgctcgtaggtggtctcacgcaggttgagcgccttggaggcctgctgcatggagttctcttcggagccggaacccggcttcttggcgaacagttcacggttcgtggtgttcggcacgtcggccgtcagtgtgttcccattgccgaacacgctggcgatggtatcgctcaacgcctcgttgatcgaaccttggccgtccgagatcatgttcatgttcaccaccatcacgccgccggggttcaggtgctctctgaccatggtgaagaactcggtggagctcatctggaagggaatggtgatgtcctgatacgcatcgaccatgatcacgtcgtacttgtcatgcgaggcggcgagccaggctcggccgtcatacgtggtcacggggatgtcggcgggctcatcgaagtattcgccggccagatcggtgatcttctggtcaatctccacgccggtgatgttcattttcggataatactgcttcagctggcgggcgtaggtgccggtgcccatgccgaggatcagcgcggaattggcattgtcggcgagcgccggcgcagccagggccgtgtcgtagtacatacctgtcagtcctttgtctttcatcgtgacggactgcacgccgaacagcacgttggtggacaggatcgtgcggtcggagaggttcttgacctgcaggtagttgtagatggactcgccctcataggccaggttggtttcccagaacgcgaagccggtcaggggcgagacgcaggacgtggccacgaagatcacggcgctgaccacgcaggcgatgcgcttggccttgatcgagatgaagtagatcagcggacatgccggagaagaattcggtgatgtagaggaatatctttgatttgagaatcggccgttcgcttgcctcggtgatctgtgccatcgctccgctcccctgcctgtgcgcctatcgactactgttctgatgcgtagcctatcagcattttcccggccgatgggtggataccggctacagtaggcatcatgactcaggtatgcgtgatttttggtgcgggcgaatactatgcgggcacgcccgtggtgccggccggcgcgtatgtgattgcggccgatggcgggctcgaccatacgcgccagttgggtatcgtgcccgatgtggtggtgggcgacttcgattcgctggagggccggccgccccgcaccgatgtgcgcaccatcgcgctgcccgcgctgaaggacgatccggacatgctctccgcgctgaaggtcggttggtcggcgggttgccgcgaattccatgtctatggcggtttgggcggccgcattgaccatacgatttccggcattcaactgatggcattattggcccggcatggggcaagcgggtatctgtatggtgatgggctcatcgtcacggccatcaccgatggtaggctttcgttccccgcgcatccggtgcccgaggacggccgcatggtgtctgcgttctcccactccgatgtttcgcttggcgtgaacgagccggggctgaaatatgagcttaaagacggcacgctgaccaatacggtggtgcagggggtaagcaacgagttccgcgacggcgtggacgcggccatcagcgtggagcacggcacactgatcgtcaccttccccatcgaggtggcgttgcctcaggtgagtcgattccacgaatttggcggcgatatcggcgagctggacaccgcagtgtccaagctgctggttcgctgacttgcatgccgcgcgcttgctcatgatgattcgagacattcctccaaaggagaggaaaaatcacatgtcggttgcgggcaatccgaattgtgagcgctcacagaaaatacggcatttttgcccaaaacgcacgctgaaacgttgccatgtgtacagagtcggcattacagtagcaactgttggtaaacaatggcccggtgtgccaaagcgcgccaaggccaccctacaagggagaattacatgacagttaagattggtatcaacggcttcggtcgcattggtcgtctcgccttccgtcgcatcttcgagctgcaggctcgcggcggccaggctggtgacattgaagttgccgccatcaacgatctgaccaccccggctaccctggcttacctgctgaagtacgacagcacccacggcaccttccgtcatgacgatggcactccggttgacgtcaaggccaccgaagactccatcatcgtcgacggcaaggaatacaaggtctacgccgagaaggacgccaacaacattccgtgggtcaagaacgacggtgttgagtacgtgctcgagtgcaccggcttctacacctccgccgagaagtcccaggctcacatcaacgctggcgccaagaaggtcctgatctccgccccggccaaggatgacaccaccccgaccgttgtgttcggcgtgaaccacgacatcctcaaggcttccgacgtgatcgtctccgccggttcctgcaccaccaactccatggccgccatggtcaagctgctggacgagaagttcggcatcaaggccggcttcatgaccaccatccacgcctacaccggcacccagatgctgctcgatggcccgcgtggcaccaagaccggccgcaacctgcgcgccgccgccatcaacaccatcgcccactccaccggcgctgccaaggccatcggcaaggtcgttccgtccgtgaacggcaagctgcagggccacgcccagcgcgtccaggttccggacggctccgtcaccgagctgaccaccgttctgaacaccgagaccaccgccgacgagatcaacgccgccttcaaggctgccttctccgacaccgattactacggctacaacgatgagggcatcgtctcctccgacatcctcggcgacacccacggtggcgtgttcgacccgacccagaccgacgtcaacaccattgatggcgtgaccctggctcgcaccgtgtccttctacgacaacgagtacggcttcacctccaacatgatccgtaccctgctgtacttcgctgagatctccgagtgaaccattgcggtctaggccgctacggttcgtttgagaactaagctgtgagacccccgccttgtgcgggggtttcttcgtagtagaacggtaatcatggcaaagaaaagcaagcatgataagggcgcgggttccactccggcgacagtccaactggagaaggcgggcgtggaattccacgtatacgaatacgagcactccaacgaccatatggatgacggctacggcgtggaggcggccaccaagctcggcttcgacgagcatcaggtgttcaagacgttgatggcggacaccggtgccgaacgcgtggtgggcgtggtaccggtgagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccagattctggtctccggcggcaagcgaggcctgtctgtgggcgtgaatccacaggacctgctcaaggtcttgaacgccgttgccgcaccaatcggcacgtggtgaccgttcttggctcccctcacggaggggagccaagaatgactacttcttcctgcgcaactccgccggcagcacaaagtgcatgttttctttgatggtttcgacggacttcataccggtgaagcccaagttttgcagagcgtcaatcacaccggacaccagttcgtccggtacggaggcacccgaggagatacctacggattccagaccctcgaaccatgccgggtcaagctcgctggcatcatccacgcgatacgctttgccgcgctcccccaagccctcctgcgccacctccatcagtcgcacggaattcgaggagttggccgatccgacaatcaccacgcaatcggactgctgggccaccagtttgaccgcagcctgacgattcgacgtggcatagcagatatccgaactcggcggctcttgaatccaagggaatttggccttcagcgcggcaatggtatcggcggtctcgtccacgctcaacgtggtctgcgagagcagcaccagcttggtgtcgggcgcaaaatccagcgaatcgacatccgattcatgctcgatcaagtgcacgtgttcggggctctcccccactacaccgaccgcttcatcgtgacctttatgcccgatatagacgatttcatacccctcgcgcacgaaacgcagcacctcacggtgcaccttacccaccagagggcaggtggcatccaccacatgcatgccacgacgttcggcttccgccttcactaccggagatacgccatgggcggaaaacaccaccggaatacccgcttgggcagcagcatccggaatctccgccaattcctggacgaacaccgcgccttgcccggccaagtcctcgaccacatgcttgttgtgcacgatctgccggcgcacatataccgggggcagcccatcctcgcgcgtccgctttccggaagcctccgcggctttgagaatggtctgtacggtaagaatcgcacggtccacacccgcgcagaagcctcgcggatcagcgagcacaacgcttttggtcatcggaacctcctgaacgtcaatagtgttttccagtgtaaggcagggattacaggaatctgccgtcacaacttttccgcgtctcccacaaatcaccggtttccaaggaatccacgtgcttctcgcatgatggtgtgagactcgtcactccacgtattgctaccgtgtttatacgaattgtttattatatgccgcatatcgccaatccccgcctcgatagaggagacgcgctagactggggccagcgatagcaggagctaccggcccaccaacctcactacgggagtgattccatgacgagtaaaacaccacgcaccggaaatcagtattcgattcactatggcgattattccgccgtcatctgcgaactcggcgccaagattcgccgattcgattatcaaggcaaggaaattttctgcccgttcggcgtcaacgacctgacccccacctgtaacggttatgtgctggccccgtggccaaaccgcatcgaaaacggcgaatacgatttcaatggcaagcattactgcgcgccggttaacgaatatcatcccgcaccgcgcaacaatgcgaaccacggatacgcctaccactacatgtggaagcttgaatcgttgaccgatagcgccgtgacgctttcgctgcgcttccccaacttggacggatacccgttcgatgtgaccgtgaccgtcacctacgaactcggcgacaacggcatgaccgcgaccgtcaatgcccgcaatgatggcgacgaaccggcaccgtgggctctcggcctgcatccgtggctggccaacggcaagcagggcgcaactgccgccgaacgcgatgccgactccgccgcctgccacctgcagattaaggccgccagtcatgtgacggtgaacgaggcgctgattcccaccggcaccgaaccggttaccggtatctacgacctgaacgatggcccgacgctcgaaggccgcgcctttgatgatgcctgggttgacgtggagcgtgccgccgatggtacgaccaccaccacattcacccgcccggacggtatcgaagtgaaaatcattggcgatgagacgattaatgcttggcagtgctacaccgccactggcgcaccgttcgccgagcatccgtatggcatcgccgtcgagccgatgaccgccccggccaatgccttccgcactggtgaccacttggtgacgctcgcccccaacggcgactacaccactgtggtccgctacgaagtagtccagaagtagttctgttacgctggctcccctccagaggggagccaattttttatccttatgtgccgccgcgtcttgggacttatgcgatacgattgtgagcgataacaatttgttccacaaaggagtgtgcactatggctttgaagcctcgcactggtaaccaatatgtcatctcgtccggcgaatggagtgccgtcgtcaccgaactgggtgccagcctgcgcgagctgaagtggcgcggcgaagacctcatcgtccccttcgacccgaacaaggtcattccctgctgcaacggctgggtgctggcaccgtacccgaaccgagtgaccaatggtcagtattctttcgatggcgaagactaccagatgccgatcgacgagttcgaccgccaatcctccctgcacggctatgcctaccgctacatgtgggagctcgttgatttgcaggaatcacacgtgacgctctcctggcgctcccccgacatcgccggctacccgtttgatatcaccatcaccgccacttatgcacttgacgagaacggtctcacggaaaccttcaccgtgcacaacaacgacagcgtgaaggcaccgtgggcatttggcatccacccgtggctggccaacggcaagcacgccaccggtcaggccattaccgccgacaacgagtcctgccgtcttgagctgcactgcgacacccacgtgaccgtagacgaacacttgctgcccaccggtgaagagccggtttccggcatcttcgacctgcgcgataaccccacgctggagggacgtggcttcgacgatgcctggaccgatatcaccaaccgcggtgaagacggcagcacttccgccgtgttcacccgccccgacggcatcaaggtcacgctgactggagacaagaccatcaactcctggcaggtgtgcaccggcaacgaaatcggcgagaaggctcgtcaggccggcgtggccgtcgaaccgatgaccgcctacgccgacgccttccgcaccggcaaggatctggttgtgctcgagccggatgatgactacaccaccgtggtcaccttccacgccgaacaaatctgaaaaaccgaataaccaagcctgacgatcatcgccacatggacacccgtgttgcatcacgtcgtgcttatgtggcataattccgaaggcttatttttttactgcagcaaaggagtccatcatgggcatgcgcggacgtaagcgcaaggatcgtcgtaagaaggccgccaaccacggcaagcgtcctaacgcctgattcttcgcgtttcttatggaacgctcaaggcccgtctgatgatacatcagacgggccttgttgtatatgtcgttacttatcttcgccgcagcagtgatcaagcgtggccttgagccgggctatcagacattcgggtgccacatccgggcgcaagtaggcacgcaacgcggcaatcaacgcctgttcacgctcgtcgcagcaggtacgggggtcaaaacagtcgccctccgtaacgatatgcacgtccgcctggaccgacgcagaggccgagccggtatccactgaacgatgatgcaccgccgtgatatgcacttcggtctggctgaccatgccatcggcccccgtacgggttatggagatatggcgagtacgctctaccggctgatcgttcatcagatctcctttcccgaaagcttgcttgactgttgtggcgtgcgggcgccagtcgcatgactatgtctcactgcggcttgcgtgtcgccattgctaccaacagtttgttcactacttccattatggccggaatcggcgattcgaccaacgttttcgcccaacttcgcggatggtgaaccagccgacgaaccagtcacgtacccgcgctctttcgcatacgaggcgagctcacgcttgagttgcgtgcgggcgcgattcaggcggctcatcaccgtgccgattttcacgccctgctcatcggccacctgctggtaggacttgccgtcgatggcggcgtcgatgaacacctgccggcgttccggcgagagtttggcgagcgcggccatgatttcctcgggcgcgaaggcgtccaaatattcctcttcagcggacttgagcccgtccgacgtatgttcggcggcatcgtaaatgtcccagtcgtcgtattcaccggtggagtcgttggcacgctgcgggcgccgcttggccttggcatactggttgaagtaggcattgcgctcgatggtggtcatccacgcctcgaagttggagcccggctggaatgagtcgaaggccttgaacccgcgttcgaaggtgtcctggaccagatcctgcgcgtcatcgggattgttggtcagcctcatcgcctgccggtacagtgcattgacggcgggcatggcgagctgctcgaatctggcgcgcttggctgccatggactcgcccgatccggctgactgcccggattgcgtagttgcttcgcttgtcgtcacgtttcaccattctaatcaaatcatgtgcccatatcgtggtcgatgacgtgtgagccacaacacgctgcaccccacctgtagaatggcgtatcggctagataatagggagtaacaattatggctttgactttggcttcggccgctgacctgctcaaggaacaccatctgctgcgtgaaatcatccaaggggatgtctggaccgacgacccggcccgtatcgcttcggcggatgagccgttcgccggcatcacctacgacacccgcaaggtcacgccgggcaccctgctgtgctgcaagggccgattcaaggccgagtatctgaacggcatcgatgaagccggcctggccgcatacgtggccgaaaccgagtactcagccgcaaccgccgcccccggcctgatcgtcaacgacgcacgtaaggcgatgagcctgctgtccgccgcgttctacggatatccgcagaacgagctcacggtcatcggcgtcaccggcaccaagggcaagacgaccacctcgtacttcacgcaggcgcttatcaacgccgtctccggcggcaaggccgcattgttctcctcggtcgataattgccttgacggccacacctacgtcgagtccgatctgaccacgcccgaatcgatggacgccttccgcatgatgcgcgaggcggccgataacggcatggagtatctggtgatggaggtctcctcccaggcgtacaaggtggaccgcgtctatggcctgactttcgatgtggccgcgttcctgaacatctcccccgaccacatcagcccgatcgaacaccccacgttcgaggattacctgtattgcaagcgccagatcatcgtcaacgcgaagtcgctggtactcggcgcggacagtctgcacgccgatctgttgcgggaggacgcggaggcagccggcatcggcgtgaccaccttcgccctgcatgacgcggataatgccggcaccagtgcggacgtcgtcgcctggcccgccgacccggcacacgcctccttccacatcgccgacggagatcaggcccttggcgactaccatctgtccatcgatggcgacttcaactacctcaatgcggcggcagccatcgccatcgcccatgcggttggcgtatcgctcgatgacgccgacgcactgcacgccatcgaatccgtacgtatcgccggccgtatggaacagttccgcgacccgcagtcaaacacgctcgccatcgtcgattatgcgcacaactacgcatccgtcaccgcgctgcttgacttcgtctacgagcgttggggcgaggaaaacccgcgtatcacgctggtgaccggatcggccggcaacaaggcctacgatcgtcgtaaggaaatcgtcgaggctgccgagaaccgtatcgcgaacttcattttcaccgccgaagatacggacaccgagccgatcatcgacatctgcatggaaatgcaaggctacatcacgaacaaggatgtggtctccacggtgatttccgaccgtctgacggccatcaccaacgccatttacgatgcccgtgcgcacgccgaccgattcaacatcctgctgatcatcggcaagggcaacgagcgttggatcaaggaccatcgcaagcatgtgccgttcgacggcgacgatcacgtcgtcgaacgcatgtttggcttgtgacgggattccggccaatcaaatcctgatcggatcccgattagcccacatcagatcacgcgcaatacgaccaaaccagaaacacgacatacggatacaaacgaaaaaggatagctgaatcgtaatgatcacgttggagaaagttgacggagccacactggaagccgaagccgagaaggccggcatcacgttgcctatcgaacagaccaaggtttggtctggttttcaggcggatatcgacggacgcacaccatggggcaattatctgatcaagcgtgatggtgaattggtcgccgtgatctcctttatcgattttgagacgcacggttatcattatctgcgctcgatgcatgggccggcgtgggtcgccaagcccaccgaggctgaggagcgcgaggtcgtcgacgccatcgtggacaccgtcaagaaggccgacaagagcatcgcgttcctgcgtatcgacacctggttcgccgatggtacggagaaggtgctgtccacagtgccgtacgaccagaccgtggtcatcgacatcaccggtggcgatgatgagattctggctcggatgaagcgtcgtggacgccgtgacgtgcgcaagtctctacgtgaatgcccggccgaggttgccgatgagacggataaggccctgaccgatttctccgaatattacgatgtgatggtcgaaaccggccagcgcgatggattcacgcctgctccgatgagcgactactccgatatgatcggcgcgttgggtgccgatcattgccgtgtgttcgccgcacgtattgaagaccgtgtggtggcatggtcgattgtcaccgtgaacggcacgcatgcggtgcgctactatgccggcatgcgcaacgaggttatgcgtctgcatgtgaccgacaagctgctgtattccgaatgctgcatcctgggctcgcagggtattacggaatacgatctgatgggcatcggctccgatttcgcgccgtcgctcaaggggcttaacgagttcaagtgcaagttcaccgaggaaatcaccccggtggcccccgcccgcgacgtacccatcaagaaggtcttctacaagacgctgcagactgtgcagggcgtgcgcaaggcattacgctaataccaccccgctcccgctggtgggagctgtcgagcgaagcgaaactgagggtggtctttcgagatggaccaccctctgtcacctgtggcgccagttcctaccagcaggaaccattcatttatcgttcgagtttttggctcaccacggctgttacgccgtcggctcgcatggttacgccgtagagcgcgtcggcaatcgacatggtgcgttgctggtgagtaataatgatgagctgcgcatgggcgcgtagctcattgaacgcattaatcaaacgggtcaggttcacgtcgtccaacgcggcctcgacctcgtccatcacatagaacgggctggggcgggcggtgaaaatcgcgaacagcaacgccagcgcggtcagtgaacgttcgccgccggacaggaggctcagctgtttgacacgcttgccggccgggctggcctcgaccagtacgccggtggtgagcatgtcttccgggttttccaggcgcagtcgcccggtgccgcctgggaacagcgtggcgaacatctgctcgaatgcctcggcggtatcgtcgaacgcggatttgaatacctggaccatcgtggaatcgagatccttgatgagctgcatcaaatcgtcacgtgatttgaccacatcgttgcgctgatcattgagatacttgttccgctcctcaagcgcttcgaattcctcggtggccaaagggttgatcttgccgagtgcggccagatcgcggcgagccttatcgagacgcttcttctgctcctgacggttatacggcacggtcttaaagcggtcggaatcgccgttggtgccggtctctcccccggtttctccctcttcggtctcagcctcagcttccgtctcatccaacggcacagggttgccctcatcatccagcacgggcaccggctgttcggggccgtaatcactaaccaattcctccaaagtgagaccgagttcgtcggacactttttgcatgagctgcccggattcggcggccaaccgttcgcggtttacatccaaggcatgttcgcgcccggtcagatcggtgaccttgggctcgatctggttgcgctgcgcgcgcagggccttgagttcctcgtcatggctggaggcggcggcctgcagctcgtctcgtttggcggccacgtcatgcagcgtatgctctaccatggcggccactgctcgcgcgtcatcggccacgccttgcaggtgtgcggcctgctcgcgtctgcgatcgttcaacgcctcgatgcgggcgcggcgttcggcggtttctttggcgttgtcccgcagcagcccggcctgtcggctcagtgactcccctttgcggcttgcttcggtccacgcgatttttgcggcgacctcatgctcgcgagtcaggttcagttcgcgctccagcgtgcgttcgcgttcatcgagttcgtcgaaatcggcatgttccgctgtggattgctgggccgatgccaaagcgcgattgaggtcgtcaagcttgagctgatgctcgttgcaattctcttgggtctcggtgattttcctatccagctgctcgagctgacgggtgaacgatgcgacgcgatctgtggcggatttcagagatttctccgcctgctgggctttgagccgggcttcggtgcgtttggcggattcctggtcgacgagtcgagccgcttcatcgcgcttggttttggcctcggccacttgctcagccattccgccgtcttgggcggtcaactgtttgacctgtgccaatgctttgtctcggcgggcggccagagacaggtccgattgagagattgaagagccgccgaccgccgccacgccgtgtgtgaaggtctcgccgttcttggtgacggcccgcatggcttcgccgaatgccacaatctgttgggcttcgtcggcggtgccggccgcggctacatcagccagcaggagacgcacggtgcgcacgaccgcttcggcctgtgccgggttctcggcatccgggttcgcggtgacgagtgctgccagcgcgttgcccgattgcggggcggcccccgcgttctcggcgctactctcctccgactccgtgcccggctctgtggcgggatcgccggcaatgctcgcggtcagcaccacggctttgccgagcttatcttcccgagcgcgttcgagggcgtgcaacatgttgcctgccgcgggtaccacgatggcgctggcatactggtcgagcgcgtgggccacggcttcttcccagccttcggccacatggatgaagtcggtgagtcggccaagcgaggccacgtccgtatcgcgctccaacgatccggaggcattgcggctgtctagcgtgtcggcaagcgcatcggccttggatttgagcgagatgatcttggactgtatctcgcgctgcttatcggcgcgttcattcagtcgttcgcggcattcggcgagcgttgcacgtgcggcgtccaatgcggcaccgtcatcgtcggcaatggagtccgcttcgctgcgcaatgcgtccagctgttgctgggcatcgtcgcgctgggaagtcagcgagtcgcgttgggaggcgtaatccttggcgcggctggtcgccagttgtacggcggattcctcgcgggcgatgagttcgcgcagtcgggcgatttgcgcatcgcgttcctgtgcggttttgcgcagttccgtcaaggtctggcggactgaggcaagctttttctcgtcgtcggcgcgttcctcggtggccttgtcgagtgcgatgcgcgcatcggccacggccttggtttgtgccgctgcctgagactccagttcctcggctcgtttgacaagcatgccgggatcctcaccgaagttggtgacgatctggccggcgagtgaccggctgcgctcttcggccaactgggcgagcgcgttcagtcgttcacgggtctgcgagaattcatgccagtattggttggccttggcgatggccggactggattcggagctcaacgcctcgacctgttcgatgcgtactttgacttgggcgagttcacgttgggcgacggccagctggttacgcacagcgccaagctcttgacgtaccgtgtcgcgacggctcatcgagcgttgagcgtcttcggcgtacaggcgggcttgggcgtcgcgtacggatatctgaatcgcgtcggcgcgccgggagatacgtgcctggcgtccgagggggccgagttggcggtgaatctcccccagcaaatcgtcgagtcggctcaggttcgtttcggtattggccagcttgcgcaacgcgcgttccttgcgcttgcggtgcttcaggatgccggcggcctcttcgatgaacgcacggtggccggacgggtcggccttcagaatcgcatccaatcgtccctggcctacaatcacatgcatctgctggccaagaccggtatcggagaggagttcctgaatgtcgagcaggcggcattgcgagccgttgatcgcgtattcggagcctccgttgcggaagatggtgcgggagatggtgacttccgtgtaatcgatatcgagcgtgtgatcggaattatcgatggtcaggctcacctgtgcacggcctaatggcgggcgggaggacgtgcctgcgaaaatcacgtcctccatcgaagtgccgcgcaggtttttggcgccctgctcacccattacccagatcagggcgtcgacgatgttcgacttgcccgaaccgttggggccgaccaccgccgtgatgccgggctcgaagcgcagcgtggtgacggaggcgaaggatttgaatccgcggagggtgagttccttgagatacatggcgtgagactgttttccgtatgccgggtgtccgggtatccgatatgccttggatgcgggttaccgggcgtcggcggaatcgtcggtgtcggcgctggctgtgtcagtgctgtcggtgtcggcactggccgtgccggtgccggcgttaccggcgtcactggcctgttccttaccgaggccgaggacgtcgaacacgtcgaagtcgtccgggcttaccgaatcctcgaggttgtcggcggcctcatcctcggccttgtctgccggctgatccgaatcgtccgggtcaaccgccggctgatgaacggccatagcctgcctcatcgtggggctggcgtgttcctcaagcatcaggcgtgcgtcgccggcggtgacgaagctgccgcagataagcacgccgtggccgtagcccacgcccagctcgtcctcggcatcgaccatattgacggcggtctgaatcgcgtcaggcaggttcgcttccttgatcacacggtcacggccgaacacgtccacggcaatcttctcaagctcgtcggccggcatcacgcgctcgcgccacgagttctcggtgaccaccacggagctcaggatcggctccagaacacccagatattcctcgacctgcttgtcgcgcatcatggcgaccacaccgaccagctgcttgaagtcgtagctttcctcgatggccttgcgcagggcttcggcggcattcacgttgtgtccgccatccagaatgatggtcggtgaggtgcggatctgttcgatgcgtccgggaatcttgaccgagctcaacgcctcggccaccaagtcgccgtccagcgggccgttgaccggaatcaccacttcggaggcggcgagcgcggcaagcgcgttgtgggcctgatgctcgccgaacttggcgatcggcacgccctcgtaagtgccgttgggcgtggtcagggtggcgacttggccgccgactgcggccatacggtcggacgcggtcatttcgtagccgtcgcgcacgagcatggcgtggttgcgttcggcggcttcggcgagaatcggcatgacggcttcctcatgcggctgcgggccgatgatggcggtgcagttcggcttgatgatgccggccttctcggtggcgatctgttcgacggtgtcgcccagccactgcatgtggtccatgtccaccgggccgatgatggccgcatccgcgttgagcacgttggtggcgtcccacaggcctcccatgccgacctcgacgatggccacgtccacgggcgtgtcggcgaacttccagatggccatggcggtgagcacctcgaagaagctcatcttcggcttgccttgctcctccatcttggcgtccaccagggccacgagatccttggtctggtcccagatgtcgatgaaatcgtcatcggacagctgctggccgtcgatggcgatacgctcgttgatcttctccagatgcggcgacgtgtacaggccggtgcgcataccgtaggcgcggcagatggcctcggccatgcgtgcggtggagcctttgccgttggtgccggtgatatgaatcacgcggaacgactgctccgggtggcccaggatgtcgagcatcaggttcatccggtcgagatccagattggtggtgttatgctccggcgggcggctcatgatgtccagttcgacgtcccgcatgctctcattgttccgattcggatgctcgaatgacatatcctcttctaacctctgctcgtgttgctgttgcgccgttcggagtgcgtatgccacttacgtgttcgcgccattctcgtcatgtctacgcatgcccgcatatattccgcttccgcatgcgcaggaagctccccttgcacaggtttgccccgcatggttcgggattcttgccttcacgcgtggagccgcactccctcaattccctctatcctagccgccggggtggtttatcgtgcgcgcacagtgaaaccgtctaatatgtcgccgccgcgcgggcagtctctacctgcagccacgcacagtgaagccgtctcatatagttgcaatgcggctcttgccgtcggcatctcattcttaatcggctgcaatccaaaacttgtatgtccggcgacgctgatgctattcagcgtcggtacagtgccagcttctggcggtacaccgacgctatgatgctcttgcgagtcggtggctggccaaaacctggattaatcccgactccatcgcctctcagtgtcgtctcctcgccaaggcatgccattctgccgtcgttgagaaatttcaacgtcgtcaatcgaccatgtcttgccccggaaacgactctcacaaacgtcctctacatcatcttttgaactcgcagaggctcattcactgttatgactgctctcaccgtcggcagccgtccaagccctggatctatgccgccaataaattgcagcaaatcgtcggccccgatacaaccattggactcacgccgacgctagattccacactcagacagaagccagccaatatctgaaccagcaccgacggcgtacaaagcataagcaccgttaaccgtcaattcgccgccctctaccagctacatccgccttcgccgatgatatcttgttcgaatccccaaagcacgttgttcgaatgacattactgatggtggataagttttgtgtgttatccactattccgaattagcggcctaataccttgaaattatcgggagtatctcgctccaagacagccaagctccgaggctagaaccacaatggctgaaattcatacttacgctgcttcgttccggctacgctcgacgtcatgaagacacacaaagcagtggcctcgctcatatcagccgcgcagaatgagctgagatgcgtctattcaagaaatgaagcggaacagaccgctctacgccgccgtgcccagagtggcgagttgttgaaagtgtatgacggcattcccagtctttatgcaaataccgcatactgggatggtttgacgccgccggagcgaacgttgcatatggcccgcgctcttgcgcaagagcatcctcagtgggtttttggcggcttggtggcagtaagtgcctatggattcgaacatcaatggcatttgcatgatgactgcataaccatcgtgacttccgatcatggatctcgtcaatgccatcagcgcttacgacatgtctatatgcccgatatgaacaatccgaagacacatcacgaggcctccggcctatccctgatatcaccggctagaaccttggtcgaggccgccatagaccttgattttcggtttgcgttgccgatctttgactcggcccttgccaagggaataaccaaggaagagatagccgccgactgcgttcaatggagaatcgattatgcccgagtattccgcctgctgcgctatgcaaacgaaaggagcgagaatggtggagaatccctcgcgcgaggcaccatcatcgaagatcgcttcctcacgccgcgtattcaggtaacggtgaccgacccacagacgaataccgagtaccgcgttgatttcgtatggaagctcgatgacgggcgcgtgatagtggccgaatacgacggcacacaaaaatacgtggacccagccatgaccgataaccgcagcattcaggaggtggtggccaaggaacgcgcacgcgacgagggactgaaacgagccggtgccaccgaaatcgtccatttcacatacgccgacgtcatcgaacgtactccgctgcgggtaaaactgatcaaagccggggtgcctcaggtggagacctccgcatagcagtgagtcccgcgacgcgataaaccttcatcgcatgggttcacatggattcagcccacagaatatgtcaatatcaatcggcaagctccagcccaagcccatgcccctctccttccctaccgagaacaataaacgggcccgcattccagcccgccgcactcgccatatgggcatgtccggaagaccgtccaaattccgtacttggttttaccgtcagccgtcaatcgtggcacatcgcataaagccgactaatatgaggtgggaatcgatgattcgacaacaactacatacaggagagtggcaatgggtgaagtgatcaccgccaaggacaaggaatatgaggccgaagagcgcgctacggcaccgggcgcgaaccagtcgatgagcgaccgcgtgaacaaccgctcgctgcgcccgcagtcggccgcattcaaggagttcatgaagtccggctgggccgacgatgatccggagattaatcctctcgaatcctccaagttcacgccagcccgccttgaggcgctgggcaaggccttcccgggcgagcgtctggtcattccggccggccagccgaaggtgcgcaacaatgattgcgattacatgttccgcccggacaccacgttcgcctactacaccggtctgggttccgattacgaggccggcgccgtgctggtcctgaacccggtcgaccccgactcccccgaagccgccgccggcaagacgcacactccggaactgttcgtggcgccgcgcgccgacaactccaccgaggacttcttcatgtccgcccactacggcgaatactgggttggcccgcgtgccggtctcaaggagatgcaggcgatgaccggcatcgaaacccacgacatcgcccagctggccgacgccctgtccaaggacgtgggtgccgaagccggcgccgtacgcgtgcgcgtggtcagcgaaaccgacccgcaaatcacttcgatggttgaatccatccgcgaggccaacggtttcgccgatccggacaagaactccgcatccgacgacaagctgcacgagttcgccgccgaggcacgcatggtcaaggacggctacgaaatcaacgaaatgcgcaaggccgtggacgccaccaagcatggcttcgaccgtctgctctccgcactgccggccgcgctcgacaagccgcgctccgagcgtatcctcgaaggcgcgttcaacgccgtgtcccgtgaactgggcaacgccgtcggttacgactccatcgtggcctccggcccccacgccccgattctgcactggatgcgcaacaccggtgtggtgaagaccggcgacatgctgctggtggatgccggcgttgaggtcgattccctgtacacggccgacatcacccgcaccttcccgaccaacggcaagttcaccgacttccagaagcgtctgtaccaggccgtgctcgactcgcagcaggccggtttcgaagccgccaagccgggtgccacctactccgacatccaccacgcctgcatgcgtgtgatcgccgagcgtctgcacgattggggtctgctgccggtgagcgtcgaggagtcgctgtccccgcaaggccagcagcaccgccgttggctcgcctgcggcgtggcccaccacctgggtcttgatgtgcatgattgcgcgcaggcccgtttcgagtcctatcagagcgcgccgattcgcccgggcatgatcttcacgatcgagcccggcctgtacttccgcgaggatgatctgctgattccgccggaataccgcggcatcggcatccgcatcgaggacgacgtgctcatgaccgagaacggccccgaatggatttccgccggcatcccgaagcagatcgacgacgtcgaagcctggatggccgagcaggctgcccaagcgaagtaacctaagctccctctgatgagggagcttcttttctactaaggaggcaatgtgtccactccggaatttgtgttggaattgcgtaagaagatcggccatgatctgttgtggctcaatggcgtgaccggttgtgtactgaacgaacatggtcaactgctgttgggccgtcgttcggacacgggcgaatgggcgatggtctacggcatcaacgagccgggcgaacagccggcggacacggtggtgcgcgaaatcaaggaggagacgggcatcgatgccatcgtcaccgatttggtggccgtcatctcgtcaaacaaggtactgacctacgccaatggcgacaacaccatgtacatggatcattcgttcctgtgcgccctgaagcccggcggcaatgccgagccgttcgtaggcgacgaggaaagcctgagcgtcggctggttcgatctggatgacctgcccactcccctggcggccagcacgagcgagcggctggagctgttccatacttacatcgagaacaaaaaacacggcgacgcccacgccctgttccagttcgatgggcagcagtactagcggatataaagttagctccctctgacgagggagctccaatgctatgcgattacgcctcttgggctaggagctcgtggaggtgggcgcggtgttgctgctgttcgcgcgggtcgggcacgggcagggaggccagcagcttcttggtgtacgggttctccgggtgctgcataatctggtcggcatcgccgtgctccacgatctggcccttatgcatcaccatgatgcggtcggcaagcatatcgaccaccgccaaatcatgggtgatgaacaggcacgcgaagccgatttccgcctgcagtcgcttgaacagctccaacaccttggcctgcaccgacacgtccaatgcagaagtcggctcatcggcgatcagcagcgacggcttcaacgccaaaccacgcgccaaagacgccctctggcgctggccgccggacagctcatgcgggaaacggttcatgtaggcgcgcggcagctggaccatctccagcaggtcgcccacatagttcttggcatcggccacggaaccgtacttgtggtgcacgagcagcggctcggccacattctccgcgatggtcatcagcgggttgaacgaggagcccggatcctggaacacgaaaccaatgtccgcgcgcttgggcttgaagtcacgctccttgacgccgttcatctcgatgccgagcacgttcagggagccgccggacaccttctgcaggccggcgatggcacggccggtggtggacttgccggaaccggactcgcccaccaggcccagcacttcggagcggtggatggtgaagttcgcgccgtccacggccttgaagtcgggctgcatgagatggcccgggtacgtgatggtcaggttcttggcctcgacggcgatcggctgttcgcgccaatcggccttgcgctcgatcggtttgccctcgcggtcgcgcacgaccagcttctgaccgatgcgcggcacggcacccagcagtcgcttggtgtagtcgtccttcggatggtagaagatctgctccacgtcgccctgctcgaccacgtggccgcggtacatgacgaccacctggtcggcgatgtccgcgatcacgcccatgttgtgggtgatgatgagcacggaggcgtcgaactcgtcacgggcgaggcgcagcaggtcgagaatttcggcttgcacggtcacgtcgagggcagtggtgggctcgtcggccagaatcaggccggggttcagcaccaacgccatggcgatgacgatgcgctgcttctggccgccggagaactggtgcgggtagtagtccacgcgggtttcggcatccgggatgccgaccttcttcaggatgttgatggccttggcgcgcagttccttcttgtccttcatgccgtgggcgcgcaggccctcttcaatctgccagccgatggtgtacaccgggttcagcaccgaattgggctcctggaacaccatcgcggcctcggaaccacgcacttcgcgcagctgttcgccgctcagggagagcacgtccagcgaatcggagccatcgcgcttggacaggtagacggcaccggaggtggtggccgtctccggcagcagcttgatgatggagcgcgcggtcacggacttgccggaaccggattcgccgaccacgccgaccacggtcttgcgcggaatggtgaagttcacgtcctcaacggccttgatggagccggcgtcggtcatgaaggagacggacaggtccttgatatcggcgagattcttgttgttttcgctcatctctcactccttgccttccggcttgccctcgccggtccattcggaggcgacgatggtcgggtcatggtcggtgacggtggccggcgggtcgacgttcgcgtcgagttcggcaatcacctcgttgcgtgcggtcggcttctcgtttgggtcgacggacgtgtcttcgatcgatccgaccacttcgccggcggacttgcgggcgcgcagacgcgggtcggccagatcgttgagcgattcgcccacgagcgtgatgccgagcacgatgagcacgatggcgatgcccgggaacacggcagtccaccagatgccggcggtcacgtcggaaaccgagcggttcaggtcgtagccccattcggcggcggcggtcggctcgatgccgaagccgaggaagcccaggccggcgagggtcaggatggcttcggacgagttcagcgtcaggatcaccggcaacgtgcgggtggagttcttgaacaggtgcttggtcatgatgcgccaggtggaggcgccgaccacgcgcgcggactcgacatacgcggattccttgatgcggatcacttcggcgcgaattgtgcggaaatactgcgggatgtacaccacggtgatggagatgccggaagccagaatgccgctccacaggccggactggccgtgggagatcatgatggccatcagaatggcgagcagcagcgaggggaaggagtagacggcgtcggcgatcatcaccagaatgcggtccacccagccaccgtagtagccggagaccaggccgagcagcacgccggcgaagatggagagcagcacggccacgacgatggcgatgacggcggtgcgtgcgccccacaccacacgggagaacacgtcgaatccggcggcggtggtgccccagatgtgttcggcggagggtgcggcctgcgccgggaaggacgtgccgtcggcggccttgatctgggcgtggccgtagggggcgatcagtggggcgaagagggccacgagcaggaagaacgcggtgatcgcgaggccggtgatcagcatgcccttctgccagccgaccgccacgcgcagttccttgatgattggaatcttggtccagaacggcgtcttggtgctgacgttgagcttggtgaggcggtcgtcaccgggaacggtgatcttgtcttgggatgtggtggtcatctcagtacctcactctcgggtcgataagcgcggcgatgacgtcgacgaggaagttgacgacggccacgatgatggcgataaggatcacgatgccctgcacggccacgaagtcacgggccttcaggtactgggacagcatgaagcccaggcccttccattcgaaggtggtttcggtcaggaccgcaccggcgagcatcagggcgatctgcatgcccatgacggtgatgatcgggatcagggccggtcgccaggcgtgcttgttgagcaggcgcttttcggagacgccgcgcgagcgggcagcctcgacgtagccggaattgtaggtggagatgacgttggtgcgtaccagacggatgaacacgccggcggtcaggaggcctagggcgacggccggcagcacggcgtggcgcagcacgtcgacgagcacgttcatgtcgccgagctggatggcgtcgatgatgtagaagccagtcggcgataccagacgggtgaactgcatttcggagttcaggtcggagcggccggaggctggaaggatgttgagccagacagcgaagatgagcttcagcacgaggccgaggaagaacaccggggtggcgtagcacaggatggcgaaggtgcggatgccggcgtcggcggcacggtcgcgtttgcgggcggcgagtcggcctaggccgatgccgacaatcagcgccacaatcagggcgaggaaggccagttcgaatgtggcggcgccgtagtgcgtaagaatgctgatcaccggctggttatcggtcagcgtcgtgccgaggtcgccgtgcagcaggccgccaagatagtcgacgtattgcacaatcagcgggcggtcatagccggccgcgtggatgcgctgctggagttcggcgggtgtcaggcggccgcccaaggcggcggaaatcgggtcgccggtggcgcgcatcacgaagaacacgatggtgaccagaatgaaaacggtgggaataatgagaaggaacctcgtcagcacgaagcggaagaaactacctgacagtcggttcttcttcgtcttggctttcgccggagtggtgctggaggtcgctatggcgctgtctgacacgcgatgctccttggtgttggtaatcggtatataaagcaataaaggctcccctctccgaggggagctggcggcgaagccgactgaggggagtcatacgagttgggctcccctcagtctgccgtcggcagacagctcccccccccctcaaagaggggagctcatgctggatcagcccttggtgacggaggcatagcggaagcggaaggaagcgtcgagggtgacacccttcacggaggtgccggtgacggcgacctgggcaccctgcagcagcgggatggtggagaggtcttcggtctcgagcttctgaatctgcttgaggatgtctccacgagcagactcgtccttctcgccggcctgcttgacgatcaggtcgttgacttccttgttggagtagccgttgttcacgaagttaccatcgcggaagaacggggacaggtagttgtccgggtcggagtagtccgggaaccatccaagctggtagaccgggtacacaccgtcggaatcgtcggtaaccacacgatccttgttgtactgggtccattcggtagactgcatgtcgaccttgaacaggccgcctgcctcaagctgggacttcagggcagcgtattcgtcggcggagacggagccgtagtggtcgctgttgtactggagcttgaggtcgaccggggtggtgacgccggcgtcggcgaggaccttcttggccttctcggtgctcggcttgccgttgccgtcgccgtaggcggacttcagcgtgtcatcgtgaccggccaggccgtccgggatgaaggagtacatcggggtgtaggtgcccttgtagaccttggtggagagctcttcgcggtcgatgaggttggcgacggcctggcgcacggccttggccttgttggcgtcggcgtcgggctgggattcgccgtagggctgaatcttgaagttgaaggcgatgaagcgctcctcaccgcccgggcccttgacgaccttgaccttggagtccttggagaggtcctcgatgtcggtcgggctcagggagcggttggccacgtcgatctggccctgctggacggccatcttcaggttggaggcgtcggcgaagtacttgacctgcacggcggagttcttggccggggtcaggcccttgtaggagtcgttcttggcgtaggcggcggactcgttgatcttgaaggcggtcagcgtgtacgggccggcaaaggccttcttggagacgatggtgtcggcgtcggtgagcttgtcggcgtcgaaggtatcctcatcgacgatcgggccggcggggctggacatgacctgcttcagagtcacgtcaaaaggcacggaatccttgaacaccacggtggtgtcgtccttggcggtcacggattcgacgttggcgagcagggagctcgggccgttcgggtcgttgatcttcttgatgcgatcgtaggagaacttgacgtcggaagcggtcaggtcgttgccgttggcaaacttcaggccgtccttgagcttgacggtgaattcggtgccgtcatcgttccaggtaccgtcatcggcggcgatgtccgggctcagttcggaggtgttgtagtcctgggcgtacaggaacgggaacacctggatctgcacggcgtatgaaccgttgtcgtaggagccggcggggtccaggctggtgatcttatcggtggtgccgatggtgatggcgttgccggaatcggcacctgcggtggtgtcatccttcacaccgccgcaggcggtcagggatgcgatggcggccacggagacggcggcggccagaatcttcttggaattcaacaggaatcctctctcataacttgtttccacgtcatcactgcgggcgtggattaccgcctgactatggtgcggatgtgttacctctgcgtttccatagtcatcgacttatgtttcgcttgtggcgaccaaggccggttttatgcggtatcgagcagtattacggattcttgtattacgacgtgaataacggtcacatggtgagacaaatatactatcatctcaccatgtgaccatgttcgtagacgaatgccttccattcgtcaaccggtcggcctactgctacttgagcttgcggcccgcgcaccacacctgttcgaccgtccagtcggccgggtccgcaaggttgaaatcggcggcgaagccgggggcgatgaggccgatcggcgccccggtgaccgggttcggccggtcgaagccgaacgccttggccggcgtcagagttgccgcctcgaccgcgtccaccgggctgaagcccagttcgcacaccgcacggcgcacggcgacctccagcagcagagtggagccggcgatggcgccgttggagaccaggcgcgcatgcccgccgaccacgttcacgtccagcgcgcccaacttgtaggcgccgtccgggcagtcggtggcggccatcgcgtcggtcacgaaggccgtgcggtgaggcgcgaaccggaaggagaggctcaccatcggatcctgcacgtggaatccgtcgttgatgagctcgatggtgacgcgcgggtcctccaccgcggccggaatcggaccgggttcgcggtgatgcaggccgttcatcgcgttgaacatgtgggtcatgatgcccgcgcccgcgtcgaagccggctttggcggtctcgtagtcggcgtcgcagtggcccacggccggcaccacgccggcagcggcgaactggcggatggcggagatgccgtggggcagttcgggggcgatggtgatctggcggatgcagccaagcttgccggaggcggggtcggcaccggaggcctcaagcatcttatcgacgatgtcaggcaccggatccttgagacattccgggtcatgtgcgcccttgcgggccagggccaggaacgggccttccagatggcagcctaggatgtcggggcggccggactccattgtggcgcggacggtgcggatgttgcggcagatcacgtccacggggttggtgatcagcgagagcacctggcgcgtggtgccatgcacggcgtggccggcccgcgccacgtcgatgccgtccggcccgtcatcgaagctcttctcccatgcgccgtgcgcgtggatgtccacgtagccgggggtcagaatacggccttcggcgtcgatgaccgcgttgcgatcggccgggtcgagccccaccgtgcggcagcagtgctcgaaggccccctcccccgtgccggccgccacgatgacgccggcggcatcggagacgacccaatatccgcgccgttcgccgcgcgcatccaccttgcgcgcgttacgaatcgccaccggagccggcttgccctccagtgccgcggtcacgcgcgagactatctcgttcctatcagacatgttgttctccttaccgctcatgcgctcccgctggcgggagccagcacacgataactcagatgccctgccaggccggcttgtgggtgtaggcgtaacggtagtagtccttgtggcgcaggcgggacgcggcctcctcatccacgataatcgtggcgtgcgggtgcatctgcagcgcggaagccgggcagaacgctgacacgccgccttccaccgtctcctcgatggcttcggccttgccggcaccgaacgccagcagcacgaggtgacgggccttcatgatcgtgccaataccctgcgtgatgcagtgggtgggcacttggttgatgtcgttgtcgaagaagcgcgcgttgtcgatgcgggtctgttcggccaaggtcttgacgcgagtgccggaggccagcgaggaaccgggctcgttgaagccgacgtggccgtcggtgccgatgccgaggatctgcacgtcgatgccgccagcggcttcgatggcacgatcataggccgggccggccagcgcgatcttgtcgccgtcttcaagcggagtgccgttaagtacgtcgccgggcacatggaccttggccgggtccaggccgagcggttcgaccacagtgcgatggatggtcgcatgataggactcgggatgggtcagcggcagtccgatgtattcatcaagcgcgaaaccacgcacgcccgaaacgtcaatggcctcgtccttgacgatcttggcgagcgcctgataggcggccagcgggctggagccagtggccaggcccagcacggcgtccggctttgctttgatcaggtccgccacgcaacggccgtagatctcgccggcctcggcttcgttcttgacaatgatgatttccggcatcggtttcctccagttccgtgcggcccgcccgatgcgagtcgctgtaccgccgcccgtcttgcggataatggcaacatccttgtcacgtccgggtgccgcgcggcgttccaaccaccgttcggcgtagcgccgattggtgattcgctatttgttaatgatactaacaattttggaccttatgaacactcacggtgtttcctgacgcttcacacaggtacactggaatttattagtgaagtttcataacagtttcaacgacgaaattgcgcttcaccgtctaagctgtgtatggaacaacaatcgccgtccactcgctcaccatcaggcaggaggaaacatgtcatatctcggtctcaacacaacgaccgacgaccatgcggccaaggcttcccccgccgatgtgcgccgcaagaaccgccaacttatcttcaggttgttgttccccaccaaccagtattcgcgcgccgagctcggccgacgcaccggattgagccgcgtggccgtttccgatgtggtcggtcggatgctggaggaaggattgctgcgcgagaccggtcaggcacccagcggcggcaaaggcaaacgaggcacactgctaagcatcgatatcgatcgactgcgcatcatcagcatcgacctgacgcaggagcacctgctgcacggcgcagtcaccaatctgctcggccagccgctgcgtcacgccgaagtcaccctgaacaccggctcattcgtttccgtggatgtgatcatcgagctcattgagaagatgctgggcatgtccgatggcgaggtcatcggcatcggagtcgcctcccccggcgtggtagacaacggcgtggtccgctcctccacgatgcgcggctggaacaatctcgacctgtccacgccaatcgccgaacatttcggacttgaagtaaacgtcagcaacgacgccaccgcagccatgctcaccgaacgtttctttggccaaggcgggccgaatatgcttttcgtgcgcatcgaaagaggcatcggttcggcgattctgctctcggacacgccggtaatcggcgaactgcacgcggctggcgagctcggccatatttccatcgatcttgacgggccgctgtgcccttgcggcaagcacggttgcttggagacgatgatttccggaaccgcattgaagaagcaactcagcgcagcagacgtggagcagcatcagggtatccttgctcgggcgggccgctatcttggccaagccctggccatgcctgtgggccttttggatatggcagacgtatgcgtctatggccagccgaacatcatcaacgcgacgttcatcggcgcggcccagcaatatctggatgccgccacatcctcgtccttccacaaacacacggtgattcggcgctgcgaatgcggacctgacatcaccgtacagggcgaggccatcgccgtggtcttccaacacttggccaaataaaagccggtcaccccggcaacgaaacgcgcaagaccaagcgcggcacagcacgacataaagcgatataggactgcgtgggagatggggcctcggagacaaatctgaggcctcatctcccatgccccggcactatgccaggctacgccgccatggcggcaccgatggctccgactggttggccgacaggtgccagacgcagccgggccggcaggtccagcgtttcgaggaatcggcattgcgattcgcgccggcgcagctcagccgtgatcacctcgaccaatggttcgccggttttggccatgccaccgcccaagatgatgagtcgcggatcaacggactgagccaggatttgtatggtgtcgccgatggcgcgcactaccatgtccagcacatcgacggccttggcctcccgctttttcgcgcgacgaatcaggtcgggcatcggcgggtcggcgttgggccacagacgccccacggatgcgcccgagcagactgtttccaagcatccgtattgcccgcaagggcacttgaggcgatgaggttcgactgggatatggccgatttcgccggccgcgccgctatagccatgcatcagcacgccgttttcgacgatgcccgcagccagtccggtgccgaagttcaggaacgcaatggtaccggccatgccgtccgcaccgcccaatacggtggccgcgccgacggcggcggcattgacgtcgttttccacatgggccggcacgcccgaacgctgcgagaccaacggccccatatccagcgagaccacgtcgagattcacgatattgcccacatgcccgctggccgaatccaccgtgcccggggtaccgataccgatggccctcacctcgtcaaaacgctcacccgctgcctgatgtgctacagcgacgatgtcttcgatcacggcatcgttgccatgcctggcgggaatacgggcggaacccaataccgtgcccattgcgtcaaccagcacagcttcgatttttgttccgcccacgtcaacaccgattttgagattgttcatagtgttttcagacatcagtcctcccctgttcttcatcgaacgtttcgcttgatatcagtgtgcatccgactattgacaaccatcttaacaaattaccccaagacgacactcacatgcacgacacaccgaatgacatattgattgcgtcaatcaattaacagcgttaatatcttaatcaagttcagattcaaagacgagcggaacaactcgcagcggtgcagacaaggaggacttaagaccgatggcaacaaacaccacccacgccacttcccaggccagtgtctccgaatccaaccgctcccgcatcgtcaagcacctgtatcacaacggcatcagttcccgcgcgcaaatcgccaaggcactggaactcacccccgcggccatcaccaaaatcaccgcacgccttatcgaggccggcatgattgaagagaccggcgatctggaaggctccaagaaccgccgttccatcggactcaagctcaacaccacgcacttccgcatcatcggcatcaaattcgcccgctcgctggtgcagatcggcgtgttcgacctgtgcggcaacaccctgagctttgaaaacctgcccacggtgtgcgacaacaccatcaacgactccatcgtcaccatccaccagcgcgtcgaacaactgctcgacaacgacccgtccatcgtggccatcggcatggcagtgcccggcccctatctgcgtaacgtgggccgcaccgccgtggtgtccagcatgcagggctggcgcagaatcaacttcatcgacgaattcgccaccgctttccgcgtgccagtgttcatcgaacaggacgcccgcgccggcgccctcgcacattatctcttcgacccgtcggtgcacgccgacgacaacctcgcctattatctggtcggcgaaggcgtgggcctcggcgtcatcgacaacggtcgcctcatcaacggcttcctcggtgccgccaccgaaatcggacacatctccattgacgtcaacggccgcccctgcgattgcggcaacgtcggctgccttgaacgctactgctccacccccgccattcacgatacgctcatcgccgatggcaccgtggttcccggcgcggccgatatgacccacaccgaagccgcccgcgccctgttcgccaaagccggcgacggcgacgaagcggcaatcgccattgtccgcgaagtcgcccgatacgtcggctacggatgcgtcaccatcttcaatggatacaatcccgagcacatcatcatcggcgacatcgtgtccgaagccggcccgatactgctcgatgaggtgcgcgccacggtggccgaacgggccatccccgaaatcaatgcctccacttccatcagcctatccaccttgtccgccgacgcggcggtctccggtgccgcagcagtggcagtgacccaattcctcgaacacccctcggtgttcttcgacgtctcctaaaccaagcgccgacatcacaagattttccatacgaaacacccgataaaggaaacaaaggaaaggaaaccaaccatgactaccccgatcgttctgagcctcggtgaactgctgtgggacatgctgccgagcggcaagcgagccggcggcgcccccgtcaacttcgcctaccacgcgatgaagaacggcaccgaaggctgggccatcagcgcggtcggcgaggatgaactcggcgacgaactgattgccaaggccaacgaggccggtatcaacaccgtcatccagcgcaatgcctggccgacctccaccgtcgaggtcgcactgaagaacggcatcccggagtacaccatcgtcaagggcgtggcttgggaccacatcctgtacacccgccagctcatcgacgtggtctccaaggccgacgccgtctgcttcggcaccctggccctgcgctcccccgaatcgcacgccaccatcacggagctgctcaagcacaccaagccgggcgcgatgaagttcttcgacatcaacctgcgcggcgaccactactccaaggacctcatcgaggaactcctcaaggcggccaccgtcttcaagatcaacgacgaggaactcctgctgctgcgcgacatgttcgacatccgcggcacctccggcgaagacgcctcccgctggttcatcgaggaattcggccttgactacgtgattctgaccgccggctccgcctactccaccatcatctcccgcaagggcgaggtctccacgctggacactccgcacgtcgaggtgaacgacaccgtgggtgcgggtgactccttctccggcaccttcaccgcccgcatcctgctgggcgacacgctggcagaagcccaccgcaaggccgtcaacaccgccgcctacgtctgcacccaggccggtgcctggccgcagtacccggccgagatgcccgactatctggctgaaatcggcaagtaatccaaaaccacctattttcccgatggctttgccgtcctataccggcaaagccatcctgttttaaaaaggagttaccatgtccattcgcgacaccgtcaccggcgtccagcatgtcggcattccgaccacggatctcgaaggcaccatcgcctactacgagcgtctcggcttcgaatgcctcggcatctatcccaacggcgaggaccgctgtaccttcctgcgcctgaacaacctgaccctcgaggtgtggaccatgaaccccacgcctatggaaaacggcgccatcaaccacttcgcgctggattcgacggatatcgaagcgtccttcgccgaagcccagaagctcggcctgaacttcgtggaaggctccatccagcacatcgacaccttctggagcaacggcatccgttacttcaacgtactgggcccgaaccacgaggtcatcgaattctgccaaatcatgtaacaccctgatggaacccggcaacaggactatcactattcactagtcatcatccattgatcgatcgatctgtcatacgtccatttatagagaaaaagggaatacatatcatggacaagaccgcatccaagaacgtggcgtgggtggaaagccctgacggctaccttgatcgcacgccagtattgcaattttcaatgacttcggtgctgttcgccttctaggccatcgccgcaagcctcaatgacattcttatcacccagttcaaggccgtattcgacctgagcgacatgaagaccgcgttcgtgcagtccgcattctatgccggctacttcatcgtggccatccccgcctcgctgttcatcaagaagaccagctacaaaatcggcatcatgaccggcctggcgttcttcgcgctcggctgcttcatcttcttcgtggaccgtatctccgccagctacccgctctcgaaggtccgcgagactcgcgtgctgaccgtctacatgattatcggctgcgtgattcttctcggcaccgccttcatcctgccccgccatcgagctgttggtcgtcggcctgtacttcctgactgaattcaagcgcgacacgtacaccccgccccagctcaaggccatggacgagaagaacgaggcctgattccgccccctttgttcgtcattcgtgtgacttcacgaatcgactgaccgcaaccggtgagattctccgaacaggaaatctcaccggttttttcatatggtgtactcacggccacgctcttcacatcctttcgcgtgtcttcaactaaagcggtttagaataatgctgttcccttgatatgtatatccctcaaacaaagaagttgaatttatgacgaccaccgcgataccgaagtcggtctcggatttcttgcagcgcatcacggacctatgtggcaccgaacacgctgattgggccgagaacttcaacgcctgctttgccgataccctgaccaccacggtcaaacggcatgacgacggcaccacatttctgctcaccggcgatatcccggccatgtggctgcgtgattcgaccgcgcaattacgcccttacctagcccttgccgccaaagacgacgacattgcgaacttgatcgccggtctggttcgccagcagttccgctacattaccatcgacccgtatgcgaacgccttcaacgaggaaccgaacggtgcctcctgggacaaggacgatcagtccgacttctccagcccttggctttgggagcgcaagtacgaggtggattcgctgtgctaccccatccagttggcttggatgctgtatgcgaacaccggcaacaccggtcatttcgatgccgaattcattgccggcgtcaagaagattcttgacgtattcgagaccgagcagcatcatgaacgctccccgtatttcttcatccgcgacacggacatccccaccgaatcgctgagcaataacggcaaggggtcgccggtggcgtacaccggcatgacctggtccggcttccgccccagcgacgacgcctgcacctaccactatctggtgccctcgaacatgttcgccgccgtggtgatgggctatctggaacgcatcttcggcggtgagattctgaatgatgccgatatcgccgcccgtgccggcgagttgcgccgcaccatcaccgaaggcattgaagcccacgccaaaacgacgaaccgcaatggagagacgatctacgcattcgagaccgacggcctgggccacgtcaatatcatggacgacagcaatgtgccctccttgatggcggccccttacttgggatactgcgcaccggacgatccgacatatctggcaacccgacgtacgctgctcagcgacgaaaacccgtactactacgagggcgagtatctcaagggcatcggctcaccgcacaccccgccgcgctatgtgtggcccatcgccctgtctatcgaggcgatgaccagtgacaacaaggacttcaaggcgcatatcctcgaccgtcttgtagccaccgacgccggtacacatctcatgcacgaaggcatcgacgtgaacgatccgaccaagtacacgcgcgaatggttcagctggtcgaatatgatgttctgcgaactggtcatggactatttcgacattcgcgtgaaacactaagacgtgcccgctgaatgctcattgtgcacccaccgcatgttctcgttaaggaaaggaacaatcattatgaccaataacccacgttatacgctcggcaccgaagccaaccgcattttcatggcttccgaaacctacgagctgctgaagttcggcaaaggcttcccagcaccgaacggcggttccggctggctgaacgccgacggcaccctcgacccctcccacggcgtcgaaacgtggatcaccagccgtatggcccatgtgtattcgattggtgccatgctcggatacctgggtgcgggcgagctggccgacgcggcgctcaagggattgaccggcattctgcatgacgacgagcacggcggctggtatccgcaggtgttcgcggacggcacccatgcgccgggcaaggtctgctatgcgcatgccttcgtgattctcgccgcgtcctccgccctgctggccgggcgtccgggtgccaaggaactgcttgatgaggcacttgccacgtatgacaagcatttctggaatgacgaaatcggtttggccgtcgatacctggaacaccgaattcaccgagctcgacccgtatcgcggtctcaacgccaacatgcacaccaccgaggcattcctagccgtggcggatgccacaggagacaacgcctatcgagtacgcgccggacgcatcatcaatcatgtgatcggctgggcgaagcacaacgagtggcgcatccccgaacatttcaagtccgattggtcgctggacctcgaatgcaacgtcgacaagaaggatgatcagttcaagccgtacggcgccacgccgggtcacggcatcgaatgggcccgcctgatcacgcagtgggcgttgagctcctttgccaaccttgacggagcacagccgtacgtcgacgccgccgaacacctgttcgcgcgtgccgtggccgacgcatggaacgccgacggcaccgtgggactcgcctacacgaccgactggaacggcaagcccgtggtcaccgatcgcatgcattggacgctggccgaatcgttgaacacttccgccacgctgtacgcggccaccggcgaggagatgtacgccaactggtatgccacgttcgcccagtatgtcgacgaacatgtcatcgaccacgagagcggctcctggttccaccagctcgacaagaacaaccacgtgatcggcacggtctggccgggcaagtccgacctgtaccacgccttccagtccacgctgattccgttcttggacccggccgtgtccattgcgacggccgtgaagaacgctgaataatcgacagcatctaagcctctatatccttttttcctctttctcaacggcgttggcccccgtggaatacgggggccaacgccgtactggtcgcatgtcattgtctgcaagccgatgcaatgaccgttctacgccatggtatccatgggcttggcggtgctgtcccgaatcaccagtttcggggtgaggattcgccggttgccgctcacctgctctccggcaagcactttgagcagcagtttggccactttggcaccgtattcgctggcatcacgatgcgcggcggtaattgacggatacgccgcctcacaaatgaaactgtcttcaaaactgacaatggcgggcagcccattcggatagacttccgcatggccctcccccgcctccatctgccgagcggaataatcttcggccatggcgtgaagactggccgcggcgaggatctccgtttcatagatgaacgcggtaggcggcttcggtgaatgcagcatctccaacgtgagcatcgcggcctgttccgcaacaaaatcggtgaattcgatgttgatggattccagctttcgccgtttggcaaatgcgcggaacgccgcgacacgcccctgtgaataatccaggttcggatcgccggaaagataggcgattcggcggtgtcccaatgacgacaaatgttcgagcacggttcccatcgtgcgtgaatcatcgatggacagtgacggcacataattgttcgggtcgggtcctccggcaagcactgcgcgcacacccagattcttcaacaattccgggcgtggatcatcggctcgcaaatcgacgaggataacgccatccacgcgcttgcgcgacgcccaatccttgtatacgctcatctcctcgttcaggaatcggcatgggcggtacagcaaaccatagcctttggggctgagcgaggcgtgcacacccgccatgaagtgcagcatgaagctttcatccgtgagcccctgcgtggatcgtgcgggggcaaagcctatggtcatggtcttcgaggatcccagtgcttgtgcggcgtagaccggcgtccagccgagcctggctgcagcctctttgacccgacgtttggtttccgcggaaacgccgggccgatcattgatggcgaaggataccgcggtctgcgagatgcctaattcatctgcgatgtctttcaggctcacacgctgcgtgccgtcagacgatgacgatgcctcgcgagcagatctcatgaacactcctttttacgaccgcattgcgactattgcgatacggttgacggcacccccgcattgggccatatgcatcaaccgtgcgctaactcttatgatatcaataattttagtcaatttttatatctaattttggattattcgcataaccactatactttcaagcattttggagtatagaaaaccattcattttaccactaatttaccacgattgaatgagccttgatatgactataaaataacacccaaaagacatcattacacctaaatggtgtctttttaaaaagcagtcaatcataagactaactgctttgtatgtagggatatgaaattgtaaactagattgtctgttatagatttatagtcataatatattcttcgctgttttcatcaacaacaagaaaacctgctttcttatacatttttactgcataattatttttctgaacagataaggaaatttttgaataaccaaaagatttttccactaacaataattgttgcaataatgaagtcccaatcccttgtcttctatacttttgaaaaacagacatagcaagggacggtgtatcattgtcaatgtgtccgtaatcgttcattattcgtacccaaatagcacctatgacatttccttgaacttccgcaactaaagccctatcatcttttcgctttccaaattcaaaaacatattcttgtaattctggacagttaattattgatttaggtggtggctcaacaccgtctggaatataaattgcttcatacaaaaagtcattgagtaaatcatattctgcttttttaatttcccttatgatataatccataacttgactcctaatctattttatcttttttcataccccgattataccattcacatataagcactacaacaaaattttatgcttcaataatcttgttaaaaagttctaagagtatatcatttcatcactccaatctataattttggtaagaaaaaagcagtcaatcctaagactaactgctttatatgtgatataaggttatcagacaatttaccaacaaagtatatactatcgactcaataacataggcaaaaattctactgaaattttttataaataactaaagcattttagtcactggtctcggcatatgtcttgcgacaaaacaaacgggatttagggggggcacccattgggcaacccctaaatcccgcttatggcacgagtatcaacacccgtattgcgacgaaccactccgtcttgctacgagcgcgaagtaccaccgcacccgcgccaagcagcaccaccatggccgccacaatcgcaatgaccgacgaacccgtggcactcaacgaagcgccattcttgtcattgttcttgttgtcgttctggctgggcttgttcggcttggtatcgccaggcttgttctggtcgccgggcttgttcggcgtcaccgcgaccttggtgaattcgacggtgacgcccttgccgatggcattgccgttcagcacggccttcaccgtgtacttgccgaccttcgtggacacgacgttcagcgaagccacgccggcggcatcggtcttgacggtggtgtttccgccaatggccgagacgccttcgggcagtccaaacgccacctcggcattggccagcggattgccgaacgaatccttgaccgttgcctgcaccgtgcggatggccttgccgtcggccacggccgaaccgtcgaccgcggtcagcgtggacttcttggcatccggctgggtggggtcggcgaccgtgcacttggccagttcgtcggcggtcggaatcttcaccggatcggtcttgttgccgctgtaatcctcgacctgcacccgcagttcatgactggcgggggatggacctggtgtatgaggcaggtgtggtacgaccacggataataccagtgattggcggagtgttctgcgagtaggtgtagctagcacccagctggttctcctgctgctgcttgccattctcgccgatccacttctcggtcatgtacaggtagcgccagtcttgagtctcaggacgggccagcgtcacattatcgccattccagatcaccgagcaagccggatacggctcaatggcggcatcggcaaatgcacctgttgccgtagcggtagtgccacctgcattatcgacgttcaccacatagcgggagctgtcaaccggcgcattggcaatcgtcactttgctcttgtcggcggcgaccttgacggtctgggaatacggcttcgcggcgtaacgccacgaaccggtgtcggatttgacggtcacggttttctcgccggatacctgcggattggtccaagagaccttgacgttgccgtccttgcctggttcgactttcacgtcggagacggccgccgcttcgttcagcggcgcttcggtggcgagcgaacgcgagccgtccgcgcccacggcgtagagcttgagcgtggcgatcttcttacccgcgtactgggacaggtccacgctcgcggtcttccagccgttgcctgccgaaccgtccgtcacgtccaccggcaccacggtctcggggtcgtcggcaaggatgaggccaagctgcaacttggaatcatcgctgttgagcttgttgtaggtcaggtcaatcttggagccggcagcgacatccaggtcggtcttgtacaggcgaatggtgttgtcgttggagagcttgccgctcagcaccagcgaatcgccgccttcgtaaccaccgaccttggtgtacttgaagcgtggtacctcctcgtagtccttaccgtagtcgaagtcggcctgcagcgggtcggagtcggcatcgatccaccactgccatgtcggcagaatatcctgcaggttgatgttgccccactgctggtcgctggtccgttcgccgccatcacgccattcgagaccgtgaccggtgttgaacgacgtagagaacatggaaccgccaaccacggagcattcggcgatctgggaagcgaagcccttccaaccgtcattgctcgtgccgtcgtcgatgtaattgtcggcgatgtcagtggtgcccttctcgccggtggacgagccggtccacagtcggcgttcgcggtcgaacacctggttctggtatttcggatagaccttcttgtcgtcgcccagttcgcgggagacgaagtcggcgccgagcgcggcgaggctcacatacggcttacctgtatcgtcgagattgacgttcatatagcccgcattgctgccgatactgtcgaacttcttctgtccggactcgatgccagcaaacaccgcatatttcggatcgatgccgaaactctcggcgtgagcggccgaatccttaagcatgttgccgctgaaccagtagttcaggaagatggaatcagagatcttgcccttgtccgtatcctgcacatacggcgaattgctgccgttgaacatgtcttggtagcctacgccgccacccgggtatgtggctgagtcgtaccactggatgtaaatgccctgatcgacaatctgcttcatgaagtcctggtaggctggaacatcgtcggcgacatcgccaacttcaaaagcgcggcccacctggccgcctgcgccggcatcgctccggccaccggccagtccggcaccagcatcaagggcgagagaccctccagacggggcaacaaacgcctcaggaacgcgctgtggcagtccttgttcgtcgcgtccgccaaacacccgccgtccatcgcctactacaagcgcaaacgcgaacagggcaagcaccacaacgccgctgtcatctgcctcgcgcgccgacgctgcgacgtaatctacagcatgctcaaaaacggcgtcctctaccaggaaccagccctcgtagcctgaatcgggccacacgggaaaggacgccggacgccaccggcagggcgaagcgcgcccacgacagccaaccggaatcccgacacgtcaactccccaaggagttgacaaaaacataggaacacccccatggcattgtgctggtggcgctggccggtgcggccaacgccgccagcgtggtcatcgacaataccgcggccagaccgctgcacagccatttcctgtgttgagcccgggcagaagtacacccagcgggatcgcctagtgacaatctcatctataatctcctttgacttcttccggcttacgccggagatcaaccgtctgcgtactacttcgtccctaccgatgtgggccatgggatacggcgcttcgcatatcgcgccgtatcccaaatactgtttttcggttcattcgaaccggtgttatccgcggcggcggactgcgaatacgctgataccggcgagcgtcataatcacggcgaccgatagcacgacggtgccatcggaaccggtgcttgccagacgtccggttgcagactgtggcttgttgtgtgatgcgtcaccggaactaggtttgtccgtttcgcctgtgcctggctgttgcggcttgggcttgccgcccgttgcatctgcgattgcggtgttgagcgatgccgtccaagagacaacgtcagctccggtatacagcttgctggtcaggccagtgaccgccgcgtttctggccgtggtcagcgttgtccgcacatcggtatcggttgcgccgtcagctagcaatgcatccgccttggctatggcaccggtaagtgccgtggtgtcgatggaggtcagggaaagttcgagcgtcggatcatatgtgttgctgtatccgtcgttccaatccgcgccgagcaccgccttgttcacctcatacaggttggtggccgctgccacggtttggcgcgtttcggctggaacatccttggtataggacatacggtcaaggaagtggttggcagcctgcttggcgttttccagactcatgccttggctttgtgcgatggctgtcttcgtccaaatcagattcgacggtttgatgtgtgccaaatcatcgtcggaataggtgcgtccgtcgcggtcgagcgcgtagacgaacatgcctccgagattgtggtcgtacgagtatgaggccacatcatagaaatgactgtccaggtatggttcggtcgcgtcgttccaccggttattcatgtcaccctcttcggggaaggtcaggccgggaacgaacttggtcgagtcgataaactgttcgtaggtggcagcggccttggccgtccggttcgaatcggaaccgtactgctggtaggcaacatagtcgaagcaatcagaaacgttcttaaacggagcagtgtagctgccattggtgtcgtaaaggaacatcgtgccttccgggttatccgacttcggcccgatgcgcttggcgagggctgtgatgacctgatcggaaatcgccacctgcgcggcatccgggaaagtttccatatcgatgtcaagaccgtcgaggccaaccgaggtcatgtacgtttcgatgacatgatcggcgtacgcgtcataatccgattcggtcgcgctatcgacgtttttgccctgctgagcaatccacgtcttgaaaccgtcgaccataacaccgctgtaatccaaacctcgtacgagtttgatgcctcgggcatgcagatacggcgcgtaatcgctcttgagcttgtcatagaacggctgggccgccgcttcctggccactgggaacgtagctgaacacattgacgacatcgatgccgtatggaatgtcgtacatggagatccaattgtcatccggtaaatcggtgttcacgcctttcatggtcacgtcacgccatgcgcggtaatacaccatgaaatgcttgttgccgttaccctcctgcgacgccgcaacgggggaatccccctcctgggcgttcgcaaccgttcccatggccagcgaacatccgagcatcagtgctgtggcgactacgcccgccgcgacggcggcgagtctgcgtccgatggacgagcgcccttcactaccttgtgagcaacacatatataatctcctttgttgtttcctctatcgggtgacaacccgcagacttgcaggttgtgaggatggatgccttgcggtttcaggctccatccgggggtgtgatgcggttccagtgcttcgcaccccacattcatacatgccccctaatattcccccggcagcgtcgccgtgaccgtatgcgtcgaatctccatccagcgtgcaggtcacctgaacttgcccgtcaccgacatcccgcagacgatcacacggcacgtggaacgcgatatcgcgacgctctcccgcgttcaagtccatgtataccgaatcgacaagcattgccaaacgtgggatgcggcggccgccgctgacatgcgcgaacagattcacggcacccgcggccccgtgatcgtcagcatgtgccgtcacctgcaccagcacttcacctggatgcgattgcgtatcggcgtgcatctcgctgaacgtcaccgccgccagcgaaccggctccatagccgaagccgcgcaatatcggttccgccgcatccttgtagacatgcgcggcactttggcggtcattgtatcgaacgggaatggctgcgggatatgcgggtaaggtcacaggaaggcggccagacatgtcggctccgtcaaccaatacgtcggctacggcctgcggcccatattggccggcatatccggcccagatcgtcacggcggagcgttccagcacatcggtcagtacatgcgcgcgaccgcacaccgccaccgaaacaattggagcggtggtcaatgccgcgacttcacctagcatgtcatcctgacgccagggcaggcggatgtcagacaagtccacgccttcgccgcaggtggcaccgtattcggttacggccttcgccgcgccattgtcgtcgaattcactgtcatagctgcgttcgctggtgctgccgcatacgaataccacggtcgacgcacgcgcccattgatcggccggcgcatcgctcggcttggcggccaagagaacccggtcctccccgagacgtgccaccaattgccggtagacgcttgactgttcatcggcgggcagaggggcggtgtaatcgcccaggaagcagccgaaatcgtcggcgaacgggccggcgacaatcacagggccggcttgagcatcagctatgacgctgcggatatcgtcgagcgtggcggcagactggccatcattgatcagcgttatcgcctcgcgggccatgcgcttggcctgctcacgcccatccgcagtggcctgcgcgatggcgtcggcgctcggcatggcaattgcggcggtatcggcaccgtcttcgggcaagagaccgaacatggctttgagttccagcacccggcgcaaggccgtgtcgacagcggccactacctgttcgtcatccgcatattcttcgaggcgggtgaatccttcatcccacagggagacgtccacgccggcgagcagtgcggcacgccctgccgcgggaatggagccggccatgtcttcgagccgatccacggccaggccatcggccatcacgatgccgtcgaaaccgagctggtcgcgcagataatccttgagcagccacgggttggcgcagcaaggtacagaatcgatatcgttgtaggctgccataaagcccaaggcaccggcgcgcacaccggcggccaccggcggcagatgaatttcatgaagatcgtgcgggcccagtacggcggactgtccgttgcggccgcccacggcctcgccttgcgccgccagatgcttgagcaccacggccactcccccgtggccgaccttgctgcgatgctcaccctgcatgccggtaacgatggcctcgcacatgcgggcagccatcagcggatcctcgccgaagcattcctcgcaacggccccagcgtgggtcacgggcgatgtccaaaccggataccaatgcgatatgaatgccgctggcggccagttctgcggcaaccgcggcttccgcttcctgcaccccctgcgggtcaaacgtagcgcccaaacccagattggtgggcagcaccgtgccgcccagcgcctgatgcccgtgaggcgcctcttcgctaagtaatacgccgatgccgtgcgcgccacgttccagcacagtttgctgcaccacggcaatcgcctcagtccgctcctcagggcgtatgccgttaccccaatgttgaccagaccatgggtcggctcgcaatagaccgtacagggtgccgagtccaccccatcggtcaatctcctgcttgagctcgtccgaggcaaccagccgtcccgcagcattgcgttccacggacttccaaccgagcagacgctggttcaactggccaactttctgcgtgaagctcatcgaatcaatgagtcggtccactgcggcgcaattgatgctcattgagcgcttccccttctcgtatattgtcttctcgttcttctcgctcttcggcgagtaccgggtcttatgttttgccctgcgcactgcaattgtgcgcactgcaattgaaaatatccggctgtggaacaaggagtagatgattccacaaccggatatcggtttaatcagccgtttcgaacgatgggtccgaaaccgcagtgtagtaacgggcggcataggggtgttcgtcagcgtgcaattccagaatgccacgctgcgcgagcgcctcttgattggccgccacctgcgaggtgatgatggtcgggcgctggcccgccacctgcagcttcatccacaggtcgcacaccgagcctcccgggccgagcgcactgcggttcaccgggtttccggcctcatccacatcaatcaccacggcgacggtcttcggctgagccggcaatgcggaacggtactgtgcggcgagttccccgaacgtacggccgatcggcttcagctggccttgctcgtcgaacaagcccagagagtgctcgaagaacgggaagtcttccatgctggcgggcacatcgtgcgagcaccaccacgtcacaccccacaggttccggcaatccatggcacgttcaacggtcttgcggcagaattccggcgtgtagtcggtttccagcacattctccggcgcaccgacttcctggagccacaccgggcgctcggaatccttgccgaacgccttggccagctcggccaggtacagtgcgtacgacgagcactcctcactggtggcgccgtatccttgcgcgatgccgttgaacacccaggagtgaatcactgtcatatcacccttggtggcggactgcaccggagtgaacgggtgcccatcgatgaaccaggtgccatcgttgacgctgtacagcgcgttgtgcccttcaccggcggcggtcggaagcagcgcgtccagccatgcgtcgatctgccggtccgtggcgctcatcttcgtgggatgcggcctgtcagacagctgattgacctcgttgcccaaggtcagacccttgaacgcgggttccttggacagctcatcggtcatggtcttgaccagttcacgctcggccgcaacggcgtccgcatcggtgaacatgttgcccgcatgccaggtgaccagccatgaaggcaggaagtcgaagctggacagatgcccttggaacacgtccacataggcatccaaaccgtgctcgccggcgatgtgcaccatgcggcgcacatccgccacgcccttcttgttgatccaggtgcgattaggttgcagatacggccagatcgggaagatgcgcacatggtccatacccagttcgctgatctgcttgagatcgttgtcgatgccgtcccagtccgggtcgagccatgcgtggaaccagccatgcgacggcgtgtagttgactccgaatttcattggagtacctcctttttccagtccgctcagcccttgagtccaccctgttccaggccacggaagaagtagcgctggaagcagcagaagaagacgatgatcgggataagcgagacgagcgcaccggcggcgatcagtcgcggatcttggatgaacatgcccttgagtcggttcatgccgagggtcaaggtgtacttgctttcatcggagatcgcgatcaacggccacaggaagtcgttccaggcaccgacgaatgcgaagatgccgacaacggtcatcgtgcctttgacctgcggtacacagatgtggaagaaccgctgccataggttggcaccgtccaccatggccgcctcttcgagttccattggaatggatttgaaggcgttggtcatgagcaggatgttgatggcgccgcacaggccaggcagtgcgactgccagcagtgtgttctgcaggtggatggagcgaatgatcaggaactgggagatcatcacgccttcgatcgggatgaccatggtgcccatgaacatggtgaacaccagtccgcggccacgccacttcaggcgtcccagtgcgtagccggccatcgtggagaagaccacgttgccgaagatggagatcaggcagaccaccagcgtgttgagcatgtagtggaataccgggacctgcttgaacacggaaatgtagttgtccagcgtcggggtcttcggcatcaggtagggaggcacggcgtagacgttgtcgcccttgcccttgaacgacagggacagttcccagacgaacgggccgacgagcagcaggaacatcagaatcagaatcagatactggacgactttgccgacggtgaccttatgcgtgttggtattcatcagtcctcacctcgcttttgtacgatctgctgcacgatgagcatgacgccgacgatgacgagcacgacgatggagatggcgctcgcgtaaccagtgcgggcctggataccggtgccttcgcgcttgataagcatcgacatcgtcatatccatgccgccggggcctgcggagccgttggtcaacacgtagatttcgttgaagactcggaatgcggcgatggtggacagcatcatgatgagcatcatcgtggagcgcacgccgggcattgtcacgtagatgaactggcggacagggccagcgccgtcgagggaggcggcttcgtaaagggattcatcgatgttggcgagggcggtcaggtagatgaccatgtagtagccgaggcccagccagattgtcacgaacatcgagctgaagagcacgccccatcgatcggtgaggaatggaaccggcttggagatgatcttcaatgccttgagcacggagttgaccagaccggcggaatccagcaggttggtccagatcatacccaccacaacggcggacataaccaccggcatgtagaaggcggtgcggaagaagcccatgatgcgggagttgcccttgaccagataggccaggatcaacgggaggatcaccatgaacggcactacgcagatcacgtagagtgtggagttcagcagtgccgtgaggaagtactcgtcatggaacagtttgatgaagttttcgagtccgacgaaggttcccggacggagcagcgtggagttggtgaaggcaagcctgaaagtgttgagtgccgcaaggacgatgaatacaaacacaatcacgaacgctggcagaacaaacaggtagggggcaatgatggtgccgaagctacgattctgcttcttgccgtggttgaggttcatcggttcaggccggccggaggccgtgcgggcctccgacctgtcagcggcgagtgccgcgttgctcactgtgatagcttctcgtttgcgaactcgacagacttgtcaagggcttccttggcggtctgcttgccctgcatggcgagggcgatctgctgctggaagttcttggagccgttgttgtcggtgaactcggacggacgagagccgtagccgtccttgacctggtcgagcgtgatcttcagagccttgccctcaagggtgctttcgtcgatgctcttgtagtagtcgtcatccagaccccccttggcggacgggaacacggaggccttcttgtcgaactcgatctggttcttctcgttggtcacgaatcgggcgaagtcaatggcaacgtcggggtgcttcgagttggcgctgatgccgagcatctcgtaggccacggaagcggacttgccgtcgttactgatacgcgggccgactgcgaggttcttgtagaggtccggagcgttctgcttgaagccgtcagcggagtaggcggagccggccatggagactaggttgccacgctggaagagatcggcggcctggctccaagaggagtcgagggcctccggcgggatgccgcctttcttgtacagctcaacgaagcggctgatctgcttgacgccggcctcatcattgaaggtgtacttgctgtggtcatcgttcatgaaggacttgacgcctgcggtcatcaggtcttcggtgttgtaacccatcgtggtgcccaggtagacatccttgcagttctgcacgatggtgtcgccggcggcgaagtattcatcccatgtggtcggaatcttgttcggatcaaggccgcacttctgcatgagctcggtgttccagtaggtcgggccatcgttgacataccacggcaggccgtaggcacccttctcgatgccattgccctgcatggtcacggacttccatgcgccttcgtagtagtccttttccgcatccggagcctgcttggagacatcgagcagcgcaccggccttggcaagaccatacaggatggagttgccgccgtcgacgatgtccggcagttcgccggccgcagcctggctggacagcttgtcttcgtaaccatcggacggggcgtcaagccacttgacggtgacatccgggtggtccttctcataggccttgatcagcgcctcgaaatacggggtgtacttgtcgttcttgaggttccaggtctggaaggagatctccttcttgccgccgtcatcccccgcagttccgctaccacaggcagccaccgatacgagcatcgcaccggcaccggcgatggcgagaatcttcttcatagaaaacatgatgtttccctttcctttcgattcctttttcatcccgccctactgtggacggagaaacctaatcgttgtgctccagcacagtcacccgtcgcggtgattgacgtggtatcacaacctttattcagttctcatcgctgagactaaaccgctttagtttccggccagttgcgagcctgtaaactaaatcggtttagcaaaaatataacacaatcgaaacatgcacgcaacgaattcatcgtcgcgtgtcgcattgatatttgtccaacgggatcgctctccctcttctcatacaataatgggccgcgcccaaccgtatggcagagccggtctgttccggttccgttacggttgggcgcgacccaaaatatcgagtctaggcccaatatcccttatcggcgaatacgcagcgtggcgagctggaatggcgccaacgaaacgaccgcaccgtcggcaggcattggttcgtcaccggcgagcgcgcgcggcagttcggcatccagctccggctcctccatgagattcacctcccgcacgccggccttggcatcggagagagcggcgtcaaggcgcagtgtggccgtggcattgccgccggcggcctcgtacaggcgcacgatcagatcgctggaaccgtcatcggcgagcttgatccagtccaatacgatgacgccggtggcgtcggcgagcgagaccagcggcgccatatcaggcaactcccctattacggggctgttgagtcgcgccgcttcgtccagcaccgcattcatatcggcgtcagcgaccagagaccacgcgaaggagtgtgcgccttggtcggtgcgtgggtcggggtacagcggtgcggacagcagcgagagccgcaccatggtgccgcggccggtgccatgtgccgcatcggcgtggatggggctgacgtcggagccgtaggtggaggcgttgaccacagcggcggcatagtcggcgtcggcgatacgcacgaagcggtgcgtgcagctttcgaatttggcatcatcgctgcgcgtgttcttgttgatggggcgttcgaccagaccgtattggcattcgtattgcgcgttcaccgcttgcacggcgaccggcatatccactttgaggaactgttcgacggcatgccagtccacatcggcggtgaagtccagtgtggcggagcccggccttaaggcaatgcccgtacgaatttcaacgcccttcgcgcgagtgacagcatgcacgacggccccaccgttggcggtttcgtccacgcttgcaatcgatgcctcgctgagcgcgttggcggtgaggaatgcatcgcgttgaatatcccaagcgtcccagtggaagggttcgtctttgagcatttcgtagcggcccagtcgggtgccggcgggcaccagttcacgattggttcgctgatcgacgattgacgaaacggtgccgtcggcttcaatgcgcacgtgcagtcggccgttgtcgagcacaatcgtatcgccgtcatgggtaacggcgacccgagccatggatgcggttcccgcttcggctcggctcgaagccgggcgtaccacccacgcctcacaggcttggcgggaatatggggcgattacggcgtcggttatggttgcgtcatcgggttccacggctgcgatcgcgcgcccggcttcaagggcgatctcgttcagccgagcgacgtcacgcgcgtattcgacccgcgcctgacggtgtacccatgcgatggccgaaccgggcagaatgtcgtggaactggttcaggagcagcgttttccaaatacggtccagctcttcgcgcggatagacatagtccgggttcttgatgcgggccgcggcgcacaggtattcagcgacgcgcagcatcgactcctcctggcggcagccacgcttcatgtcctgctgggcggtgagggtggcacggtgcagttcaaggtacagttcgcccttgaacaccggggtctctccttgcgcatcgtcgacgatatccttacgcacgcggtcgaacagttggtcgggagtaccgaattcgatcttcggcacgccggcgagatcatggtcgcggcggatgcgcgcggtcatctcacgggtgggaccgccaccgccatcgccgaagccgtacagcagaatcgcgttacgggagaggtccttgtccaggaagttgcgctgcgaatacatcagctcatgcatgctcatccacgagcagtaggtatccgagggcgggaagtgcgtgagaatacgcgtgccatcgatgccctcccacatgaacgagtggtgcgggaacttggtggtgtcgttccacgagatcttctgcgtgaggaaccagtcgaatcctgcacgacgggcgatctgcggccaagagccggtgtagccgaaactgtccggtagccagatgccacgcggcgtgacgccgagatgctccttgaaatatcggcggccgaacgtgatctgccgcaccaatgattcgccggaaggaatcatgttgtcagattccacccacatgccgccgaccgggatgaaccggccttcttcgatgcgccgcttcattcgtgcgaacaggtcgggatgttcctcttccagccatgcgtactgttgggcggaactcatcgcatacgtgaagtccgggtcttcgtccattaaagccagcacgttggatacggtacgggccactttgcggcgggtctcgcgcaccggccatagccatgcggagtcgatatgcgcatggccgatggcaatgtggttgattacgctggatgcagccggttcggcgagcacgccggcgagcgccgcacgggctgccggcacggtttccaagtcgcgttcatcgtagatgttcaaggagcgttgcagcgctttggcgagctgccagtagcgcgggtcgtcgtctttgagttcgcaaatcagggaggatacggtttccaagtccatgtcataggcgaacacgtcttcgttgaagatggtgatatccatgcgactcagtgtgtatgggaagtcacaggtgccggtggcctcttcgccgagttcggtgggtgagaacggggtggggccttcgacgaatgggttggcggcggcttcgatatagacggtgaagtcgccatgttcatcgagttctacagtgctgctgccgcccgcgtagacgagtggaatccagtggttgcgtgggttcgcggatttgatggcggtgccatcggcacgatagacaagtccctcggattggaatccggggccgcggtgatcgagccagccgaggtctaccatgagttcgacttttcggcccttgaccgccgccatgtcgatatggccgttcacctcgaaccatgtggtgccccatgtggtgccccagactccgggaacgcggaaaggttcgaagggaacttggccgttgcgcactttggctagaaattcgctggagggcaccggttcgccgggattgtggaacgaacgcaaggtgcatgcggcgagcgtggtgtggatatgcggtttgacgcgctgctgcatgacgcggtcgcagcgctccaactgctgattgggcagaagaaacatggagagttcagctcctttgctgtgtctggtggtaggggtgggagtgatggtaattggagaaaccgcaatacgacatacttctgccccctcatggcgcgaggaggcagaagcgtcaggcaaaaattcagcgcgtgatgcgcagggtggcgagctggaacgggccgaagtgcagtgtggcgccttcggcgtcctgtgtgccgtcttgcagcgcgaccggcaggtcggcggccagattgtcgccttccaacacgttggtctcatgcaccgaagcgcctgcgagcgccgggcagacgtgcagcgtggcatcggccctgccaccggccgcctcataggcgcgcgcaatcaggtctccggagccatcgtcggccagctttatccagtccaacactacggtgccgtttgctgactcgatcgaggcgagcggcgctaagtcgggcatgtcatgaagcgtcggtgcgttgagtgcgcaagcggcgtcaagcgcacggcccaccgtggcgttggccaccacggaccagtcgaactcatgcgcaccgatatcggtgcgcgggtcggggaaggccggcgcggagagcaatgacagtcggaacatggtgcccgagtcacgaccttcggcggcgttctcggcgatcggcgtggcatcggacccgtacaccgatccgttgatgacggccgccgcgtaaccggcatcgccgatgatggcgaagcggttcgtgctgctctcatacttggcttcgtcggatgcggtgtttttgacgattgggcggcggaccagaccatactggcagtcgtatgttgcttggtcggccacgatacccagcggcagatcgactttgaggaagcgttcacgttcgtgccagtccatgtcggcgtggaaatcgagcgtgtgtgaaccggggcgcagcgtgatggtggtggtgatgacggtgtcatcgtcggcggtacacacgcggactcgtgccgcaccgttttcggtatcgaccgattcgattgatcctgtcatggcattcgccatgagcagggattcgcgttcgatctcccaggcatcccaaacggcgggttcgtccttcaacagttcgtattggcccaatcgggtgccggccggaaccagttcacggccatgctcctcgtcaagcagcgacgagattgtaccgtcggcctcgatggtgacggacagtacgccgttggccagcagtacacggccgttgtccaatgtctgggtcagtacggaacgcgcgttggtcggttcgttgatgcggctggcacgccaagccgcgccgtcattacggaactggctgatgcgggcttcggcgagcaggtcggcctgcgggttggccttgcgcagcacggcgcacatgtcttgggcgatttcggcgagacgcttcagatcgcggcgatagtcctcgcgggcttcgcggtgcacccatgcgatggacgaccccggcagcacgtcatggaactggttgagcatcagggtcttccagatacggtccagctcttcgcgcggataggcgtagttcgggtcggccaacgtggcggccgcgcccaggtattcgaccgtgcgcagcagcgattcctcttggcggcagccgcgtttcatgccctgttgcgaggtcaaagtgccgcgatgcagttcgaggtacagctcgcccttccagacgggcatttccgggccggcgttctctgcaagctgccgatgcgccttgtcgaagaagtcgttcggctcttcgacgctcaccttggagacgccttcgaggttctcgtagcggtgcaggtgctccatcatgttgcgcgtggggccgccaccgccatcaccgaagccgaagagcagaagcgagcgatcggcgagatccttgtcctggaagttcttctcggcgtagtcgagttcctgaaccttgcaccaagcagcataggtatccgccggcgggaagtgggtgaagatgcgcgagccgtcgatgccttcccacatgaacgagtggtgcgggaacttggtggtgtcgttccacgagatcttctgcgtgaggaaccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtggtgcgggaacttggtggtgtcgttccacgagatcttctgcgtgaggaaccattcgtacccggcacggcgggcgatctgcggccatgcgccggtgtagccgaagctgtccggcagccatacgcccttgggctccacaccgagatgttccttgaagtatttgcggccatatgcaatctggcgaatcagtgattcaccggcgggcagcatgccatcggcttccacccacatgccaccgaccgggatgaaccggccttcttcaatgcgccgcttcatgcgcttgaagatgtccggatgatcctcttccagccaggcgtactgctgggcggagctcatcgcgtatttgaagtcggggtcggcgtccatcagcgccaatgcgttggatacggtgcgggccaccttgcggcgggtctcgcgcaccggccacagccatgcggagtcgatatgtgcgtggccgatggcgctgacgttcatggccgaggcgttggccggcttggccagtacgccggcgagtgctgcgcgcgcggcttccacggattcggggttgcgctcgtcgtaggcgttcagcgagcgctgcagcgctttggcgagttgccagtaacgcggcgactgtttgtcggcgaattccatcagggagctcaccacgtcgagatcgacggagtagttctcgtagcgttcatcgaattcggccagatcggcggacttgaatacgtacggctcgtccggcttgccggtggcatggtcgcccagttcggtctcaatgaacggaggcacgccgagcagcagcgggttgctggcggcttcgaggtacagggtgaagctgccgtcttcggcgaccggcacttgcgcgttgccctcagcatccatgaacggcacccaatagttgagcgggtgtacggctttgatggcggtgccgtcggcacggtagacgaggccctcgatatggccgccgcaggagtgcgggtaccagccgaggtcgaggatgagctccagcggcttgcctttcgggtagccggccggcacggtaccggtcaggcggaaccagactgtgccccatgtggtgccccattcaccgccgagcgtaaacggcttgaagtcgatgtcacctcgattgagcttctcgaagaactcgtcagtgggcatcggctctccgggaatgtcaaaggactccaccgcaagctgtgcgatcgatgggtggatatgagggtccacgcgctggcgcactatgcgcttgcaccgctccagttgctgttcaggtttcaggaacatctgctgttcactccccttatctctgccgcttgtgcggccacatcattgtgctgcccgttcatgggaaacatatcgacatgcgccctcgcccgcagaagactaaagcgctttagtaacatattggagggaatgggatatgatgtcaaattactatcgcaattcagcgtgttccgtcaggcatgtcatgctcggtgtcgatgacgatggtcaccggcccgtcattgaccagtccgacccgcatatgcgcaccgaaacgaccttccttcaccggcactcccccggagcgcaacgcctcgtcgaacttgatccacatgaaatcggcatgctcgggcttgccggccttgatgaagctcgggcgattgcccttgtgcacgtcggcgaacagcgtgaactgcgagatggagagaatctcgccgccgatgtcctggatcgaacggttcatcttgccctgcgcatcctcgaacaccctgagattcagaatcttatgggccagccaggcgatctgcttgtcgccgtcctcatcggtgacgcccaccagaatcatgaatcccgggccaatctgctgcggctcgaacgtgggatccagagtgcccaattcattgaccacgtctaccgatgcttcggatactcgttgcactacaactctcatgactccctacagtagcaactgcagcaacaaaaaagcgccgttcccttacggaaacgacgcttgtcttggtggaggcgcggggaattgaaccccggtccgatgaccgagcccacagtcttctacgtgcgtagtctgctggccaagttggcgatttttctgcccccatcgatgtcgcagacaactgatggcgagcatatccgcagttaaagtcccgatgcagccctgaggctcaactgcatcagcaagtcttctaaacgacgctcagcatcctcccaaagacgaggaggagtgaacggagcggctgctcactggttaattctgactaaaaatcaggcagcgagagcgaactcagtgcggttagatttagcacttattcttttgccggggtcatccacgagcggacccggcgttctcggcacgcttccctgcagcgaacaggtcaccgtcgaaaccgatcgcccccaatcttgagttatcaagcttccggcttttcggccggacttttcagcatacaccctatggcgctactcgcgcaaatcgccagcagcgaacatcgccccggaaccaacgaagccaacgaaatcgccgtcacttgatgatgggcttctgggatgaggaaacatcaatctgatgtttcccggcaaagccagccgtgccagcggtgatgttcttgtcgatttcctcgacttccgccaacttcagcttcagttgcgaagagtcgccccaaatgattacgcggtcaccgtcgttaagcgtggtagtcaccgaatcctgcgtctcagcggtgaccttggtaatggacttacgcatcgattccggcaacgcgcccagaatcgtcagcgtctccttcaccgaacggttcttgagactggcgtctatatccttgacctcgatcaccgggatgccatccacgttggcgttcttcaccgagttcaacacacgcgcctgggaatccaccgcggtcagggtatcgcctcttttcagcatggccgcgggccgttgcgccttgacttccacgctcatcgacttggggaactgtttggagaccttggcctcgctgacgccgggaatggacttgagttgctctgtgacctcatgggcggagaccaggaacaacgactttccagcctgcttatcggcgatgacatggatggtctgcgcactcacccattcgttggcaccggatacgccgatctcgctggtttccagacgaaacaccgacgagaaaagcagcagccatgccagccccgccactacagccacactgacgaccgcaatcaacacgcgtaacgcaacgacgcgcacgtttgcacgcttgcgttctttggcgcgttcggtgaaattcaccactttcgggcgtgatgcgactcctagggagccggtggtctgatgcagcgtttcggcaacgtaatcctcgctgtgcaaccgccgtgcatcgacgaaggcaccggcctggcccttggctaccgtcacatcgtcgatgatctccggctcgtcgatctcatgcccggaagacacggaccggggagcgcgagacttcgacgagcgacccgtgtttccgcgtgaaccgatggtgcgcggcttgcgggagctcccagacgaacgacgtgagccgttgtcattgcccccggatctgaccgtgcgcccggacatcactcgcagctttcccgatgggcctcaagtgcggtgagcagcacctgatccatgtcggtgatgtcgcccgcgcccacggtgaagatcacgtcgccgtggtgggcgcgcatggccatcatcttggcggccaggcacatatcctcaaccggctgaatccacgtgcctgcggaagcatccttgagtcccgcagccgcgtccacgatggtggaggggctgatgtccgggaaatcggcctgcttttcacgggccgggaagatgccggtgataatgacgtcatcggctttggctaaggatttggcgaactggtgcgcgaagaacttggtgcgggagaacaggtgtggctggaagatcacacgaatggtcgaatcggggtaccggcgtcgggccgcatccagcagggccgcgatttcggtgggatggtgggcgtaatcgtccactacagtgacctgcttgaccgtgccgcgcacctggaagcggcgtgccgcaccgaggaatgtgccggccgcattggccgcgtctgcggggctcacgcccagcagcacggcagcgctgatggcggcggccgcattgcgcgcattgtgcacgccaggaaccttcagggcaacgctctgagacaccggctcccccgccgtcaccgcggccggcagatgcagggtgagctgttcgacgccgctgcctgcggtctcgctttccgaagcgatccagacatacgcggcaccgcccaaatcgggcagggattcacgcgcggtagtgccgtaggcaacggtatgggatttcacgtcggcgggcagggcctccagcacggcaagtccgtcggggtcgtcaatactgatgatcacgtgaccggtggcccggccggcgtgggcaacgaacgcggcacggtagtgggcttcgtcgccgtaatggtcgagatgatcggcttcacagttggtgataatggcgatggtcggatggtatttggcgaagctgccgtccgattcgtcggcttcggccaccaggatgtcgcctttgcccgcgtgtccgccgtccagcgtggtgccgtccgggccttggataaagccgccgatggcgtagcttggatcggcaccggcgttcaccagaatgtgggacagcatggagctggtggtggttttgccgtgcgctccggccacggtgacggctcgtttgccgttcatgagcagggcgaggatgtcactgcgatgcacaatgcgcttgcccgccgcgtgtgctgcgacgatttccggattgtccggtttgatggcgctggagtagaccacggtctcggcctgggcgacattttcggctcgctgcccgaattcaacggtgatgcccagcgtttcaagtcggtcggttttggcgctgtgtgcgcgatcggagccgtccaccgcgactccttcggcgtgcagcatttcggccagaacgctcataccggcaccgccgataccgatgaaatgggtggcgccgagatccgcggggcgggccgcagcatcgaatgaggcatacgtggggtcaagcactatgggctgatcttgagacaattcaaaactcctttagggattccagcaccctatattatgaccgtatctcgtgctgcggaacggaattggtcagtatcgcgcacggaatgatatctgaatactacttggatggttcggctaattgcagaacgtgccgggccatgatttcggcagcgtttctgatgccgtattcccatgccttgcggccgaattcggcaagtcgttcgtgatcggcgagcagatcgggcacatgctcatgcacccactgcggggtcaggtccttgtctgcgaccagaaggccgccgccggcgttcaccactggctcggcgttgaaacgctgctcgccgttgccgatgggcagcggcacgtaaatggccggcaggcccagtgcagccagctcggataccgatccggctccggcacggcaaatcaccaagtcggcacaggcaaaggccagatcgattcgttccagatattcggcggtatggtagtcaccttgtccggccgattcggggccgatgccggtaagcacgtccgcgccggccgaggccgtgaccagttcgcgtacttcgctgattttgcctcgcccggtcaagtggatgatttgtgcgtggaccaacaggtctgcggcggaggaggcgatggcgcggttcaggctttgcgctcccagcgatccgccagtgaccagcaccagcggacggttcggatcgacgccaagctgcgcggccgattcacggcgtacggcggcacggtcgtcaccgatgcgtttggtcagggaggcgatggccgggcgcaacggcagaccgacgcgctcgacgtcggctccggcacgcggtttgagaccggtgccctcgtacacggtaccgatgaaatcggcccaacgagcgcccagtttattggccatgccggcacgcgcattctgctcatggatggcaatcggaatgcccatcttgtgtgcggtggcgtagacgggggcggaagcatacccgccgaatccggccacgacatccgcatgccgcgtttcaagaatggagcgcaccttggcggtttctcgcttccattttgccgggaagcgcagcatgtacaggttagggcgacgcgggaacggcactttttcgatggtgtcgagctcgtagccggcctccggcaccaaatccttctccaaacccaccgcagtgccgatgacggtgacctgtgccgtgggttcgatgtcgcgaatcgccccggcgaccgcgagcagcggattgacatgtccggcggtaccgccgccagcaagaacgatatgtggtgtgccttgattcatgattaccgagtctacttacgcgctctgacgcgactgttttatctgcggttgagagcgcataagtcccacaaccagtccggccgccgtcaagcacataatcatggatgagccgcctgcggagacgaacggcataggcacgcccaataccgggaacacacccacgaccacgccgatgttgaccatggcctggcccacgatccaaatggtgacgcacatcagcaccatggcaacataacgatcggtgacctgcaatgcgatgacgatcatgcaccaggcgagaatcgcgaagaacagcaatacgatggcgcaaccgacgaatccggtctcctcgccgatgatcgcgaaaatgaaatcgttatgggcggccggcaggtaattccatttctcccgcgaattgccgatgcccaatcccagaaaacctccggaggcgatggcgtacttggcgtgaatggactggtagcatacgctctgcgcgtcagcggccgagcaatcgccatatgtggccagaatacgacgcaagcggttcgggctggaaaccgccaatgcaccgaccataaccaccgcgcccaatacgccgactcccatccatttgccggggaacccgacgatcagaaaggccacacctccgatgaagaccagaatcatggccgtgccgaggtccctgccgcccatcaccagtgccacgcctatcgcatacaacaccaacggcgcggcatatgctttgattcccttcttgtggtacatcttgctgcaggcatgcaacgacgagggaagccatatgcacatcgcgaacttcatgaattcggccggctggatagtggtgaagccgaggtccagccaacctctgttgccgtagacgtcgtgacccaaaggagtaaaggtcagcgcctgcaacaggcaggcacccaccacaaagaacacgccggtccgtttccagaacgtcaccggcatcatcaatgccacgaagcccagcaccaagccgatcaggcaaaacgcgccctggttcagaagctgaaggaacggcgacttgcccagtgcggccatggtgaccgtggagctggagaacaccatgatcaggccgaagcatgtcagccccaccacggccatgcggaagccgtggtagcaccatagcgggttgagcaagcttcgccaacccgtgtagtcggcgatttcgagtgagggcttgtcaggggctctgtatgccttacgcttatgggtatcagtggaggccatgcacctcgctccacgtcttggctgcggcggcgaatcgattgcctcgatccgcgtaggacttgaactggtccatggaggcgcaggccggagccataagcacgatgtcgccggcggcggtatacgtgccgcaggcttcgacggcacgatccatgacggtatcgttgtcttcgggatcgatgatggtcaccgggatgtccggagcttggctggcaaacgcttcgatcatcggctgctggtctttgccgatgatgacggccgctttgatggtgtgtgcctggtccttgaccaggtcctcgaatcgactgcccttggccagacctccggcaatccagatcacagacttggccgggaagctggacagcgaggcgcgtgccgcatggccgttggtggctttggaatcgtccacaaaacgaacagagccgccctcgactgcggcctcagccacggtttcgatgcgatggccgcccggcttgaacgaggtaagcgccttcaacgcggtatcgcgatcagcgccaagtcccagcaccaacgccaatgccgtcaatgcatcggccaccagatgcgggtacagtgagccgtccggctctgccagatgcgtgaaatcggtgatggcggccagtctgaccgactctcctactgcgccgccggccacgccgctcctgtccacgatccagccatcttcaatgccgatctggccggcttgaggggcctcgagcgtgaatcccaccttgcggcatccttcggcagtctgagcctcggccgccagttcgctgactttggcgtcctgcgcattgtagacgatggcgcgtttggcgttgtggaacaccttggatttgtcggcggcgtaattctcgcgcccgccatgccagtcgaggtgatcgtcggcgatattggtgatcgccgcgcagtcaagtgccagcgaatcggtgaagtgcaattggaaggagctcagttccacgcacagtacgtcgtgctgcggattggtggcgcaacgagacaggctcatgctcatgtctccggaggcgatattgccggcggtcggcgcgtcgagtccgcaggcggtgagcatttccgaggtcatctcggtggtggaggttttgccgttggtgccggtgatgccgatccatggagccggagtaccgatgcgctcgttattcacacgcagctgccatgcgaattccacctcgctcatcacggggatgccacggcgttgggcttccagcacgaacggggtgcgggggttgaacaccggggacgacatgacgtagtccacgtggtcccagtccacgtcatcaaaggagtggagatcggcctcgggcttcctctcgtcgacgccaatcacgtgggtgccgcgttccctcaatacctccgccaacgaggtgccggacacccccagtccggcgatcaccactgtcttatccgctacttgcattgttcctcctgatataggaattccgtgggtgagcataatccacccagatttccgctagctgaacagcaggccggagcgggtgacccagtcgccgtagaaaatcgtcagggcgagcagcacgaagatgagttcgatcatccagaaccgcaccaccaccttggtttcggtccaaccctccagttcgaaatgatggtgaatcggcgccattttgaatacacgtttgtgggtcatcttgaagtacccgacctggatgacgtcgctcatggcttccatgacgtacagtccgcccagaaccaccgccaggaattcggtgtgcgtggcgatggacagggctgcgaacagaccacccaaggccagggaaccggtatcacccatgaaaatcgatgcggggttcgagttgtaccacaggaagccgaagcaggcgacggccgcgcatacggcgatgacggtcagatcgagaggatcggacacggcataggaatatccgccatggctgccgcccttgatgtggtagctttcccagaatgcgatgatgccaaaaccagtgaaggcgatcatcgacgaacctgccgccagaccgtcaagtccatccgtcaaattcactgcgttggtccatgcggtcatcaggaagttcacccagatgacgaacaggatgatggctacggcacggccggcgaagtcgaagttgaagaacggctgttcgatgaagctgatgcctgcctgcgcactggggaatcccgatttggtgggaatcagcagcgcaagtaccgcgtagatggtggcgaagatgaactggccgatgaacttgccgcccaccgataggccttcgttctgcttcttacgcaccttggcgaagtcgtcgataaagcccagcagacccatcgacagcatggcgaacagtacgagcgccgcggaccaggagggcacgtcgcccgaacgcaggtatcggtacagtgcggaggatgcccaaccgagcagaatcgcgaagttgatgaccacgccgcccaacgtgggggtgccgcgcttgaccagatgcgactgcggcccatcctggcggatgtactggccatagtgcagcttgtggaccagccgaatcagcagcggggtgccgactaaggtgacgatgagcgacaccagcattccaatgatcagagcaatcacgtgcagcttctctttcttgtcggtttcttggggtggttatcaggtcagttctttgcccagcgttcagccaaagcgctcaggcctgacgcgtgcgatcccttgagcagtaccacagcgtcgggatggttgcgagccaagtcgatgaccagctgttcggccgcatcgatgtcgtgtacgcaatccaccgacgcggattggctctgacgggcaccgtccgccagagcctgtgccagtgcatcgagatgttggtcttgggcggaaccgaccgcgatgatcgcgtcgatgcccaattcgtccgcatacgtgccgatcgaggtgtgcaatgccgtttcatcggcgccgagttccagcatggcacccagcagcgccacgcggaacggctccttgccgtcatttgagttccaggccttcaacccgttcaggccggctttcatggagtcgggattggcgttgaaggaatcatcgatcagcgtgaaggaagtcccctcgcgattcaccgtagacaatgccatgcgatgagggctgatggtgtgctgcgaggccagaatccgtgccaccgtttcgggtgccataccgtaacgcatcgccacggttgcggcggccaacgcgttcatcacattgtgacgtccaggaatgcccagatgcaccggcgtatggttgccgtccgcatcgaccaacgtgaattcagcatgatcggaccggtcggcagtgacatcaatggcccgcacctcgggctcctgcgacgatcccaagccgaaccacagcacgtcgccgttggccaggccggccatgggaaccacgtgttcgtcatcggcgttcagtaccgcggtgcctccgggaagcaatccctgcacgatttcgcttttcgcctgtgcgatgcgttcgcgggagccgaattctccaaggtgagcgacgccgaccttcaatacgattgccgtgttcggcggtgcgatacgggtcagtcgcgcgatttcgccgatatggctggcacccatctcagccacgaagaaccgggtgtgctcatcgacccgcaacgcagtgagcggcaggccgatctcattgttgaacgatcccaccggagccacggtcggacctacggtggcaagcagggaggagagcagatccttggtggtggtcttgcccaccgaaccggtcaatccgatgatgtcgaagtcgccgtccagctcgcggcggcgaacgatgttgtatcgggcgagttcgccaagggcgtcgaccgtgtctttcactacgatctgcggaaggccatcggacttcacctcatggtcgacgatggccaccgtggctccctgtccagcggttttcgccacaaagtcatgcccatcgacacgctcgcctcggatggccacaaacaccgatccggggccggcctgccgcgagtcgctgaccgtattggtggctcgagactcggaaccggcgtctccgatcaatcgaccatcgacggccttggcgatctcctccacgctcatcggaaccatggtgtttcaaactcctttacgattacgcttcgtcccgtatccacggacttaattgagattattggccacatgcagggcactgcgtatgttgtttttcctcacgccggcggccagcaccatggcgatggccaaggacatgtgcccgagtcggacgcggtcatacattgccggtgaatccgcagccatttcatccgattcgggtgtcgacgaggtcatggacatgtcatgttccgcaacgaatgcgtagcgtgtcttcaattcgttcaagcttgcgcttgcgttgacatcctccgtgcccagtacatccacgttcaccgattccaacgcatgctcggccaacgtgcggtcatccatggcgatgatcacggccgccacaccgtcttcggcgcacacggacagcgcgcgctgcatatcgaggatgcccagaggatagttcaggttcatggtacgtgtcatcgacgtggacccggatgcggtgattaccgccaccggattgcccagcatgtgcaggaattcggagagctgggacacgcctgcgtcgacggcctgctcatccgcaccggtcaccgcgaacaccgccatggcattggacggtccgccggccagaccgctggccagatcgccgagtacgcgatcgtcgaaatcgccgtagagcaacggtatatcggcattggcgatctgccctttggacgcgcgtggcagcaacgccgcataggcaccggcctgtgcggcatgcagtacatcgggttcctgctcatgcgtgcagatgaacagcgagccgggaatcacggtgtccacggcatcgctgagtgaggtaatggtgacattggtggcgaagggtggatcgacttcaaaaccgtaccgttcgaccagcattcccagggtcacccgctgggcgatggattcgctcactgcactcatgggctatcgcctttctcccctgatccttaccacgtgactggaatagcatttttgcgtggactggagacaggcacctcgtatttctgcataaggaactcacaaatctgtgcggaaacagggccggccgtcagaccgccgaacacaccattcggatccttcatcaccacggtgaccgcatagcgcgggttgtccgcgggaatcaccacggaataatcggagataatggacgagagcgtaccatccgagccctgcacctctgcggtaccggacttggcggccatgcggtaaccatcgaccttgacgaacttgttgtagccttccgccactgattccatcgcattcatcatgtccgatgcgaccttttcatccaccacgcgggtggcttcgcccttcttggtctcagtggtcttgccattggcatcggtggttgatttgatgatcgactgctgctgcttgacacccttgttcgcgatggtggccaccacgttgttgagctgcagggcgttgacggtgtagccctgaccaaacaggatggtgttgcgcgtacgcagatcccacgccgaagggttggtgagcagaccgctcgattcaccgggcaggttcagtccggtcggttgtccgatgccgaatttggtcaggtactcgtagcgttgctcatccggatagttctccccggccataatcatgccgacgttcgatgagttctgcagaatgccggcgagcgtccagcgctcagtgccatggtcgaatgagtccttgtaggtctggccctcctgtgtgatgtggtccgggaccgacaattgatcgctcatcttatgcagtcccatctgcagatagccggacatggagatgaccttgcccaccgaaccaggctcgaaggtttcggacacggcccgagacgggctcatcttcgccgcatcggtaccagcctgtacttcatcgctatcggccagtgcgagaatctccccgctctggacatcctgcaccacggcgatcgcccacgctgcaccatacttggattcggcctccttcaagacctttttgacataccattgcacatcacggtcaatggtcagggtgacatcgtcgccatttttggccgccaccgattcggtcatggtgccgggaatctcttcgccgccattaccacgctggtaggtttcatggccatcggttccggtaagcgtcttgttctcgacctgctcgatgccggcgacgccatcgccgttgtcgttcacgccgccaagcagcgcgcccatgagatcgccatccgcatacagtcgttcactgctcagctcaccccagacaataccgcccaggtgcaacgactcgatgctgcgcttgacctgcggagtcacatctttcttcagaatcacatactgcccggtaccggacagatcagcgcccagttccatggcgttcatatccaggactttggccagcagtcggcccacggccgccgctccggtagcgcccacgggtttgccgtcaatttcgtggcagtaatcacgggtgttgtcattgcaagtaatcggctcgaactcctgtgcagcctccggattggcgacgatagtataacgctccacgctttgagcgagcacggagccgttggcgtcgaggatacgcccacgcttggcgctcaacgtcacggtcagggtgcggttagccgtggccgcttgtgcggtttgacggccgccgacgagctgggtggaggccagctgaatcacgcatgccgacgccaccaacgccaatgcggcgccgatggcgatgcatttgaacgcgaaggtcttgaccttggcgaactctacgatgcgacgaatggtgttcactgggttccgcctttgttggactggtatccgcttaagtcgatggacactgatccctgctgcgggaccatgcccatgtcgctggccttgtcgggcaggttcgcgaccaattgatcgagtttggcctgatcgtcttcgatatcttgggtaagtctgttgatgttggtttcgatctgtgccgcctcaaacgagttctgcaccatctgggtacgcagcatcagcgcgccgaacaaggtgccgacgaggaagatcactgcaatggccacgtgcaccagcggtgcgcttcttgttctggtccattcgatgacccgtccgacgacattgccctgctcgtttccacgcgggttggagaccacccgcagctcaggtcgggaggaggactgatgcttggtgtgcggtcggttcgaggctggagccgcgttcgatcgaatgctacgtgcagttgccatatgctgttatcccctccttgtacgaattcgtgccgtgtttttggctctgcccggagacgcggagccttgtatcttgacgtcattcaggccctgcgcggtttgcgtaaagcgtttcctccatcgtgacggaatctcacggctgacttccaccgcccgtaaccgcaccgaagccgatctcgggttggctgcgatttcatgttcgtcggccttgatggcacctcgcgtgagatccgtgaaaaacggttgggcatccggcggtatgacaggcaggccagccggaacatccactcgcagcccttgtgccatgaacgatttgacggttttgtcttcgagcgaatgataggactccaccaccagtcgtcccccgacatgcagtcggttcgcggcctgcggcaatgtggaggcgagcttgtccaattcgccgttgacttcaatgcgcaacgcctggaagacgcgtttggcgggattgcccgccgggcggtgggcttgcggcaccacttcatcgaccagacggttgagctgtgcggtggtggtaaacggctccttgtctcgacgcgccacgatggcgcgggcgatctgacgcgagaaacgctcttcaccgtattccttgaatatgcggaccagttccgccgcatcataggtggcaagaatccgttcggccgtcaacggctggctgacgtccatgcgcatatccagcggcgcatcatgcgaataggagaagccacgatcggtttcgtcgatctgcaggctggataatcccagatccatgaatacggcgtccacgcgttcgatgtcttggtccgccaacacctgatcgagctgatcgaaggcggcatgcaccggaatgaatcgatcggcgagcccctcccgttccatacgttcggtggccagccccagcgcttcactgtcacggtcaatgccgatgagccgagcctgaggcgcggccttgaggaaggcgatggaatggccagcaaggcccagggtgcaatccactgcgatggcgttctcatgttccagggcaggtgccatcaggttcacgcaatcgtcaagcaataccggcagatgaatattcgccacatcaaccatcagaattccacctccggcaacacatcgtcagcaatatcggaatatccctcttccttctcggcgaggtaggactcccacgtgtccttattccacagttcggcacgggtgccaacgccgatcaccacgacgtcggaacccagattggcgtaatcgcgcagcatctgcggcaccagcacgcggccctgcttgtccggctgctggtcgacggcaccggaaaggaacacacgcaggtattcgcgggcggctttgtttcccaccgacacacgctgaatctgcgaggcgatacgtcgaaattcgtcgaacggcagcaggtacacgcaccgttcctggcctcgggccatgaccaggccctgccccagctgggagcggaatttggccggaagcgccatacggcccttggcatcgatcttcggcgtatatgtgccgagaagcaatggcggcagaccagccatgagatcggccatagtggtggagccttgtgcgttggcatcagcgtcgcgaatcgtctgatcggcaaccatggctccacctccttcatcgttacgtgggatacacttcggccaactggctcaccactctaccccacgattccccatttctccccactcatgcacgatttgctcacccttttagggcaattaccgatggattgcgcgtgtcggccacgactgtcgcacgaatggacgctccgcacatctaatccacgtcgcgcaccccaccgaccgagcagcatggtgaattcacgctgaattcacctattccgagttgtccgcatcactgacgtagggggtgtgcggtaaatttgaatgccttaagtttttctgccccacggaaatggaacgaagagaacagcatgtcgagttacgcctcccagctgcatgaagagcagcaggccgtcgatcgcgcctatggacgattggatgatctgcgagccgaaatgtggcaacgcctggacaccgtacgcgccgccggctcccacggatcccccacgcaacgcagcgaacgagactcctttgccacaatgtacgaaaaccgcctcacgcaattgcgcagcgttgaggatcggctggtgtttggccgcctcgatgccaagaacggcgaccgtcattacatcggccgcatcggcctgtcgagcccggaccatgagccgattctgaccgactggcgtgccgaagccgcacgtcctttctatgaggcgaccccttccaatcacggcgacatcgtgatgcgcaggcatatcaccttgagtttccgcgaagtcgtgggcgttgaggatgaggtgctcgacgtgcattcagaccaggtcggccaagcgtcttccgccggcacattgaccggcgagggtgcgctgctggcttcgttgagctcacgccgcaccggcaagatgaccgatatcgtggccaccattcaggccgagcaggaccgcatcatccgctccgacatgaatcgcgccgtggtggtgcagggcggccccggcaccggcaagacggccgtggcgctccatcgcgccgcctacctgctgtacacgcaccggcgcacgctggaacgttccggcgtgctggttgttggccccagctcggcgttcctgcactacatcgatcaggtgctaccctccttgggcgagaccggcgtggtctcacgcaccatcagcgatctgattcccggcatcaccgccacggcggtcgactccccttatgcagccaagctcaagggcgatcgacgcatgacctccgtagtggccaatgccatcgccgcacgcgtgcgtgttcccgctgctctgccgacagtaaccattagcggcattcaggtaccaatgctggccactgatatcgagcaggcgcaggcggacgcgaagcgcacccgacaacctcataacaaggcccgcgagacctttatccgttcgatgctgaccagcatgcagaaccgttatgccgaacagcttgattacacgccggatcaggcggagctgaaccgcgcgatgtcgctgctacgtatgaacgagcaggttcgcaagaccctgaacctgtgctggctgccgatgaccgccccatggctcatcgatcagctgttcgcccatcccgaacgtctgaagtctctggctggttggctgaccgacaacgacatcgcggcacttgcccgtcccaaaggctccccgttgacccgctccgatattccgctgctcgacgaagcaatggatatgctgggccccgatcccaaggcggtggcccgccagtccgtcgccgacgcacgtcgtgccgccgaagagcagtatgccaaagacactctggccgcgaccggtctgggtggaggcatcgtctccagtcagatgctgctcgaccagatgaacggggacgacgctgagctgaccgcgcagcgggccgcggccgaccgtgaatggacctacgggcacatcgtggtcgatgaagcgcaggaattgaccgccatggactggcgtatgttgatccgccgttgcccctcccgctcgttcaccatcgtgggcgatgtggcgcagacttcggcgctgggtggcacccgacgctggagcaaatcgatgaaccgcctgttcggcgaaagccactgggatttgaacgagttgaccatcaactaccgtaatccgcaggaagtttccgaacttgcctcacgatttgccgaggaggaaggcctctacatctccacggtcaatgcggtgcgcaccatccccgattcggtgtcccgcaatgtggtgcccgacatgtcgtccttgctggaaacgacggccgagcaggcggcgcagcttgccgaacaattcgtttcggcagacggcaccggccgcatcgccgtcatctgtcctgataatctcatcgccccggtgcgcgatgccgtgcgccgcaaactggctgtcattcttgacccggccgaatacgcaaggctcatcgagcagcccgaatgggatgagcaaatcagcgtctgcggcactgaaacggtcaagggtctggagttcgatgccgtcgtggtggtcgagcccggtctcatcgaggatgacgcgccgagccgcctggtcgccgcctcggacctgtacgtggcaatgaccaggccgacccagaaactggttatagttcggacaaaagcggacgaaaagtccctgaacatctaaggtatgaagcatgcccaaagcactgttattggaaaacattcaccccgatgcggccaaatcgctgcgtgatcgcggtttcgaagtcgagaccatgaagggagccctgagcgaggacgaactcatcgatgcgctggatggcgtggacttggtgggcgtacgctccaagaccaacgtcacagcccgcgtgctggatgcgcgtcctacgctaagcgccatcggctgcttctgcatcggcaccaatcaggtcgatctggcacatgccggcaagcgtggcatcgccgtgttcaacgctccctactccaacacccgttccgtggtggaattggtgatctgcgacatcatctgcttgatgcgccgcattcccgcacacacgcatcacatcaagcatggcctgtgggacaagtccgcttccggctcgcatgaagtgcgcggcaagaccctcggcatcatcggctacggcaacatcggctcccagctgtcagtactggccgaggccctcggcatgcgcgtggtgttctacgacattgaggagaaactggcactgggcaacgcccaccgttgcgacaccctcaacgaactgctggaacagtccgatgccgtgaccctgcacgtggatggccgcaagtcgaacaccggcttcttcggcgaagaccaattcgcccacatgaagcaggacgcgattttcattaacctttcgcgcggtttcgtcgccgatctgggagctctgaagcagcacctcgattccggccatctgtctggcgcggcggtcgacgtgttccccgttgagccgaagaagagcggagatccgttcgagacctcactggccaatgaagacaatatgattctgactcctcatattggcggctccaccttggaagctcaggaatccatcggccatttcgtctctcagcgtcttgaggattactggttcaagggttctacctccttgtccgtgaacctaccgcagatcaacctcggtgagtgcaagggcgtgtgccgtatcacccatctgcacgacaatcttcctggtgtgctggctcatgtcaatcatgtgctcggcgaggagaacatcaacgtttccttccagtcgctggcaaccgaaggcgaacttggctatgtggtcaccgacgtggctcaaaagcccagcgccgccacgcttgaagcactgcgcaacatcgaaggcaccattcgcatgcgtgtcatcagctgacgcagctcatcctcgattgatatgaaagagacccgtcgtcgacgggtctctttcataagtgctgggcttcatgattggctcgcaccatggtttgcgaatcactcgcatatcacggtgcatggcattcgcatattattcacgcaaaccatcaatggcgctttggaaatcctccagacctgcaaagttctggtacacactcgcgaatcgaaggtacgccaccacatccaagtcacgcaacggtttcaggatggctttgcccacttcatctgaggtgacttcggcaaggcctcgggagcgaagatcctcttcgactttctgtcccagcagcttcagatcctcttctctgaccggccgcccctgacaagctttgcgtacgccggaaatcactttgtctctactgaatggctccacgccacccgaacgtttagtgaccagcagcatactggtttccaccgtggtaaaacgcttgctgcatttcgggcatacgcgacgccgacggatggaatgaccgtcatcgctaatgcgcgtatcaatgactttggtgtcggggttctggcaaaaaggacaatgcatgctccccagaataacgtgtacgggcggaaaaaccatgccgctcgggtttcatttactcaaccggaacaataatgcgctgcccggcctgcaatgatccggactcaagattgttcaacgcaatcagctcatccaccgtttccgatacatcatgaccagcaggcgtgatagccgaagcatatgaccagagcgtatcccccggccgcacgatataaccggtcacctgcgtggcccccgtatccgattgggcccgctgaacggtaagcgcgccgaaaccacaccaggccagcgtcaaggcgaccatcactgcgataatcttcccacgcacattccggcgggacgttccagcatgctgcatagctacacgtgcactacaggccggggccatcaccattgaaccagtcatcacgaccacctctctcgaacagatgttctatcgaacaactgttcttataatggcacaaacgttcgacacggtcaagtcaaaactcgaacagatgtttgatttcacacgaacaacacgttatgctggtgacataacgaaaggagccctgacgtgagcaccattcccttctcccccaagcagaagccggacgagtccaccctgaccgaccgccagcgcaaagtgttggacgccattcgcacgcatatcgacgaacaaggcttcgctccctctttccgggaaatcggaaatgccgccgggctcaaaagtccgtcttcggtcaagcatcagctacaagttttggaagacaagggcttcatccgcatgaacgcgaacaagggtcgagccatcgaggtggtggcaggatccgccccgaatgccgaaaagccctcccaagccagcgaagaggcaaccagcaccagtaatgtggcggagatataccaattccccgccgaagccattgccgaatcacacgatgtgccgctcgttggccgtattgccgccggcgtgccaattaccgccgaacagcatgtggacgacgtcatgcgtctgccggaacggctgaccggctccggcaccctgttcatgctgaaagtccacggcgattccatggtggatgccgctatctgcgatggcgactatgtggtggtgcgcgaacagaattccgccgtcaacggagatatcgtcgccgctctgctggatgacgaggccacggtgaagaccttccgcaaggaaaacggccatgtctggctgatgccgcacaaccccgcatactcgcccatcgacggcacacatgccacgattatgggcaaggtggtcaccgtgctgcgcaaattgtagcctgttcgccaccagctgatcagcgtgcaccgaatcgcgccggtcgtgctatagtcacgcacagcttacgaaaccccggcctcgcgccggggtttcgtcgtattcagaccatatcgcaaatggtattgagaagcggtttcaactcgatagagcgaaggagtacatatggctcatacccatgcacccgcaccatccacatccgtaaaccctgccgcgcaccagcgtaggctgattgccacgttgaccgtaaccggttcggtcttcctcatcgaagtggtgtcggctgtcttaaccggctcattggccctgctggtggatgccggtcatatgctcaccgacatgtccgtgctggcggcatccacaatcaccgccatactgatgcgccgcaagcccagcaacactcgtacttggggctgggccaggcttgaggtgctcaccgctgccgcaggtgccgtggtgctgctcgtcgttggcatctatgcgttgatggaggccggcatgcgtctgttcggcggttccaaagcggaaatcgacgatatcggcttgctgctgttcgtgggcattctgggtcttgccgcaaatatcatctcgattttcatccttgcctcgcagcgcgaagacaacatgaatatgaaggccgcgttcctcgaggtgatgaatgacgcacttggctcggtggccgtggtggcctctgccctggtaatgatctccaccggatggaatggcttcgacgccgtggccggtgccgtcatcgcactgatgatgattccgcgcgccatcaagttgctgcacaacgcggtcaaggtgctgctggaggaaacaccggatggacttgacctcgataaggtacgcgaacatctggaagacgtgccgcatgtgcttgccgtgcatgacctccacgccagcacggtgtccaccggcatgccgattctgatggcccacgtggtagttgacaaagacctcaccatggaagatgccgccacaatcctcacccaactgcaggattgcctgcgcgagcacttcccggtctcggtcccccacaccaccttccagctcgagcccgagggctatagctccccctcctccaacgaactccacgaataaaaaatgctcccaacgggagcattcagcagggtataaaaaatcgctgtatgtgtgcgattttcgtgccgcacaagttgaaggcctacaaaggtaggtcgagtcttgtgcggtgcgaaaggcgctccgtacagcgattttttatcagaagccgaactgggcggcggtttccttcagcgtctcggcagagcgcttcagagcggcgagctccttgtcggagaccggggtgttgatggtgttgttgacgccctgacggttgaggagggtcggcacggacatgcagatgtcggagatgccgtggaagtccttgagcatggagctcacgggcaggatgcggttggtgtcgtgcaggacggcttcgatgatgtcgacgccggacatgccgatggcgtagttggtggcacccttaccgttgatgatcttgtaagcggcgttcttgacttcctggtggatctcctcgcgcttgtcggcgtcgagcggatcgtggccgggcagcggggtccagtcgcacatggggacgccaccgatggtggcggactcccacagcgggacttcggagtcgccgtgctcaccggcgatgtaagcgtgcacgttcttgacgttgacgccggtctgctgggcaatcaggaagcgcagacgagcggagtccaggttggtgccggaaccgaagatctggttctcgggcagaccggtgagcttctgagccacgtgggtagcgatgtcgaccgggttggtgatgagcatgtagatggcgttcggagccaccttgaccaggttcggcatgatggccttgaggatgttgacggtagcgccaacgagctcaagacgagactgacccggcttctgacgcggaccagcggtgatgacgaccatgtcggcgtcgcggcagatctcaggatcgtcggaaccgtcgatggacacggtcgggtagaagctggagccatgctgcatgtcgagcacttcggcttccacgcgctccttggcgatgtcttcaagcacgatctcgcgagcgatgccacgctgggcagcggcgaaggcgagggtggagccaacggcaccggcaccaataacagcaagcttcgtgggcttaacggtagtttccgccatgatggatgaacctctcttcaaaggcggtctgctgatgaatggcaggccttgtaactaacgtcttcactctataaacccgctaagacgttttgctaccagcacgccaccctgtttgataaccgtatggtaatgttttcaacggttgttagcgctcacgaatatactgtgatgtttatcacgttagtcaatggactgttcgaccacctgagcggcaagatgggcgtcaacgtccgcttcaagctgtatgccatcatcgcggtactccaccttgtctaccttgccgtattcgcgtacacgagagatcagggagccagcggtatacggcagcagagcgttgacatgcacatgcgggaccggcagcagactttcgaccgcggtacgcagctcgtccaatccctcaccggtataggcggagacgatgaacgcatctggctgcagcgcggcgagtcgttcacgagtcgcctcgtccgcctgatcggccttgttgaatacgagaatacgcggaatcgaggccgtaccttcgatgtccgccaacacgtcattgaccgcgtcgacctgagagaacgggtcagggtgggagccatcgaccacatgcaggatcacgtcggcctcggccacctcttccagggtggatttgaacgcctcgaccagctgggtgggcaggcggcgcacgaagccgaccgtgtccacgtaggcgtaggcgcgtccgtcgcgggttttggcgcggcgcacggccgtgtccaatgtggcgaacagcgcgttttccactagttcggccgaaccggtcagacggttggtcaacgaggatttgccggcgttcgtgtagccgaccacggccactgtgggcaggccgaagcgacggcgtgaaccgcgcttgacctcacgtgccggggccatctcacgaatctgacggcgcagtctggcgatacgcgtgcgaattacacgacggtccatttcgattttggtctcgcccgggcctcgcgatccgatgcccgcatccgcgccggccgcgcgaccgccggcctgacgggacaacgaaccaccccaaccacgcagtcggggcagcatgtattcgagctgcgccaactccacctgcgccttaccttcacgcgaggtggcgtgctgggcgaagatgtccagaatcaccgcggtgcgatccaccaccttgactttggcggcgtcctccaatgcacggcgctgtgacggcggcaggtcgtcgtccacgataatcgtatcggcttcctcacgcgccacgatgtcggcaatctccttggctttgccggaaccaacgtacgtggctgcatccggcttggagcgatgctgcagcaaaccatcgcataccaccgcaccggcggtttcggcgagcgccgccaactctctcaatgattcctcggccttggcttgcgtggtgacggcggacgaccagacgccgacgagcaccacacgttccagacgcaccttgcggtattcgacttcggtgacgtcctgcagctcgccgagaccggcgacatgcttgagctcgttgcgggcctcgcgctcctcccattcctggttggcgtcctcatgccagccggtcgcgcgctggctgtcgtcgagcaacacttcggactgctcggccagcacaccttcaggagtaacgtcgttgttgccgcggttgatgtcggtgtactgggtgttgtcggtcaagtgcgcctcgtttggttggaatggttcacgattcttctatggtcctttattatcatcacatgaggtgacatgctggcatagatcggcacgtaccggcataggccggctgatacaggtcggcatacgagagcggcgaatcccgcagaaatggagcgaccatggcagaacagtatttctctgcggaacccgcatcgaaggatgtgcgccgcacattgaacgtaacgttgcgcggccatgaggcgaccgctcaggtgtcgaacggcgtgttctccggctcgcgcgtggacctcggtacgtcggtattgctgaagcatgcgcccgagccgccgcttaccggcgattttctggatttgggctgcggctggggccctatcgccctgacattggcgtttgagtcgcccgaagcgaacgtgtgggcggtggatgtcaacgagcgcgcggtggacctgacccatgccaacgcacaggcgaacggccacacgaacattcatacggctcaggtggacgagtccagcactcccctgcctgccgagaaccagccggcgttctgcgagacggtgccgagcgacctcacgtttgatgtgatttggtcgaacccaccgatccgagtcggcaaggaagcgctgcatacattgcttatggcttggctgccgaagctcaaggtgggcggtgccgcctatctcgtagtgcagaagaatctcggttccgattcgctgatcccctggctggacgatgcgctcggcgaggggttcactgcgagcaaatacgcgagctccaagggcttccgtatcattgaagttcgtcatgaaatatgagtatcccgcagaacttcccgtatctgccgcgcgtgatgagatagccagcgcggtcaaacgttcccaagtcgttattgtgtccggccagaccggttcgggcaaaaccacacagctgccgaaaatcctgcttgagcttggccgtggcacgcacggcaagcagatcgtgcacacccagcctcgccgtatcgccgcacgcacggtggccgaacgtatcgcctcggagatgggcgtgaagctcggtgacgaggtcggctatcaggtgcgtttcaccgacgaaagctcgcccggcacacgattgagggtcgtgaccgacggtattctgctcgcccagatccagcgcgatccgaaactcacccgatacgatacgatcatcatcgacgaggcgcatgagcgcagtcttaacatcgactttctgctcggctatctgacggcactgctgcctcagcgccgcgatctgaagctcatcattacctccgcgaccatcgattcggtcaagttccaggagcatttcgagcacgccttgcatgagaaggtgccggtaatcgaggtttccggccgcaccttccccgtgcaggtggtctacgagccgcttggcaccgcgcccgcgttgatgcgcgaagtgccgggattcgcggtgggcgcccgccccggcgacgccgattacgacgagctggccagcgccatcgcggaatccgattccgaccggccccgcggccggtccggtgcctcctatgccgatgacggcatcaccgatatgcctaccgccgtggctcgagcctgcgccgagctggtgattcactcctcccacgagcgcggtccccgcgatattctggtcttcgcctccggcgagcgcgacatccacgagttcgaggccgcactgcggcatcattacggcccgcgcgccgacgacatgcgccggccggatgccatcgagatcatgccgctgttcgcgcgactgtccgccgccgaccagcataaggtgtttgaatcgcaccttcaccagcgcatcgtcattgccaccaatgtggctgagacctcgctgaccgtgcccggtatccggtatgtggtggaccccggttccgcccgtatctcccggtattcgaagaccgcaaaggttcagcgtctgccgatcgagccgatcagccaggccagtgccgaccagaggtccggccgatgcggccgtgtggccgacggcatcgcgatccgcctgtattcgcgtgaggattacgagacccgtccgcgcttcaccgagccggaaatcctgcgtacctcgctgggtgccgtggtactccacatgctgtcggtgggcgtggcccgcacggccgaggacgtcacgaacttcgggttcatcgatccgccggatatgaaggccgtgtcggacggtttcaatgagctcaccgagctcaaggccatcggccgcaagcgcggcgaggtgacgctcacccataccggtcgtcagctggcgcgcatccccatcgacgtgcgtctgggacgtatggttatcgaggccgcgaaaaccggttcgccgaatcttctggcccaggtgctcgtggtcgtggcgttcctgagcttgcaggacccacgtgaacgcccggacgacaagcgtgaggatgccgaccgcatccacaaccggtatgcggatgagacctccgacttcctgacggccctgaatatctgggaccgcgtgttccaagcagacggcgacccgagcaacaacgcgctgcgccgtatctgcaaaaccgagtatttcagctggctgaggatgcgccagtggaaagatctcgtctcccaactacgccagatgtgcaaggagctgaagttcaaggtcggcgacccgctgcccgcctcccgcccaggcttggagatccgccagctgccgttgaatcagcaggccgcgcattcgctgtgctgcgcgtgggatgcggacggcatccacaagtcgatgctcgccggattgctgtcgatgatgggcatgcaggtggtgcgcgagcccaaggcctccgatttcgcggggctgaccggttcggcgcgcgcccgtgcgatgaaacgcgcccagaagcagtcgaagaacgattatcagggcgcacgcggcacccgtttcgccctgttccccgcttccgccgtggccaagaagaccccgtcatgggtgatgagcaccgaactggtggaaacctctcgcctgtgggcccgctattcggcggccatcgaccccgcgtgggccgaaccgttggccggccaattgacccgcaccacgtatgcggagccgcactggtcgggttcgcgtggctcggctgtggccaccgcgcgcgtgctgctgtatggtctgccgatcgtacaggaccgtgccgtgcagtggggacgcatcaatccacttgaggcgcgcgacttcctgattcgccagggtctggtcgagggcgatattcagcagcgtttcagttacgacgacttcgtgggcaaaaaccgcgacattctcgaggatgccgccgatgatgcgagccgcacccgccagctggcggataccgtgtccgacgaggatctgttcgacttctacaacgcggtcattcccaacgatgtgaccagcgtggccgatctggcgaaatggtggaagtccgagcatgaccgtcagccgaatctgcttgatttcgacccggacaaggtggagcgtctggcatccagcgattcggtgagtctggacgattaccccgaccattggcatacgaccggatcggacggccaacccatcgacctgcgtctgagctacgtgtacgatccggccgacccggccgacggcgtcaccgtgcatgtgccgttgaaggcgctctcgcgtatcacgcccgaccagttcacatggaatgtgccgggtctgttggatgagctgatcctgtcgatgatcaaggcgctgcccaagcagctgcgcgtccagttcgtgccggccccggatgccgcgcgtgcgattcgtgactggatcgacgagcattacccggatctgccgggctcgggctcgcagcagaagccgaatctgccgccggtggatgaggatggcacgaccgttggctggcccgatctggcacatgtgttcaccaaggcggccatcgccaccaagggtgcgcagattcatcccgaagtgttggggccggaactggtcgagcgtctttccccgtatctcagagtcacgttctcggtggagcagcaactgccggccggcaagcaccctcgtggacgccggcatgcgcgcggccccatcaaggtgctgggtgtgtccaaggatctgaaggcgctgcaacgcaagttcgccgcgcaggcggaggcgtcggcccgtcaaatggtcaagaagcaggccgatcaggctggagaacagggcaagctggtcagtcaggcgaacctgttgcataaggcgggtgccaccaccgagtcccgggccacgatgctctggcgtggcgcattggatgcgttgcgattgccggccgaacgcatctcgtcgcgctggctgggtaccgaggcgttgatgctggcttctgctccgtacaagtccaccaaggatctggtcgaagacctgcagctggccacggtcaaacggctgatgccgaatgtcgacaggctctcggacgatgaggcgttagccaatgcggtgctcgatgtgcgcgaagtgtacgaggacaccgtctatcaggtggcgcatgacgtgatcgccgtgctcaaggcttatgccgaggtcgacaaggccactggcggcaaggctgatctgccgatgctttcggtgttgcagtcgattcgcgaccatatcgccacgctcgtctaccccggattcatcgggcgcactcccccggatgcgctgaagtcgttgagccgatatttgagagccgatctgagccgactcaataaggcgaaaaccgataagaaccgtgatgtcaagtgggcttggcaggccgacgaggcccgtcaggtggttgataaggcgttggcccgtgccaaggcggagccggccggcccgaagcatgaggcattgatgaagcaggccgaacaggcccgttggatgcttgaagagttctacgtgtccctatgggcgcaggagcttggcaccaaggggccggcttcgctcaaccgtatcaagaaagcgctggcgtgaccggacggcaaacaagtcgccaggccacgcgccagcgcacgcgcaagccgtcatcacagcgtgggcaagtgcgcggacgcctcggcaatcggaacaggaaacgcaatcgtaggcacggtccgatcaatgctctgaagcgttcctggcgtaaggcgaactggccgacctgtatcaagatggtgctgattcccacggtggcggtggtcgttgtcgtagcgctggtggccgggctggttcgtttcacaaactggcgggcacaggttcgcgcagccgaggcggcacagctggaactgacgcgaacatacgatttcaatccgggcaatattatttcggatggtcagttcttcaacggttcggcgatgagtcaggccgaagtccaatcgtttttggacacacaaggcggctcgctggccgcgatgaccttcgacacatcgaacgagtcaggcgaaggcctgtgcacggactatacaggcaccaaaggcgagtcggcggcggcaatcatcgaccagtcggcccgcgcctgcaaggtgagccagaaagtactgctcaccgtgatgcagaaggagcagcatctggtcactgccgtcgatcccagcgactatcagcttatggcggcgatggggttgaactgtccggataccgccgactgcgatcccacctatgccggattctttcggcaggtgtatggcgcggccaagcggtaccgttactatctcgagcacgaggaacagtacgggtatacggcgcacaatctcaactacatccaatatcatccgaacgcggtatgcggcggcgcacaagtgtatatcgagaacaaggcgaccgccctgctctacatctatacgccctaccagccgaacatcgccgcactggccgccggcaacggtaccggcgattcctgctccagttatggcaaccgcaacttcgcgcttatctacaccagctggttcggttcgccgcgaagttgataacggcagccgaccgatcttgtccgattggactcggccaacactgtcagcgttcgacgtatggacgcagcagggtcgtgatgccaaccgccagcagcgaggcgaaagccagcagacacaggcagacggcctacacgcagtagatcggtcgaatgtgggtcaatggttccacgccatgacctttgtcggccagcttgccgccgtacaggttgctccacaggcaggcgcagccaggatgcccgctacccaccacaacgacacgccatagaaaaccccgccgatgaccaatcatcgacggggttcggcacatgtgcaacgcttgcgattacagcttcggcagatacttcttcagctcgtaaggcgtgacctgctggttgtactcctcccattcctggtgcttgttgtccaggaagtagccgaaggcgtgttcgccgagcacgtcggccacgaaatcggatttctccatgatcttcagcgcctcgtccagcgagcgcggcagcggctgaatacccatagcctgacgttcgccgtcggtgagctcccacacgtcatcactggtaggctcgcccaactgcatctgcttatcgataccgtcgagaccggcggccagcagcaccgagtaggcaaggtatgggttggccaccgggtcgagcgcacggaactccatgcgcgcggagttgcccttgcccggcttgtactgcgggatacgcagcagcgcggaacggttgttgtggccccagcaaatgtagcttggtgcctcgttaccgccccacaggcgcttgtacgagttgacgtactggtcggtgaccgcgcagatttcggccgcatggtacaggatgccggcggcgaactggcgggcggtcagggacatgttgaactcctgaccggcctcgtagaaggcgttggaatcgccttcgaacaggctcaggtgcgtgtgcatgccggaaccgggcgcgtcggccaggggcttgggcatgaagctggcgtgaatgccacgctccaaggaaatctccttgaccaccgtacggaatgtcatgatgttgtcggccatggtgagcgcgtccgcgtatcgcagatcgatctcgttctggcctggccccgcctcatggtgcgagtattccaccgagatgcccatttgctcgagcatgttcacggtggcacggcggaagtccatgcctgggctgcgcggcacgtggtcgaagtagccgccctcgtcgatcggggtcggggccttggaccagtcgtcctggctttcgaacaggtagaactcgatttccggatgcacgtagaacgtgaagcccttgtccttggctttggcgagcgtgcgcttcaacacgtgacgtggatcgccgagcgaaggctcgccgtccggggtcagaatgtcgcagaacatgcgggcggtaccttgcgggccaccgcgccacggcaggatctggaacgtcgagggatcgggttgaacgatcatatcgtcttcggacacgcgggtcatgccctcgatggcggaaccgtcgaagccgagaccctcctcaaacgcggcttccagttcggccggagcaatcgccacggacttcagtgttcccaacacgtccgtgaaccacagacgaataaagcgcacgtcgcgttcttcgaccgtgcgcagcgcaaactcctgctgtttatccatagtcgcctatcgttccataaccgtgttacgaagggcgttaacatctcactgttcgtcacctgcgagtcgcgagatttcatcaacatgccccggtccgcatgtcaggcatggttcaggcccatgccggcacggcactatggtagtgactatgagcgaagatcatctcaccccatccgccaatccgcccgtcgacgtgaccagctggacgcaggccaccgacccgcgcgaccgttcgcgcgccggcatcgccactcgtaccaaggcgccgctggacgcacatgccatctggaaggtcaaggagggccggcgtgaggcgatcagccttttggaggagcagtccgcgattcgcgtaccggatctgattccgctgcgttacaagcgtatgagcgccagccccttcaccttctaccggggcaccgtgctcatcatgaccaatgacctggcttccacgccagtcactggcattccggtgcagtgcgtgggcgacgcgcatatcggcaatttcggcattttccgctccccttccgcccgtctggtgttcgatatcaatgatttcgacgaaaccgctatcggcccgtgggaatgggatctgaaacgtctcgccgcctcggtggagatctgcggacgcgccaacaaaatcaaggagaaggaccgtcgcgccgccgtggtccagtgcgtacacacgtaccgcacacgcatgaagtggttctccgaaatggattaccttgacgcgtggtacgagcacctggacgtggaggagacgctcgaccgcttcgagaccaccggttccaaacgcagccgtgtgctgcgcgaggcggccatgaaggcgctgctgaaggataacgacgcggcggcggccaaactgtgccgttatgagagcggcaagctcaggttcaaatccaatccgcccgagctggtgccgatcaatcagctggatgattacgccgacttggatgcgttgcaggcacgtatagacacgctgttcgagagctaccggcattccctgtacgacgatcgccgttgggtgttcgatcatttgcgctatcaggatgcggcccgcaaggtggtgggcgtgggctcggtgggccagcgcgcgtggacgtcggtgtggatcgcgcgtgatatcgacgatccgatgatgattcagatgaaggaggccacgtattccgtgctcgagcattactgcggcgcgtcgccgtacgccacgcacggtgagcgcgtggttcaggggcagaagctgattcagaatacggccgatgtgctgttgggttggtcgagctttatggccgaggatggccgaccgcgcgactattacgtgcgccagttgtggaatggcaaggggtcgattgatatcgacaatctcaacgcttcgggattgagcgatctgtcacgcatgtgcgcatggtcgttggcgcacgcccacgcccgcaccggcgattcgattgcgatcgccaattacatgggtggcaccgacgaattcgatcaggccatcgcctcattcgccgtcagctacgccgaacagaatgatgaagactacgccgtcttcaaaaagctcctcaaatccggcgacctcccttgctgagccgttaagcggacagcccattgggctgtccgtaggaggggtctgagtgaagcgatagctgagcgaaggtagattaacagtctcgctaaggcgagtcctttgcctacttcgctacttcaagcgcttcctggagcgtgaacgcacgtgcatagagggacttgccgaggatggcagaatcaacaccaatttcagccagttccttgatggcgcgcaaatcgtccagcttggagataccaccggaagccgtgaccttggcgtcggtgcgttcagcgacttcactcagcaattgaatgttcgggccggacatcatgccgtccttagccacgtcggttaccacgtaacgcgagcagcccacggagtcaaggaacttcatggtctcaaacaggtcgccgccttcgcgcgtccagccgcgcgccgccagtgtgtgaccgcgcacatccagaccaacagccacgcggtcgccgtacttcttgatgaccgaggcggtccaatccggattctccaaagcggcggtgccgatgttcactcgggcggcaccggcctcaagggccgcgtccaacgaagcgtcatcgcgcacgccgccggacagttcgatgttcacgcggtcgccgagctcatgaacgatttctcgcagctgatcgcgattgttgcccgtaccgaaagcggcatcaaggtcgaccaggtgaatccattcggcaccggcctcaacccaagtacgggcggcctcgaacggcgaaccgtaatcggtttcggaaccggattcgccttggcgcaggcgcacggccttgccatcgcgtacatcgacggcgggcagcagagtcaacgacataagaagagcctttcttcagttacttatacacaatttgagctccctcgtcagagggagcttcatgcttttttacagcgtggcgatccagttcttgaggagctgggagccagcgtccccggacttttccgggtggaattgcgtggcggacagcgggccgtgttcgtaggcggccacaaagcgcgatcggccgtacgagcaccagctcacgcgttcgggcgaatcgctcagatcgatgtcgaagcgggacgtatccgccggcttcacttccatcgcggcgtaggagtgcacgaagtagaaccgttcgttctccacgccgttgagcagcaccgaatcgggggcggcctcgatcgtgtcccatcccatgtgaggcaccacgtcggcgtccagcaggttcaccgaaccgccgatcagtccgatgcctgcggcatgggcaccgtgctccagaccgtgttcgaacatgatctgctcgcccacgcacacgccgagcaccgggcggccagcgcggatgcgatcatagatcacacggtcgccgtcgaccttcttcagtccttccatacatgcggcgaacgcacccacgcccggcacgactaggccgtcggcctccaacgactgccggtagtcggaggtgagggtggtgtcgacgccaagattggcgagcgcacgcaccatggaacgtacattgccgaaaccgtaatcgaaaacaaccgctgtggtcatctgctctcctatcccctactggtttggttggcgtctattcgatgcgggagccgcgcccgccacgtccgcgcctagtgtggttggcgagaatctgcatcgcctgatcatggtcgagtccagcggaatccaccacttcgaacccttgggtcttgagttggttcagggttacgatgccgagcatcaggtcctcgacgaagcgcggtgtggaggtgaacagcacgggcggcgcgaaactctggccggcctctccctgcacgtacatggccacttcgagcttgtcggcacggttgactgcaagaatcacggccatgccggataccacggtggtcaggtccttggctgcggcttccgggccgtcgccgttcagattcttcagcaccgcgacggccccctgattggcaccgatgcatgcggcggagatgtccgacagctggcagaacgcggccaacagttcggcggaggcaagacgggtaacgatcagcgccaccttcgccttgttacccaacagtccagcgagttcgttgtcgaagccgagcgaggggtcgaccacgtcggccatggcctcgttcaccgcatccgcaacggacccggtgacgtcgtcggtcataggctggccggaatcagcggaagccttatcagccgtatcatcattcgcgtcggaatcggacttcgctgaagcagcgtccgctgttttatcggcatcactggtatcactgacatcgccggataccgaatcgtccgcgaattctttctcgaatccggcgagcgcagcctcaagctcctcgtcggagaagtgcgattcgtccggatcgaacttgtcgtcggtcatcacagggctcccttggtgctgggcacgccgtctacacgcgggtcgatttccacggcgaagcgcagcgcacgggccagcgccttgaattcggcttcagcgatgtggtgcgggtcgcggccggcgagcacctgcatgtgcaggcagatgccggcgtggaaggcgatggattccatgacgtggcggaccagcgagccggtgaaatggccgccgatcatgcagaattcgtagccttcgggctcgccgctgcacacgcagtacgggcggccggaaatgtcgaccacggccttggccagcgcctcgtcgagcggcacggtggcgtcggcgaagcggcggatgcctttcttgtcgccgagagcctgcttcagagcttcgccgaacacgatggccgtatcttccacagtgtggtgcacgtcgatgtcggtgtcaccgtgggcgtggatggtcaggtcgatcagcgaatgcttgccgagcgcggtcatcatatggttgtagaacggcacggatgtatcgatatcggttttgccggtgccgtcgaggttcagttcgaggtcgatgtgtgattcgctggtttcgcggacgatgtgcgcggttcttgccatcatgtctcctgtgtgattcgtcatattggattgcggcgggactcgaatcgcttcgggtctcgccgcaatcggaaagaaacgtcccttatgctgcttccactatacgaagcacttcaacaagggcgttacggaaggtttccatctcctcgtcggtgcccatgcacacgcgcagccaaccgtccggtccgaccacacggatgagtacgccgcgcttcaggagctcgtcgaagatggcttcacgcttgtcgaagtgcccgccgaacagcaggaagttcgagccggattcggccacttcaagcggctggtccttgtaggtctgttccttgagccatgcggcggtggcctcgcgggtttcgcgcaggtgctcgacacggctcagctgctcgtcggtgtgttcgaaggcggccagtgcggcggcctgggtcacggcggacaggtggtacggcatacgtacgatgcgcacgcagtcgatgatacccttggatgcggctaggtagccgactcgcgcgccggcgaaggcaaaggccttgctcatggtgcggcttacggccaggttcgggtggtccttgatcaggctcacggcgctcggggtgccgggcttgcggaattccacgtacgcttcgtcgatgacgagaatcggatgcacgccctcgcccgcgccgaccacttcagcggtttcgcaggcggcgagaatacgttcgatatcctccatcggcaacggagtgccggtcgggttgtttgggctagtgagcagcaccatcgagggcttgacctcggcgatggcctcaagcaccttgtcgacgttcagcgtgaagtcggcgttgcggtgggcgagcttccaaccggtgaaggtgtcgcgggcgtactccgggtacatggagtacgtcgggtcggcaccgagtgcggtgcggcccgggccaccgaaagcctggaacagctggagcatgatctcgttggagccgttggcaccccacagctcgtccacgtccagacgggtaccggattcgcgggccaggtaatcggagaatgcctgacgcaattcgatgtgctcacggtccgggtatcggttgagtgtgggggcgatttcacgcacacgcttggcgatggtgtcgcatacggccgggtccggcgcatacgggttctcgttgacgttcaggcacaccggcacgtccagctggggagcgccgtacggctcctcaccgatcaggtcgttgcgcagcggcaggtttgcaggaatcgagctcatcgcagaccggcttccttctcctgctcgcgcagggtggccttgtcatacggatccttgacgaagcgggagagcacgcactcgccgtgggcgggcaggtcctcggataccgcgaaggcgttgatgcgggcggcgagggccttgaggccttcctcgtcgtattcgatgacttcgaccggcttcatgaaggtgtgcacgccgaggcctgcggcgaagcgggcggtgccgccggtgggcagcacgtggttggagccggacatgtagtcgcccagcggcaccggggagtacggaccgcggaagatggcaccggcgttcttgatgcgcttgacgaccgcatcggcatccttggtctgaatctcaaggtgttcggcggcgtaggcgttggccgcgtcgatggactggtcgagaccgtcggtcagcacgatggcagactgggtgccggacagcgacgtgtggacacgctcggcgtgctcggtacgcggcacgcggtacttgaggctctcctgcaccttgtcggcaatctcggtggagtcggtgaacagcacggaaccggcgagctcatcgtgctcggcctggccgatgaggtcggcggccagcaggctcgggttggcggtttcgtcggcgatgatgccgatttcggtggggccggcaaccgcgtcaatgcccacgaatgcggagaccagcgacttggcggtggccacgaagatgttgcccgggccggtgatcttgtcaaccggatcgcacaggatgtcgccgtcctgcggctcgctgcccttggcgccgtatgcgaacatggcaatggcctgagcgccgccgaccgcgtatacctcgtcaacaccgaggatggcgcaggtggcgaggatggtcttgttcggcaggccttcctcattgtcgcgggcgggcggggtggcgatggccagcgattcgacgccggcggcctgggccggcacagcgttcatgatgacggagctcgggtagacggccttgccgccgggcacatacaggccgacgcgctgaatcggaatccagcgttcggccacgcgggcgccttcggcgaggtcggtgtagaagtccttcggcacctggttggcggccacggcgcgggcgcggcgcaccgattcctcgatggcggcgcgcacttcggggtcgagcgtggtcagggcgtccttgatcgcctcgaccggcacgcgcaggttcttgggacgcacgtgatcgaacttctcctcgaagtcgcgcagggcagcggcgccgcgttctttgacatcgtccagaatcggacgcaccaaatcggtggcttcggaagtacccattgcagcacgcggcatcgcggcaagcagttcggcacgggacaggttctgaccacgcaggtcaatgattcgcatgatgttctcactcataacgccccatcgtagcaatgtgcgaggcctaagcggcgaggaacgcccatgttcacccgtatcgtgagattatcgtgcgtgatgtgggttcgtgatacaggttattgacgcacgccaaatgcccgagcggtctcatcgataatcggcatgtcatgcacggcgacgtgactcacttcggaccatcgcgggccaatggctaattgctcaaccaaggcttgcactgcgtcgctgctgccttgtgcttccagctcaaccgagccatcgcggcaattacgcacccagccctgtacaccaagccgacgtgcctgagtcaccgtaaaataacggaatcccacgccttgcaccagtccggtgaccactatatgtttgcggaccaaattcgccgattgcctcatgatgctcagttcctaatccatcgttcgcagcattgggtagaggctcaggaatcgccggtatgcgtcggcatatgtgcgtgcggtgtcaggattcggctggtatacagtgcattcgcatactgattgcagcaggtctggtacattgaataccaacgaggccattgccactgctggcagaatatcggcattggcgaacacttcaataggatgctccaacacatcggccagaatctggcaccacgcattttctctggctccgccgccaatcagggaaatctcggtgggtttggcgtcaaaactttccataccttgacgaatggagaaggccacaccctcaagcgcggcacgcatcatgtctgccttggtggtgtctggatcgaggcccacataggcaccgcgaatattcggattcataacagggaatcgctcccccaccagatatggcaggcatagcacaccgttggagccgggtttggatgtttcgataagacgatgcgcctctacgtaatcgccatcagcgaatacgccggtaacccatttatgcacgtcaccggcgttgaggaatggtacggcattcacgaagccttcttccacgccaaatgccagattcgcagcacctggcttgtcagtgaacggctcgggcgaaacggtggcgatccagcctgaggtgccgatattgatgttgtattgaccagggtggctgacaccgctggcaagtgtggtggcacccgcgtctccaatgcccgcgtataccgcagttccggcggaaaaaccggtgcgttgtgcagcggattccgtcactgtgccaatgttgtcttgcggattgtgcaggtgtggcaatatggtcatgtcgattcctgcgacctcgcataattcggcattccactggccattacggatattcatggccccagctgtggaacacgccgccacatcgtccacgcattcgccagttaattgggcgatcaagtagtccttggaactgatcaatacatgacgaatgcgcgcgtacgtttccggctcgtgttcacgcagccacatcaacttgggcaacggcaagcagccttcgagccggttaccaacggtgttcaggaaacgttctgcaccgccctgatatgtctcggcgagttgcttggcctgttcctcggctcggccatccgaatacagaatggcattgcggacgggattgagctcgccgttcaaagcaataacatcctgcatctgaccgctgaaaatgatgccacgaatgcgagtcacattgaattctgactcggattgccgcgcctgctcaatcatgtgcctggaggccgagcagaaagcttgccaccattgatcggggctctgctcccgatagtcgccgttgataataaggtcaagttcgctactcgcactagctacaatgcaaccctgcccattaactaaggcacccttcaacgccgtggtccccgcatcaaatgcagccacatattccgtagtcatatcgttcatcgtagcgctgaaaaaagaatcattctttgccagcaaaacgcggcttattgcatcgtcttgtttctagaatgggaaattgaacgaatactacgactagtgaggcattatggcaattcaatcgacaatcatgctgaacaacggcactgtcatcccgcaggtgggcttgggcgtattccagacaccggatggtgatactacagtgaacgcggtgcagacggctctggagaatggctaccgccatatcgataccgcaatgatttaccacaacgaggcttcagtgggtgaaggtattcgccgtgctggtgtgccgcgcagcgatttcttcttgaccaccaagctgtggaatgacgatattcgcgcacgccgcggcaaggatgcattccaagaaagcctcgaccgcttgggcgtggattatgtggatctgtatctgattcactggccagcagacggctggcagcaggcatgggacgacttgcaggagatttatgcctccggccgcgccaaggccattggcgtcagcaacttccaaaagcatcatatcgatgagctactgacccatagcgatgtggtgcctgctgtagaccaggttgagtcttccccacaattcaccaatcaagagcttattggccagcttcgtgccaagggcatcgcaaccgaggcgtggagtccgctcggcggcaccggcggtaacctactcagcaacccagtactggccggaatcggtgccaagtacggcaggtctgctgcacaggtagtgattcgttggcacatccagcgcggcatcgtcgtgcttcccaagtccactcatgccgagcgcatcaagcagaacttcgaggtcttcgacttcaacctatcggtcgatgatatgaccgccatctccgccatcaacaccggcaagcgcaacggtgctgatccggacaatttcaatttctagacctttatcggtccagatacgcaaagtggggactctccgtcattggagggttccctcttctatatgctttcgattcggccacaccctaggtgcgagagcctatgtcttgtcggtgtcttgtcttgttggtttcgggtatgcgaaagccccttggggcgtgtgctccgaggggcttcctgtacgtgtggtgcggcggcgtgctactctcccacaccctgtcggctaaacccgaaaaatcatcgtgactaaacccgcaacaactaattgaacacaaacaccttgatgcccttgccgtggacgagcaggcgcatctcctcggggttgtcctcgatgtcggtcgctatgttgatctgcgccatctccaagcgtcgcaggcccatccacgcgccgaacatcacggccagcaccgcgtcctcgtcctgtgacttgaggtcttcgttgatggcatgctccgggcagatcagcccgcccctgtgtgtttctgcaaattggcgtccacagtatgggcactatttttcagcagtataggcggctggtttccagcagaaactgcgtcgtcgggtccgccgcctttttcttggttatctggtcatgagggcgtgctcgctgcggtaggagcctccctcgaatctgatgagcctgccgtggtgcacggtgcggtcgatcagcgcggcggccatgttcttgtcgccgagcacgcgtccccagccggagaactcgatgttcgtggtgtagatgacgctccgggtctcgtaggaatccgatatgacctggaacaggagcctggatccctcctcgtcgatcggcatgtagccgaactcgtcgatgatcaggagcctggccttggcgatctgccggagctccgtgtcgagccggtcctcccgcttcgcgcggcgcagccgcatgagcagcccggtcgcggtgaagaacctgaccggtatcgcgcgcatgcacgcgagcctgcccaacgcgaccgcgagatgggtcttgccgatgccgacgggcccgtagagcacgaggtcctcgcaacggtctatgaagtcgagcgtctcgagctgcgcgcgtccccagtcggcgggcatgcgcaggttggaccagtcgtatccctcgatgtccttcgcgttcgggaatcccgcggccttgaggagccggacccgtttcgaccgctccctggaggcgatctccgcgtcgagccggctttccatcagatccggctggacgggcgtcgcccgctcgatggcctcggcgagcacgtcccgggtcaacggcagccgtctggccgtctccatgatcctcccgcatctggcgatggtgtcggccctgcgcctgcgtgccgtgttccgtccggtcgcgtcgttcatcgttccgtctcctttccgccgttcccggtgatgaaccggtcgtatccggccaggtcgggcccgtcgtcggtgatggcgccggcatcggtgtcgcgtgcacgcagggcgagggtgacgagcgtggattcgtccaatgccgaacccggcccgtcggctatcgcccggctcgcggccgcgaccgcgttgccgaaaccggcggccgcgcatgccgcgcctatcgatctgaggctctgcgcgaggcgtttggaatcggcctcgtcgagccatgcgcgcacgtcctcggggaaatcggggcgtatcgacgattccctccaggatccgggtttggccgcgagcacgggcatggccagttccggatcccgcagcgtggactggctccgtccgtatacccgggggcaccgcgcgacgatctccccggtaccgggatcggtgatccgcacgccgtcccggcggatggcggccaggagcgtccttccgtgcagcgcggcgcctgcgaggtaccggttcgagtcgatgtctatctgcccgtacttgtcggccctgcggctctcccatctgatcgggtcgaacgtggtggaaggcagcggcatcagcgccgcgcgatcctccccgaacacgtccccgatggcggtgcccctgcggtaatgcctcgacgaggcggccagcgcatcgcatctgtcgagcatgatccgtccgagctgcgcgtgggtctcggcctccagcggcgggaccatgaggttgcggcggaggaacccgaccgcgttctccaccgcgcctttctcccaaccggaataggggtcgcagaacctcgcgtcgatgcggtggtgcgcgaggaacgcgtcgaacaccgcggcgggcgtcacctcgcccctcgcgttcctgcgtcccgcgccggtggcgttgtccatgacgatcacgggagggacgccgccgatgtgctcgaacacctcgaccagcccgtggcacaggcattccgcgttctccccgggcaggctcgtcacgtaccgcatgttcgaacgggggaacgtgacgaccaggcagtggtcgtccacgagctcgccggcgatgcgggccttcgccacaccgaaatcgatctgcgcgacgccgggcgcccagacgagctcgccgtacccgtcggaaccgctccggttcgcctcgcgccagcgtctcacgtaccccggcgtcgtcgtgtactcgccgtcgtagccggtctccgcgcggagcctgtcgtgcacgcgtctggcggtatggcgctgcctgcgcggcagcatgcggtcggcctcgagccattcgtcgaccaacgccgcgtacgggtcgatcttggagccccggcgcctgtccatgggcggtttcggggtcatgtcgtccatatcagcgtatctcgcgaccgtggcgcggtccacgtccggtctcctcgcgatctccgacctggacactccctgacggtccagtctcctgatatcttgctgtttgggcatcggtatcgccatcgtcctttccttcccgagcgccgccggctgcaaccggtggattcgttttctggttacgtctcgggaatatacaggcacggcggaccggtgcctgtcctcgtctgggcggtcatatggtgcagttcctgctggaaaccggcagcccatactgcggaaaaatagtgcagaaattgcttaagaaaaattgaagcaaaacacgcccctggggcgcgtggggatgacgggcacctcgtcgatgggattgtggtcggcgatccggtgcgcgaccgcccactggtagaagaccttcacgcaggcgcgcgcgttacgcttggcctcaaggtccatgctgctttgcaggaagaacgcgatcaccgcgtcggcgtccacctggtcgatgggcctgtccacgatcctggaaaagcgcgcgatctgataccatctagttctcagagtctccggcgtgcgtccgatcgccagcatgcttgacagccattgctcgacgctttcgccccagtcatcgcgtggcctgacatgctcgcagccgtagctgttcttgtttgtccagttccttgtcatgatgctcccttgcataagaagagagagggaagcgcagtggcttccctctctgcgaagaacgatggttatatagtcgcccggggccgccgggcggggtcttcaattctatgcgtgcgcctcggcgcggggaatcgggaacatctcttcgaccgaatcagggttcaagtcttccatcagctcggcctcccacatgacgaaatccgcgatggcggtatcatcagaggcaagggtaactgaagcgcctatggcagtgagagctggaactgttaatcggacggtcgctggttcaagcccagccgcaggagctcattggaagccatcggcgtgttgccggtggctttttctgtatttatatccatgagcatctgatcggctttcttgtttccgagcatcatgcgcataatcgcatcgttagacagttcgtccaccgtagtgtcaagatattccgcagccaaaagaacctcttcaaatcgccagtttgcgcgagagatcttgagggacataccggaaggctttatcccgagatagcttgccatctcagtttgatttttgccttctctcgcttgtgcggccagaagctgctgaacgttgaaagaaacgacttttaacttgtatgcggctcgcgccttggggctgacgcccggcattgtttcaatactggtcatttttaacctttacaacaatatgtttacctgttgcaaaatatattacctctcgatttgcgtttagtgcaagtttgtcgtacactttttgcaggtcgtaaaaagtattacaaaaatggaggctggaggtgtgtacgccgatgaatgattggttcaaagaacgcggtatcggccaagagcaggtcgccgccactcttaacgtttccgtctcgaccgtttcacgcatcgtcaactacaaaagagacctcagcatgaggcgtgcgatgattctgcacactgagtatgggattccttttgacgttatgtatccatctcaattgagcgagggtgagggggtgtttgtccgataaggaaatgcccggtctcgatctggtacatcgaaaccgggcgtatgcaacacatccaatgttgaacgattccctagtcgccaaacttttgaatcgttcgcattgccttttagattatggaggctgcacaaatgtctagtgtaaccgaagtcgctgtgccgacttctgattttgatggtaacgcccccgtgaatagttcgcggtgcatggcgtctacattttccgaatccctgtattggcgacgctctgcccggcgctacgagctggcgggtcttgccgcttcgatgctggccgcgttgtcgtgcgtggtttttctggcgattctgcttgccgcgaggaatctgcttctgccgggattcgctttggttccgatggcctgcggcctggcttgtgtgggttgctggtgcgaccgtaactcgcgcgatgcctgggatttcgctttctggtcccttcacgcggaggtgaggcaatgaccatgaccgttggcgcgcgttccctcgataacgaggagcgctcgaatttccgggactacatgtccctgttgtccctgtccgtggatgcgtcgatgaccgtgagggagatcatggcggtcgcctatctgatcggccggcatgacgcgcttcgtgacgtgcggaacgcttcgtcgccggctcggacggtgaaccgtcgtctgatccatggcggtccgtcggattgcgtgttcaatcgcggctacgaggccggtgcgggcatggtgtccgacaagatcgacgcgttgatgcgcgacgtggaggccctcagcggcgatgacgcggtgttctcgatgctcaggcatccttcggtgagcgggggtgatgaatggtggaattggtgatcctgctgttcgtggtgctcgcagtggcctgtttcggcctgctgctgccgttcctgcgtctggcagtcggcatcgtgcttctcgtggtccgtctgctggcctccctcgcgcgatcaatgggggcgggccgatgatgcacctcatactcgtgatcgccgtcgtcatcattctcgccgcgtcctatctgctgacgttcgccctgtgccgcgcggccacgcgccgcgacatgcttgaggcccgttggcgtgaggagtcggccggttccgtgagtgaggagagccatgagagcgcatgaaacgcatgagcgtgccgcgcgtcatggcggcttcccggcccgtggttccgcttcgggcctgttggcggcctgcccgtcggacggcagccacgacttctacctgtcgatgatgctcgacgttcccgtgccgcgcgtgcccatgctgcgcgcacgtctgcaagactcccgccgagggggtgccgcatgagcgtgaacgcggtcgattgggcgctcaggttcgcgcccgtggacgccaggcacaacggtgccgctcgcgtgctgatgtgtctggcgaacgtggccgacgacgaggggcgcaacgcgcatccgacgcacaggaagctggccgcgtggtgcaagtgcagcgtgagcacggtcaaacgccacctgtcatggctggaagcgaacgggctgatccgtcgcggcgaccaacgccaggccgggcatttcagcgagtggcaccggcccgtcgtgtgggatctgtgcctggggaaccgtctggagctcgaccccgacttcttcgactcgaacgacatcgactcgacccgaggcggacggccttccacggaaaacagggcgaggggaaaccccggctcacatgtggaccgtggttatggcgacggggacacgggaaaaccccagctcacgggtgaaccacggttcacagctgtgaccccacccccagctcacctggtgagctacagtacgtccctagtacgtaataacccctctgcccctacggggcatctccccgcaagcggagagacctccccggacgatgacggaatccgcgaggacggttcatgggccgacgccgccggagccgaacccccgagcagcgaatccgccggggctggttccgacgcggaggcggtgtgccgcacgatggcggacgggctgcgcgccatgccgccgatgccggtgcccgaaccgttggcccggcccggcaaacgcgaactcgacgccgcccgacggctgatcgcccgccacggcatgccactggtgctggccgtggccgaatgggtgtcgctgccgccttccaagaccgacaagggcgacgcttccggcaaaccgtatgacggtttctggcgtcgcacgctcaccggcccgcgttccctcgcacggcactgggaccaggtatgcctccagatggccgacgacccccacgggcgtcgcctgctcgccggacacggcatcctcgccgacaagggcgaaacggcgcagccgccgagcgcggaatccacgccgaaggtgccgaactacgggatccccgacaacctggaccggcgcgtgtggaaactgctcgacccttacgacttcgatgcgggcaatgacgggttcgaggcaccgcgcaccctgcgccggctgttgaagcgcgtccccgcgaacgatgccgaaggcgaacgcaatgccgtgctggaggcattgcgggcgggccgcgccttcctggacgcggtatccagggagaaggacgacggcttcgggcagcggaagccggccgagaccgggccggcgtccgtccgtttcggcttcatcggcggccgtgggccgaaggaggtgccggcatgttcctgaagggagaatgcgcggatttccccgactcgtggtcggaccgcatgtgggggcccgacgacctgcccaaccagcgaacccaatacgagctgcgccgcgcggcggtgcggatctgcgaggcctgcccggtcagtgccgaatgcctcgcgttcggcatcatggtccgggaccagtacggcatctacggcggactgccgttgagggcccgacgccaggtgctgaagaccgcgcgggaggccggattccggttcgatccgaacgacccgaacgccgaacagcgtcttgcgcgattcatccgcgcgaaccccgagatcgtggcggcggcacgcgaacgcgaatgcaagcgccgcaagaccgatcagcgcaacgcgcgccagcaacgatggcgcgccaccacacgctcgaccggcaaggcgaaggccccggccgccacacacaccccgcccttgcaggacaccctcttctgaagacaatccgatacagataaccggtccggccccataaggacgaaccattccggaaaccggtatacgcggcaaaccgtggaaccgtgcacccgtggacacgggaagccggaaacccgaatgaaaggaacaatcccaatgaccacgaacacgaaaacggtggccttcgtcaacctcaagggcggggtcggcaagaccaccagcgccatcggcaccgccgaagcactcgcccgactgggccataccgtgacggtgcgcgacgccgacccgtccggcgcggcgaccctgtgggcgcacaaggccctatcggccggccgcccactgcccttcggggtggaggtcgtcaaccggttcaccgtcgccgcgcccgccgaggaggaatcatggagatcaacaagccgatgaccacgaggaacatgctggcatcgaccctcacggactatcggaaaccggtcaagctgctcaagatgcgaggagatggagcgccggctctccgacatacgcaaggcgaacggcgggcacatgttcgccggggcgagggcgggatcatgacggcccaggctccctgcgcgaagatcgcgcggcaagacccggacctcgcggatcgcatgtgggcgaccattacggtgggaggccgtgaggtcgtcgatgccgagaagcgcgcgctcgggcgcagggtgtgcgagacgtgccccctgcgaaccacctgcatcgccgacagtctcgtcggcggatggaaggaccgcaacctcataggaggtcttgactacaggcgtcgcacagtactctcgaaactggtctgccgagacctcggcatcacggcgcgccagctgcacgacatgcccgcgcaacgggtgagcgactggcttgaaaggcatccggactgggccgaccgaatcagactggcggactccagcgactggcggcagcgcaagcgcctgcaacgtcgcaaacgtgaacgcctgtctgtcgcgccgagcttcaccgacgcgacgccggttccgccggccatccaaggcgtcctgttttgaccacgccagaattaccggaataccgaaaaaccggaataccgaaaaaccggaataccgatacgaatccaacaccgaaataccgataggagaaacaaccatgatcgtgaccatcgcaaacgccaagggaggcgtcgccaagaccacaagcgccatctatctcgccgccgcatacgcgcggcgcttcgaggagggggccacggtgctcgatgcggatccgcagtccagcgcgagcctgtggagggacatggccgaggaaaacggcgggtggcccgcaggcaccgatgtgatgccggcgaacctgagcacgctccagcggctggcccgtgccgggcatggcggcttcgctgtggtggacgcgccgccgcagggccggctgttcgaggaaagcgtcaaggccgccgacttcgtggtcgtgcccacctccgattcgcccattgatctgcagcaggcgtgggcgacgatgaacgcgattcccgatggcaagcccggtgcggtgctcatcgtgcgcgccgaaccccgcacccgagccttccaggcgaccgtcgccgctcttgacgaggccggcacgccccgtttcgacgccgttgtgtgcaagcggcaggacatcaaggccggcatggggcactcccccgacaagctccacgagtacccccaggtgctcggcgagatcgtcgaagcgatgggggcgcgcgcatgaggaacctcgacatggctttcaggcccgcagcccgcacccgcagcgtctccggcatggccgacgtcttccgctccgatcagacgggggaatggtccaagaccagcgtgagcatgaggcccgaaacgcggcggcggctcaagacctacgccgccgcgcacgacatgcgcatccaggaggtcatcgacctcgcgctcgaagcctatctcgcatgacgcgagacgccgtgcgaaacaagcaggtgcccgaaccggaacggtgcagagcgccaccggcggcggcatgaacgcgcggaaaccggcaaccccggctccgacagagaatgaccgaaataccgaaaccggtaaaatcggtgcataccgaaacgaacgatgaaaggacacgaatgaaaacggaacaggaaacggaaaccaacaccccgccgcccacgaacggagaaaccgccgccgtcgaggagtcgaggcgtgttcggccgaagtggctggtgccgctggtcgcgggcctgtgcgcgctggcgcttgtggtggccggcggcatcggatggaaaatatggtcggaccgccgactggccgaggcgaaggccgcgtgcgccacggcctccgacgcggcgcgcggcgcgatgaacgactggaacacgctcgtcaacggcgacgcggccgacttgctggaggtcaaggccgatcaggtgaaggacgcgaagaccatcgacgcgctgaaaaccgcgctggacgtggaagcgccggaatacgagggctgcgtggccgacggcaaggacgggcttgaaacggcgatcgacgaactggacgatgcggccgcatggtacgagaagcacaccgggagcctgaagaaggcggtggacgcggtgaacgactcgaagctggcgaagaccatcgacacggcgaaaaccctgttggagtccagcaacggcaacgtgcaggatgacaagacgcgcgaggaactgtccaaggccatcgaagccaaggacgaggccgcgatagccaaggcatccaaggcggtgaacgattccatcgcggcgaagcagaaggccgacgaggaggcgaaagccaaggcccaggccgaggccgatgcgaaagccgccgaggaagccgccgccgctgcgaacgcccagacgcaacaacagcagtacagctatcagcagtctcagccccagcaatcctggacaccctcatacccctacggcggaggctccactggtggcggaagcggcaccacgggaggctccacaggcggctccgccggttcctcctacggcgggagcttcggctacagcagcagcgataactttggaggtgctaggccgggcggaacttgcccggagagcgtgtgcggcgtctgacttgctgacatgcaggcatgaaactcgtccgattcgttcgggcgagtttttttatcattcgcttcggtatgcaccgattttaccggtttcggtatttcggtaaataccccgaatcatgcgttttaggcgtttcccctcctcgtggtcaatatctcgcgtaactgatcggaaaaaatgtccaaactggaccggccgaaatggggttctaatggtttgtggccggagttttccggactccggctaccggcttttaggccggtcggaaacaagaatctaacaggaggaaaccctatggttttcaacgaaaggaaacgggctgatgcccgcaacgggaaggggctgcgcgtggcagtggccgctttgactgcggtggcgacgctggccggcggcggcatggtcgcggccaccgcgatggccgacggcggcggcggctgggctcccggctcggatggcagtatcggcggcgcggtgatcggctgggcctatgaggacaacaacaacggcggtttcggcggcgctacccttgacgcgttcaagaaggccgtggcgaagatgggcgcgacctataacaactacaacggcgtggccgatgagaaggcgaacaccgcgatcacgatggccaacaatgaatgcgtggcccgtttcaacgacaagcatccgggcgagaccgcgaactgccgcatggtcgccgtcggcgtggtcgccacgcccaccacgcactcctattccggcgaaggcttcgccaccgcctcctattggagcgacgcatggaacaaaaacatcgcaccgggtgtataccgcaataatggtgtgtcttatgacactaatgacggtttctctgatgctcctgagcgttcggtggactcgatcgcggcctcccagtggaataacaacccggttgcgatcgtcatcatgttgaaccaatacgagccggtgcagccgaactatcacttgagcgtgagcacgcaggctgcggagatgtcgggccagtcgggcgacaccaaggatgcttcggacacgatcaccctgtccagcgacgggtcgaagaccgagaacgtgaacggcaccgcgaccctgcactggcgtggcattgacggcaccgagaagacggtggcgaagcggttcaccgcatccaacaagggcagcgtcacagtgagcgcgtccttcaaggacatggacgcctcgtgggagtcgtggcctgcgggcaagcgctggtgggacgttgacgtggcgaagcagggcaacatggccgaggcggtctcccacaagggagagaacgacggcaaggagtccggcgagaagaccaccaccccgcccgagaaatggctgaccaacgaggccggcgacacgctgacgcaccgtcatgacgtgcccgtgccgtcccatgacgtgccgtcccatgacgacaacgactacatcgacaactacatcgcctccggcagcctgtacacggctcacatcaaggcgcattccaacgcctccggcaagttctggatctatgacttcatcgtcacgaaggacgtggtgatcggcggcaccgacaaggacgacgtgagcaaggtcaacgtgaccgacgcgaacggcaacgtcgtgccggcggacatttccatcgacgattccatcgacggcatgcgcgtggtcaaggcgcacgccaccgccccgcactccggcgaatacacgctgaacgtgccccagtcggccaagccgaccggcggcgactacgagatcgccgacggttccggggcgtgctggaacggcgacaacggcaccggcagcctggccgacggcagcctggccgactgccagggcggcaacggcgacagcgtgggcaaggtcacgccgaccccggacaaggtgtgggtgctggacgagtccggcgctctcgtggccgaggacaaggattggaccaaccagcagggcgtcgatcagaagactttcctggtggacgaccaggtgggcgcggtcgtcaacggcagcatcccgagccacttgctcaacccgctggcatcctattccatcaccgatgatctgaccggttcgatccagtggatcgactggaagtccggcaaggtgttcgtcgacggcaaggacgagaccgcgaacttcaccatcgcgatcgaccggaaggccgggaccgcgaccgccaccgcgaaggcttcgtacatcgccaagacgatgttcaagaacagcgcgagcaaggtcaagttctacctgacgggcaccatcaaaaagggtgccaccgagggcaagaagatccaactgaccaacaaggcgtacgagaagtggaacaacgagacggtgccgaccaacgagccgccggtgttcgtgtggacacccaaccccaacaaggcgtgggccatgaaggttgacggcaagtggcagctgaccgtcgatccggccaagagcgacaaggtgggcggcgacgacaagtactaccgtctcggcgacgaggtggcggcggtcgtttccggcaccctgcccacaggattgggccgcgtgcccgagatcgcgtggaccgacgacttcgccaacgtcgatagcatcctcgacctgaaggacacctccaacatcaaggtctacgagcaggacaccaccgacgaggccaacgccagcgtcaacgacctgaacaagaccggcagggacgtgaccgaccagttcgacatcaccgccgagggcaccaaggtcacggtcagcgcgaaggactcctacgaggccgcgcagaaggatctgaagaccgcgaagcagatcagcgtcgtgatccccttcgacgtgaacttcgacaccgtgaagctgctcgaatcctacggcaagtccgagggcgacgagctcaacacgtgcgcggacccgaagggcgacgacctcgacaacaagggcggccagacggtcggcggcagcacggtggacaccaacacgccgaagatctgcgtgaccgttcccccgatccacaagcaggtcatcgccgaatcctcccagggcggcgaccagtccagcatcgacaccaagaccgtgttccccggccagaccgtggaatacaccgtgcgcgtggacccgcagatccccgcggaccaggcatattcggtgaccgccatcaagctgagcgacacctattccgagtacaccgacgcgaacaagcagaccctggagatcaccgacctgggaaccggcggcatcatcccgaagagcgcctacaaggtgcagtgggacgagaaggcccactcgttcgaggccacgttcgccagggactgggttgccgccaactggaaggccggctccaacccgtgcgtgctgctgcgcttcgaggccaaggtgaacgaggacgcgcccaccgacaagaccgtcgacaacaaggccgcgctgaccgtcaacaacggcgtcaccccgtccaacaaggtcgagaacgagccgccggtcatcaagccctccaagcaggacacgcagaaggacccgaccatcaacatcgacggcaagaccgcgctgctgggcgacaaggtgtactaccgcgtcaacatcgacgcctccaggctcaccgacaccgcctacaaggtatggcgactgggcatggtggacgactacgaccaggagtacctgaccctcgacgcgaagcatgtggagatccttgacgagaccggcagggaccgcaccggcgagttcaacatccaggacaaggacggcgtgctctacgccttcgccaggaccgtggacacccagatccccgcgaccggcgagaccgtgcccggcgacccgcagcccgacgacctgaaggcgtacagcgagaagtccgacaaggattacgacccgctgaaggacccgagcatcgaccagtcgctgctgggccacacctaccaggtggtcatgccgatgaccgtcaccaaggtcaaggacggccacacggtggagaacaccgccacgcaggtcacgaacgacaagcgcgacaagaccaacaccgtcaccaacccgctgaaggagatcaacccgaccaaggacgtgaccgtgaaggtcggcggcgacagcatcgacggcaagagcgtgtatttgaaccacacgttcctctaccgcctggattccagcatcctgcccccggaccgcgcctaccagaccgtcacggactggggcggcacggaccagctgaacaccgagtacgaccagtacctgggcaactgggccgtctacgccagccgcgacctgtacagggacggccagatgctcgcggccaagggcgagaagatcgcgggcagcggcttcgactcctcgaagttcggcggcaacctgttcaccgtggacgccgacgacaacggcaaggtcacggccgacgcgacccaggcctacctcgacctggtgagcactgacaacgagcacgaggccggctgggtgctctacctccagtgcaagcgcatcgccgtggccgacgaggtgcccaacacatggaccgagaccatcaacggccagccgcgcgaatccaacaaggtcgtcaccaagaccccggacatgaccccgagcatccacctcgaaaaggtcgataccccgaccctcaagcaggaaggccaggagcaggcggaccgcgacgactccaagcaggcgctgaagatggacgccgacagcatcggcatcacgttcatcatcacgaacacctccaagaccgacccggccaccggtgacggcgcatggttcaaggcaagcgacctggacctcgccgactccaccatcgtcggcgacgcgcacgtggacatggattcgctcacctatcccgccgactgggacaccctggtgctcaagccgggcgaatcggtcagcgtgaccggcacgctcaagggcgtcaaggaaggcgagacccacacggaccgcgccatcgtcaccggcaccccgctcgtggaatgcgcgccgtccaacggcgacccgttcaacgacaagaccgacggcggcgaagacaccgatccggaatactccaccggcgacgtgaccgagatcgacggcaagcagctgtgcgccgacacccagaccgccagcaacaccgacgactggaacggataccgtgccaagccgttggcctccaccggcgtggccgtgctcggccttgccggcggcgctctggcggtgctgctcgcgggcggctccctgctcgtgttccgcaagcgccactacgcacagggttccggccgccacacggccgtgaacgcgggcaagtgaccccgtggcgttccggcctcgtcgtccgatgacggccgggacgccctccattgacttcacatgccggaaaggggcataaagctttccgaatcccgtgccccggacggcgtgtgaacccccaggcccttcgccagcctctcccccggcgaagggccttttccatgcccggaacccgtgaacccgtggaaccgtggagccgcagacccgtggaaccgtgctcccgatggggcctgtagacggtgcgccccgcagcggcccgcgacccggcgcatcatcgactctgacattgttcgcaccatcatcattcctctggaggttgcacatggctgacaggcaaaccgcattggccgtattcgattttctcgactcgctgcgcgccggacaataccgcgtcggcgctgacgcggaaaaggaccatgccacggcgggactgctggcatcgctgtccggcgacacggggctgcgcgacgccgtgtgcgccaagctgatatcgccgggcctggaacgcgcccgtttcctcatggtcgccgagcatgatccgcgcgccttgcccctgttcgcctcgggccaggtcaaaccgtggtaccaggccgactacaacgtgcgcgagatcgccaacagcgagttccaccaggacatacccgcactgctgtggcggctgtccaacaccatcccggattccgcgcgaagggagggcgcgcttgaggcggccgcgtacatgagcttcatgcagggcgatcccgaggccgcgttcaccggccatctgggccggctcgcggcggtttcacccgagggcgaggtcacgcgctgcctcatggacgcgcacgagcacggccagcatcccgcatgggtcatggaacggcggcagctgcgcgagcggcaggccgacgccgccgacggcatgaccgccaccgcgccggaccgcccgagccttcgccagcgcctcttcccgaaccgatgaacacctccggcacggacccatgggagatgggccccataatcgccgccggcaccgccgtcgccatcgacacggcacaggaaccggaacgccggccaccggccgaacccgagcccgagcccgggcccgggctggagccggatgcgcgatgcgtggacgacgccggaagcgaaggccgggcgaacccggccgtcgatccgtgggagatcggcccgctgccatcggcctcgaatccggtggggaatgatatcccggccgatgccccggcatcggaaccgcagcacgttggcggtgccgtggagccggccgatctcgccgacacgatcgacctcacgccggtcggcgaccgggatgccgccatgcccgtgcgcgaatggaggcgcatggccacgaccgcgggcggcatcctgctcgcggcctgcgtcacggtcgccggcatgtccgcgtggagatcgcatgaatccgccacggccgcacgcgagctggaacaggcgacggcggactgcgccgccgcccacgctgcggcgaagaaagccgaacggaagctggctgaatatctcgacggcgaccggctcgcacaggcgaaagcggtcacggccgacaagctcgccgacccggaaaccctggaaaccctcgacaagctggccgaacaatattccgagggcgagcgaatccccgcatgtgccgccacggacacggaaacggccaacgccaccacatccaagctgcaagccatcgaaaagaagcacacgggaaatctctcgcggctgaagaaggcggcgggcgcggtgttctcctcacggctggcccatacggtcgaacagggcgaacgattgtattcctcctccgaaggcaaggtgcaggacgaatattctcgcgccctgctgcgcgcctccatcgacaagcgcgacgagaaggccatcaccgacgccatggacaaggtgaacgcctccatcgacgcgaagaccaaggccgacgaggaaaggaaagcgcaggaggaggccgcagcggctgcggcggcgcaggcgcagagcacgccggcaccgcaacagtactcgtacacgccctccggctccgcttcgggctcgggttccggcccgacgggcggcggataccattcctccggcggttccgccggctcgaccggtggttccgcgtctccgggctggtcggtgcccgcgaacccggacccctcgcaactgcccggcaccgacccgagcctatgaaaggaccatcatcatgccacaactgaccacgttgatcccgtcgttcgcggcacccgtcaccgaccgcgtgtggctggtgggcgcgcacggcggtgccggatgcaccacgatccgccattcggatccggaacggttcgccgacgccggccgcgcgctgccggtgagccaggatccctccatgccctcgcgcatcatcctgtgcgccatgggaaccgggagaggtctcgaatcgttgcgcgcgctgctcgccgaccagtcggccggactgttcggcgcatcgatcctgttgggcgcggccatcaccgaccccgtgccccgtatgccccggcctttggtggcggcgcgcatccaactgtcatccgccgtccgcgtgtggcggctgccccatatcaaagggcttgaactcgacgggtttccccggcgttatccggccgcgtactcacggctcgtgaaggacgtagacgccatgccccgcgccacggcccatgtcggctgacgatggtgcatgaacctaacacgaaaggaacaacccaatgctgcatgaaacatacgtgatcctcgccgagaccctttccgacccgaccccgtgcctgcctccgggattctcgggcccggtatccaccgccctgggctgggtgaaggcgctgagcctggtgatcggcgtggtcgcgctggtgcgcatcggcgtgcacatcctgcgccagcagggcgacggcgtgccagaccgcgacgacacgttcgacaagctcgtcaactgggtgatcggcatcttcctcggtgcgggcgctgtcgccatcctcgccgcactcggcctgtccgtcaccgcaagctgctgagaaaaagccatgaaagggattcgacgcatacggcagcgcctgtgcgcgctgccgctcgccctcgcctgcctcatgggcctcgccgcctgcggcggacccgacttcggatcgttcagcaaggagctcacgttcggcgacaagcaggtcagcgacacccagaccacctacgtgatgaagatacccgaaggcaagctcggcgacctgatcggccccagccagatccaatgggtcatcgaccagtacggcgacccgcccgcccataccggcgcggtcgcggtcggcaccaagaaggcggcgaaggatctgctgaggaagtctccggaactgcaatgcagggcattggagaacacgtatcaggaggagtcgtccgacgagggcaaatgggagtacaaggactcctcgtgccggaagcagcgcaagctctcctggctggagaagaccctgtggaacatgtaccaggtgcagtcggattccacgatcgaatggctgtccaccagccgcaacacgctggtcgccgcggacgacacggtatctacgttgcaggcgaacgccaccccgaactacgattcgtggttcgcaccggtgaaccggtacctgcgcatcgcgcagggcgtgctcgtcgcagccgccgcgatcagcctgatcgtgctgagcgcgcgcatcgtgtggaacatcggccagggcggcgagggccgtctgctcgaccgcatcggctggatactgctcggcgtgctgctcggctcctcgtgcgcgagcatcgcgctcacgttcttctcccgctcgtccggcggcaatccgggcctgccgtcatggacgccgggcggcggcaccacgttcttcctgtcggactacatccgtatgcaggttgacccgttccttatcatcgcggccgtgtgcggcgtgatcgcggccggctggaagctcgtcacccaacaggagggacgtgacctgatcccgttgggcaaggcgttcatgtgggcgatcctgagcgccgtgtgccttgccggactggtcaacacgttccaggccacattcgacacgtggaccgccgacgtgctcaggtccgcaagcggcatgatgaacgacgcctgggaatcgaaaagcctggccgcgagctcgttcttcaatctcggcgcgcccgtcgccatcgtgctcaccatcgtgatgtggatctgcgggctgatcagcaagatattcgcctacttccgcgccgggatgctgccgatcctggtgggcgtggcacccatgtgggccgccatgagctggatggagaccggcaagcaggctttcgccaagaccatcggctggctggccgcgttcctggcctacaagcccgtcgccgcactggtcatggcgaccggctcggcgatcatggccacggccgggcccggcgacgacagccaggccatcacgctgatgctcaccctgagcgtcatcatcctccttcccgccatgatccgcgtgatcgtgcccgccgtgcaatcctcggtcggcggtggcggcggcggaatcctgccctccatactcggcatgggagtcgccctggccggcggcggcctgcgcaaggccatgggcggcaagggcggcaggaaaggcggcggcgacggacgcggcgaagcgtcaccggacggtgccaaacccggtgccggccgaggtttggccggactgctttccggactcggccgaaacggcggaaagccgcagggagcgaacggcggcggcaggcacgccaaaccgctggaaggcaatcccacgggcggcgaaccacagaacaccggcgaccagccacagggagcgaaccgcaagggcagcgacggcaaaccgcagggaacgaacggcaatggcacgggaagcccggttccaccggcacccgatggcgcgccacccgacccgtcaggcggcaacaggccgcagggaacgaacgatgccggcgggttcgcccgcgagggcgcaccggacggtgccgaccgctcgaccactcgcaagggcaagacattctgacgcattaaggagattcggataatcatggcgtcgaacacgacatacggggattggatgcggccgatgccgggaggcatccgcaacatcggcataccgttgacgatagcgggcatgggtgtgctgacctgcacgctgctggtcagcatggcgagcgtggtcgcggccatcgcgatcctcgtggtcggcatgggcgtcatcctcgtgctggccatccgcgaccgcgagcaccgcaacatggtggatcgcaccgtggagaagcgcacgtggatggccgcgcagcgttccggcgctaacctgtaccgttccggcctgctcgcgccgatcgacggcggcaaggccatgctgccgggcatcctctccagggtgggcctgacctccgccctggacgggctgggcggcgagttctgcctggtgcggcattcgcacaccggcgaatactcgctgctcctgtcatgccagccgcagggcgcgagcctcgccgacgacgacgtggaggactcgtacgtggcctcgtgggccgggctcatggaatcgctcgcctccgagaccggcgtcacccaactggccgtgaccgtggacacggcacccgattccggcgtgcgtttccgccgcacgctgagcaaacgcatcgtcaaggacgctcccgagctggccgcgcgcgccatggcgcagatcatggaccagtacgcagccggcggcgcttccaacgacgtgacgctcaccttgactttccgctacaccgaccgtgacggcaaatacctggaggccggggaggccgcgcgtcgcataagcctgctgctgccctcgatccgcgagcagatagcgcaggcgggaggcggtgccgcgagggccctgggcatggaggagatcactcgcatggtccgcgtcgcctacgatccggccgcgcaggagaccatcgaggaatccgacgagcccccgtacatcgcatgggaggattgcgggccgctcatgcacgaggccggctggagccattacgcgcatgattccgggctgagccgcacatgggagatggtggacccgccgcaaagcaacgtgaccgccgacacgctcacccgactgctcagcccattggcggactgcgaccgcaagcgcgtcaccgtgctctaccggatgctgccgcccgacaagaccatgttcatggccgaacagaaccggcagaaggcagccaaccaggtcagccaggagaaacgcgccacggtgaggtccatgagccagatcggcaaggccaaccgccaggccgtcgaaacgaaccagggtgcggtcatggtgttcttcgggatgctcgtcaccgtcaccgtgtccaggggcgaacaggaaagccaacgactcgaagccgcgtcacgcgccgtggaacaggccgcaggcggcgcgaagatcgacctgcgcccctgctacggggcacaggacacgggattcgccgcaagcctgccccttggattgaacgtcagatcatacactccagccggccccctcggccggctcctgtcctgaacggaggacacatgatgccgatgccatggaagccgtcgaaacggaagggaaccatgccaagcgccacggccacggaccccgtggcacgcatggaatccatgctgctcacaccgttgaaggccaaaccggacgagcccgtgcccccgatgccgtggcgggggaaacgctcgcgtggaggcggctatgcggccctgatgcccacgatagacgagttcttcggcacgtcgaaccaggtgtgcggcgggttctggccgttcggcaccgacatggccctgccggccgagggggtgccggtcgggcgaagcctgatgacgggtgccggcgtgtgctgcgacccgatcagctggttcaaggccggcatcatcaaacagccctctatgttcctgctcggcctgccggccatcggcaagagcacgttcgtgcgccgcgaggtgctgggactgagcgccctgggcatgaacgcgatcatccccggcgatctgaagcccgactacgcctcactggtcaacatgctcggcggccaggtcatccggctgggagcgggcatcggcgtggtcaaccccctggaccccggcgacctccattatgcgctgcaacaactggagggcgaggcgcgcaaggacctgacggactactacaacgacacgcgcgccgcgctcatggaggtgcttttgacgatcatgcgcaccggccgcgagaacgacaccgatgccggtgccaggggcgtgaccgcacgcgaatccgatatcctttccgtcgccgtgcgcgtgctccacgaccggcacggcgacgacccgcagcctcccgtcatcgcggacctgcgagacctgctgcgcgaaggacccgacgaggtgcgcacggcggcggtctgggacgacccggaaaacgacgagctctacagggcgcaggttcgcggccttctggccgacctgcacggattctcgaaccgcatgacgaagttcggccgtctgttcggcgaccagaccaccgcgcgcatcgacctgtccaggcccgtggacttcgacatcagcgccctggcccagtcgggcgacgatgtggtcgccgccgtgctggcgaccacatggacgagcgcgttcgccgcgaagaacgccgccgacgtgctcgccgaggagggattacagccccggcgcaaccacgtgatcatcatggacgagatgcaccgcgctttgcgcgccagccccctcatggtcgaaaagctcgacctgctcacccgtctgaacaggcagtggggcgtaggccagatcatgatcacgcacacgttcaaggacctcatgtgcatggagaccccggcgcagaacaccaaggcgcgcggcttcgtggaacgcagcgagatcaaggtgctgggcgctttgagccgcatcgaggtggaccgctacctgcgcggcgaatgcggactgcccgtatcccggcgcgaggaggacatgctggaggattgggccacgcccgtcaacttcggctccgacgcctcgcacaagggtctgggccgtttcctgatcaaactgggaggactgcccggaatccccatcaacgtggagatgtgcccgctcgaaaaaagcgggttcaacgatacgaacctcaaatggcacgcctagaagggaaccctgcgatgacagaccacctcgccaccggcatgaaacgcatgatccgcaccgtggcacgctccgcatccctctccgaccggctcggcgagcaatcccggctgctgcggctgacgggcaaccgcagcactctcgacttccgccccgccgagcacggcgcatcctcatgggacttcgaaatgtcgataacccccaccgagcccaagccgtacggcaatgcggaaacccgtgaacccgtatggcgtgagacggtcgattccgccacctatggcgaatcgagggcgcgggtcgcgcacgccgtcgaaacgttcagaatatacgacaacaccggcatcctgccggaaacggaaaaccggtgaaaggaccacgatgaacgacgccgcactgctcgactcgctgcacgccgcgctgcgcaatcccgacctcgcatggtacacggaattccatgccggcgaatccatcgtcgccggctacctcgattccctgacggacccgtatgacgacgatgccatacaggttcccgagggctggttccgctactcggtcgtcacccgtgaaggcgaccacgcccttccatggatggagcactggaacgaatacgagtattcgatcacccatcacatcgattggaacggcaaagggttcacgccatacaacctgtactgcacacaggacctcaccggcatgatcgccgacggctcgctggcctcgatccgggaggacgcgcgaaccatattcaaggaccggtccctgacggacgactaccttttcgccaactccatctggcccgaaccggaactcctcggcctcgtggacgacctgaccggccgcacgggacgaaacctgtaagaaccctgtagacgccatgccccaccccgccatggccttggactgatgatcggggtcatggcgggaacagcgggttgccgccgaggattgtcaaggagccgaacatgcctttggagaacaccgatgccgaagagcggatcacacgggagacgatgatcggatggatcgagcattggggcgaatcgtatgacgacgtgcgacccgatgacggtgccatgcggctggcgaaccgcatcatcgaatacaacgcggcgactgaaaccatcgaggcgttgcggaaccccgatgccgtgtacgacgaactggcatccatcctccagccggtgctctcctcgatggacggcacctatttcgcgggctccgaatggttcgccggcgaagtggaccgcatggaagcggaccgcatcaacggggagcagccggaagaaacggacggcctggcctccgaagaaccccgcatcccgttcatcgtggagagcgaggccacagccgccgatacggacgaaccgccgttggacgagctgatcaccgcagccacacacgaatatctggactcaggcatgacctacgacggattctcggaacatgtgcgcaccacctggcgcaacgccgccgcctacgactggtcgaagctcatggccgaaccacgctccacgggcgaatggtggtccgacgcgaaccggctcgccgtattgggcgtgacgatgcagttcgcgcccgaatcaacatgcatgatgatcgccagcgacatactggccgagaacgctcccctatcccttccggcattgcgcgaacgcatcaatacgccggacggcatggtgaacaccgacctgctgttttcccggctgatcgacaacggcaccacgcccgatccggcgcgcatcgacatggcgatggggatcctcggcccgttggaggccaacgcgccgacggacgcctgctaccggatcatcggcctgaaggccatgctcagcctcgccatgggcgacggcgagaaggcgcgggaactcgccgaacaggccatcggctacgacgcctcggaccggttcgcgtcaagcgtgctcgaccgtctgccggaaaccgatcccgccatggaggcggcgaacgtgtgggagaacggcgggcatttggggcgctgacgtagacgccgtgccccgcgatgccaccggtccggccggatgatgggagtcgccgccgccattgaaggcgctggtattccccgaatgaaaggaccatcatcatgccacagtcaatgcaagtggttcgcggtctcctcgccgcgaaccccgattactggccggcgaaaaccaacgcggacggcaccacgagctcggcgtacctgcgcgccaccgtgtatgaggaccgcccgcgagtccgtcagaaggacggcagctatacggacaatccgctcggcccggtgagaaccaccgtgaaattctggggccaggctgccgagctcctgcacggcatggatttccgccagggcgacgccgtggtggcgaccggccgcatgggcgatcccgacgccttcatcagccagaaggacggcaaggcatacgcgcgcccggtcgtgatcggcgattccatgcagatcgattccatcgtgtccaggcgcatccagctcgcccgcgaacgcaaacgccaggacaaggaacaggccggtgccgtggccgatgccgggcgaacggatccatggacggaccaggttgacgcctcgcgcggcgaatacgttggcgacggcgttccccgcactttcaacggcgagcccttcgacccgctgtcgggctatccgacaccgggcgcggctcccgctccggcggaccccgcggcaccggatttcctttccaccccatccgatttcacgacgggcaacgcccgctagccatgacgcaagccctggcgcatcgacggcgggaccgctgcttccatcggttccgccgtcgatgcttgaaaggagaaatgaatcttggccgacgtcgatccgaaactgcaatcgaaccgagtgaaggatctgggcggcacggtccgtcccagccgcaagatcgaactggcgatcatcgtcgcggtgtccctgatcctcacggtgttcgccctcgtgtgctcccatgcggggcatcccttccagatcttcgcgctcctgtacctggtctccggccaatggtcgctgaccgcaggccagtgggcgctggccgtggccgtgctcgtcgtgctggccgtggcgtgcggcgtgggcgcgtggctgatcgccagcaaggccgtgccgtgggcaaccggcgccaaggcacgcacccgcgtggacgtgtacgcgccggcgatgggccatggcgaggccgtggagaaggtgacgcgccagcgcgccgaggccatggcgtcaaggctcatagaagcggaccactggcgaaagggcatgtcgccgggctatccgctggggctcaacatcgtggacaacacgtcgatgtacaccagctgggaggacatggcgatcgttctggcgggcccgcgttccggcaagtccctgtgctacgcgatcccggccgtgctctcggctcctggcccgtgccttgcgacctcgaacaagggcgatatcctcgacgtgaccgccccgatccgcaggctcgaccatccgaacggccggatatggacgttcgaccccgaacgcatcgcggacccgaaccggaagagcgcgccgtgggtgtgggacctgatcgcctcggtgcagtccatcgccgacgcgaaacgcatcgccgactgctggcgttacgcctcgggccagccgcagaccggcggcgacgacttcttccccggcaccgccgcccagcagctcgccgactacctgttcgccgcgcatctgggaggccgttccgtgtccgacgtgttcaggtggtgctccaacgagcgcgacacgtcgccggccgacatcctgagcgaatacccgcgctacgcgggcatcgcctcgcgcgtgtccagcgtgatcgcgctgacgccggaaacccgaagcggcgtgttcggcagccttcagaccatggtcgcgttcctcgcggaccccgagatcatcgactggatcgacccgcaccgggatacgaatgggaacatcgacgagcggcgcggcctgttcgacccctacgagttcgccacgagcgaggacaccctgtacctgctttccgcacagggccgtccctccaccgcgttgaccgcgagcctgacggcggtggtggcgttcaccgcgttccaacgcgcccaaagcgagttcgccggcaacaaccgccgtctgccggtcccgttgtgctgcgtgctggacgaggccgcgaacatctgccgctggcccgaactggcggacgtgtactcgtatttcggttcggcgggcatcccgatcatgacgatctggcagaaccccgaccagggcagggccgcgttcggcgagacgaacttcggctcgctgttcaacaacgcgaacatcaccgtgtacctgggcggcatcaaggacgcgaagttcctcggcgagatcagccagctggtgggccagagggagatcgtgcgcggcagcgtcaacatcgacggcaccggacggcgcagcgtgaacaactcgatccagaaggagaacatcctcgacgtttccgacctgaccgaatggcccgtcggacgcgcgctgctgctcgcatcccaatcccgagcgcagatcgtcaagaccctgccatggacgggcaacaggcaatgggccgacgccctggcgcaggccaaggcgaaagcccgagacgagcagagaaaggccgcataatgagcgaacacacctcgaacaccacgtccggccctgatggggaggaatgggagcgcgcggtcggtgccgccaggaccctgctgtcatcggactgcggatggctggaactgttcacccgcgccatcctggaggagaagggcgtgccttacggcaagggactgcccaaccccgaagcgccgcacatccccgaggacaaggagatcgaggaggaaaccatgccgggccaaggcgagccgacgccgaccgcacccgaggtgccggcaggccggcacgcggcgggacccatccgatccgggattccggccgatgccggggaaaccggcaacggctacgagaacccgccggaagacgcaacggaccgtgacgacacccctccaaaggccggtgcggaggaatccgacacccgtatactgcccgcgccggaggggaagacggatctcggccgagacgaatccggcgacctcgatcccgcgcgggcaagggacgtgtccggccagttcggcgcgcgaatgcggcgcagcgagacctactatccgaacctcgccgcgttcgtggaaaggttcgtagccaacgtgttctgctaccaccagagcgcgagcgtgaacatgcaatgggtgagcgactggtggcgctatccggcgctcgtgttcccgctcgacgccatgtggcgcgcctacgagaacgcgcgcaaggcacccggccagatgatgatcttctacatccaggcggcgtcgatgctcgaccgcgttttcgacaaggaccgtggcatcgtcgccagcctcgactgcaagcagaatctcaccaggaagggcgaaccgctgccctgcgaacgcccgaaccgggcatggcgcgaaccgatcctggaaacgttgtcggtccccgccgcaggcggcaaggaaaacaaggaaaccaccatcacgccaacaaggaggagaaacaatggctcaaactgatcccgaggacggcttcgaccagatcatggtccagagctggaacagcgtcgcccagcagctgcgcaccctgcacaacgagctgagcggcgaccgcgcgcgacgcagggaacgcgccgaacgcgccgtccagaacgaacgctacgagcagaccagacggcagcagcaatccatccgcctcgaacaatgggagatggacaacagggaacgcctcaacaaggggttcgagtccaccctgaacgcgaccgtgcttgccgacggcgacggctggaggaagatgcgcgactcgtccctcttgcaaggatggatggtcgccgaccaactggagggcaacgaccccggctaccgcaggcagatcatcgaggcgaaggcccggctgaaggacgaatggtcgaaacgccacccggaaacgcacatcgacgccgcagccgaccaattgaccaaccacgtgaacatcacctacaccgaccagtcgcccgcgttgcaggccaccctgaacgccttcaacacggccggcgtgcccgtggacctgcaacgggtggaggacgcgcaggcgttccaggccgcgcacggcgacgacgccacgttcttcgtggactcgcggctcaccggccaatggacgggctacgaccacgacaggatcgtcgaagccgtgatgtgcgcgccggtcaacggcgtggacgacgccgcctcccgaatcagcttcctcaaggaccagggcctgccggaatcctcgcacgcggacaacaaggccacaggagacgagcccagcaccataagcgaggccgaacgcaccgagaacgctgacgccgcgcccatcatcgaaacccccacacccgtgcgggagcatacgaagcccgccgccgatgaacgcaaaccggcatccggacccgagcccgagaccacgggaggcggcgacctgacgaccggggagcccgacggatacgaggagatgccactcgacctgaacgaacccgaggaatggaacgggcccgacccgttcggcgaatacagtcccgccatggaatcctccatgaaccccacggaccagccgatacccgaccaggccaacgtctcgacgccgcagatcctgcaacccgagaccaacggcaacgcacgctgacgccggcgcacccctttgccatgaggcgagcggggtgcgccggcatcggatggccgtatcatggtgtcaacggctttcggaaccggaaaggacgagcatggcacacgtgacgttggatctgtcgaaatatgacgccctgaccgcctacaagggtcttcccgacgagaaggaggagaacccggcgcggttcttccccgacacctcgtcggtccgccgttgcgtgcgcgaacgcatgtccgtcatgggtctcgacgccgccgaactcgccaggagagccggggtccccctctcaagcgccgaagagctcgtggagaccggtctgacctccatccgctacgtgtacaggatgttcgacctgctgcacatccgcaccgaaacgctgccgtccgcctacgcggggagactgctgtgagggaactgcacgcctgggagaacgggcatcatgtgggcgtgttctcggaagacgacgaggagcgcatatcgttcacgtacgacgcgaacgagggtctgccgatcagtctgagcctgcccagaaccggcggatggaaagaccaggcaccgcgtaacttcctggacaatctattgcccgacaatcccaacgtccgccaggccatgcgtgagcacctgaatgcctcctcggccggcgtcttcgatctgctggaccgggttgacgccaccggcggactggtgttctccctctccccggaacctccaatcccatcgccgacgcttcgtctgatctccgattcccagatagccaacgaaatcgaccgcatcgagcggaccaggaactactggtgggacgaggacagccactgccggttctccttgggaggggcgcagggcaagttcacactgtcccgcgtggacggcaagtggtattggccggatatgatgctgccctccacccacatcgtcaaaccgaagccccatgaccttcccgaggcgaccaaggtggaactggcgacgatgcgattgtcggaactgtgcggcatcgacacaccggcacgcggcgagatcacggcgcagcgcaagacggcctatatcgtggaacggttcgaccgtcgcctggaggaaggccgaatcgtccgactgcggcaagaggacttcctgcaagcgttgggattgccgacccgcgacaaatacgatccgtcggccgatgactgcctggatctcctgcaacgcatcgatgcgtcgggttccctgtcctaccggtggctcgaaaggctggccttcaacacgtcgtccgccaacagcgacgcacatgcgaagaactattccctgatcctcgatcccgcatcggggatacgcctgtctccccagtatgatgcggtcgccaccaggtattggcccgagttcaattgggaactcaccatgccgttgaacgaggatcacgccttcgcggagcacaccacgccccaggattgggaggatctggcgacacgtcacggtctcgatggttcgagggtggcggatatggcccggcgtatggcggggaaggtcctcgccggcatatccgaatcctgcgagggcctggacgcgcggatggccgatcgcctgaacgcgtgctggacgaaggcgaacgagtccatcgagccgatcatgccgggagacgagccggcgaactctctcgatccggcatcggctttgcccgattcgctcggttttccttcctcgggccataccatctgagctttttccgggaagcgtcctaacggcggggccggttctcctcgtcagaggcgaccatgctccatagaccgtattccggcgcgattccgtagcgttcacgcagcatgtcgaacgtgtgcaggccctcgcgcatcgctgcccggtattcgtcgtcgtccgccgcgttgttgaggctggcggcgatgcagaacgcttcggatacgaggcgttccatgtcgtgcgtggacaggttctccaggtgccgttcgcgtccatcatcgaggaagggcgggcggttctccatcgcggcgcgccattcctgcacggccagggcgcggcttctggcatcgtccgcccagtcgtcgcgcagtcgtttcaatcgcatgtcgtcgccgagctcgaaggcgttgaaccgttccgtccacccgtccgtgctgcgccacgtgatcctgtagccgaccacctggccggggtcggtgaacgagtctttggcggttcccctgcgcagcctggggtcgatggagaagccttccctgcgcacgcggcgtatgaactcgtcctcgctgcgcgatgccttggcgcacgcctccacgatccggccgacatgctggcgcggcatcgttgaggcggcgaccgccgtgacgagccggcttctctcgttgccgtccaacgcatcccatccctcgtcgtcgccgtactcgtttcgcgccttccattcggcccattgacgccattgcccgtactgccagctgacgcgcgtgccggtgtcggagcgtgcgagctcgaccagttcggggcgtgtcttctccatccgcctgcatgatttctgcgcgttgatccggtcgtggtacgggtttatccacccgtcgtcggcggcgagctgcaccatgatgtgcacgtggtcgttgccgttggcggacagtccgtggcggaccgcgagccatgtgacgccctgatcgtcgtcgccgtcgatgatgttcatgcgcgtcagataatcacggatgacggcctcccattcctggtcggtcaggattccctgcccggccttgatggcaagcgagcagtgccacacgcgcttcctgccatgctctcgttcgggattgttcttgcccctcatgtcgggcgggaacggatcgtccttgcgttccctgacgcggtagcgtcggtcgaacctgcggcctatctccgcatacgacgccgccggcttgccatccatgtcaaacgagggaaacatgtcgccgctcgcgcacacgagatgctggtcggtgtgttcattgcgccgtcccttgccgaacaggtagcgcaccaggccggccgggtccgaacccctgacgatactcggtatcatacgatgattctccgcccgcgcgcccggcacggcggcgcatggcgtctatgagagatatgcgccctttgccggcacggccacttcgatagaattatcggaaacggataaggggctttgatggaaccggtgaggaacgatacgacgacggataggcgcacggccgtggaactggcgaagcggctgctggtcgatttgatctggcgcaccgccaagatcgaggttgatggcgtcaccttccccgacacgcaggaaatcttcgacgggcgcgcccccgagggtatgagcgtggacgatatagtcacggtgaataacatcaagcgcgcgtggaggttcctgctcgggaacatcgactatccagtcgattggcagtacatccgcgaatacaaccgcatcatcggcgaaggccgcgtgcgcgacgccggccgcttgcgtgaatacggcgtgaggatcggcggcacgggatgggtgccggagatccccaccgtcgaatcctcacaggaaagggttcgcggcatcctggaggagtcagaaggggaggacactgcgatgctgctgttcggcgcggtcacgcggggacaatggttttcggacggcaacaagcgcaccgcgctgatggtcgccaaccaccagctcatacacgacggcatcggcgtcttctcgatccctcccgaagacaaggcacagttcgtctctatgctcctgcgctactacgagacgggcgactactcccggctctccgattggctctcacagaacgccgtcggccatgtgcccggcgggctgactttggcccaatcgtctggggccgcggaaaagacgaatgatgccgcgaacgggatgggcatcgtgcccggtgttcccctcgacggcctcgatggaggttccggcttactgaggtgacggtcgtggcgtccgggggtgctcccgaactccatgggattatttacggtcggcttgcgtgatgatgacttcgagccggcctataagtttccggcgctgccgcaccgtgtgcgcggccgttgcctcgtcgcgttcgctggcgtgcatctcgcggttcacgttgtgcgtgatctggttcacattgacgccgatacgacgaaccatggcgtctacgcagccgatgatttcgcggggtgtcgggccgcgcccttctcatgtgctatcctgggtttctcgggaatcggaggaaccgtatgagtgagatcaggatagcggatttgttcgccggcatcggcggcatccgcatgggaatggtgcaggcgctgggcgatgccgcgcacgtggtgtattcgtccgagtggaacaagtacagcgtgcagacctatgaggcgaactggcacgacgagaatcccgtggccggcgacatcaccaaggtcgacgagcatgacgttcccgacatcgacctgctgctcgcgggattcccgtgccagccgttctccatcgccggcgtctccaagaaacagagcatgggccgtcccaccggcttcgaggacaagacccaaggcacactgttcttcgacgtggcgagaatcatcaaggcgaagcagccgaaggcgttcctcctggagaacgtgaagaacctgctctcgcacgaccgtgggcgcacgttcaagacgatatattccgtgctgaccgaagaccttggataccacgtcacctacaagctgatcgacgcggcgggcttcgtcccccagcacagggaacgcacgtacatcgtgggcttccgcgaggagaacgggttcacgttcgatgacgtgaagcccatcgcgcacggcaacgtcggcagcatcctcctgcccgcctcccaggttcccgacaagtatgttctgagcgacaagctgtggacgtacctccagaactacaagaagaagcacgaggccgcaggcaacggtttcggatatggcatggtcgatgccgccaccgaccacacgcgcacgttgagcgcgcggtacggaaaggacggcagcgagatactggtctcacgcggcgagggaaagaaccctcgaaggctaaccccgcgcgaatgcgcgcgactgatgggctacccggattcgttcagtatcccggtatcagacacgcaggcataccggcagttcggcaactcggtcgcagtgccggtcatccgagccataggcgaggcgatgaaaccctacctgtccgactgattcgcccgaggcgtttcctgtccgattggtctatgctcatggattatgagcgattacggaagaatcggcgactacatcggcccggtcgcggccaagaaactgtcggccgtcgatatcgacgccaacagcagcaaccagcacgagttcggcggcaacgacgcgctcagaagactgctcggcaccggcgaggatcgtagagcctcacaagggcacggcatacccaccgcgctcatgtacctgagcgacgatgacgcaccggcggtcgccgacctcgaaaccacatggtacgacgcgcggcgcaacaacccgaaccgcagcgccgaatggcgtctctactacaaggactgcgagccaatccgcatggcccgccccggcgacctcatgtgcttcggtatgctcagggacaatcgcctgctgatcatcatcgcacagcatgacagcacggccgaagcccaagccaaatggctcttcggcatcgacgacgaacaggagggcgcgttccgcttccacgacaatacggaacgtgagctggacgccttcggcgcgcagatcttcgaagctctcggcatcaacgtcgaagtgcgggatgacacgtatctccccgagatgatcggcagatggggatacaggttccccagcaacgaggagttcgcggccttctcccaatcctccttgacggacgtggatcccgcgcacgatgaccctgacgacgtggtgatcgaatactacgaccgcagctacctgctgttcaaactctatgagcgggcggtcatccaacacgactacgatgccgcgccattcgtatcggatggcgtcatcgacgttgactcgttcacttcgttctacacttccgtacgcaaccggcgcatgagccgcgcaggcaaggttctcgaaattcatatcgcccacatcctcgacgcgcgcggcatcgaatacgaggcacaggctaggacggagaacggaaagaaacccgatttcctgttcccctcgcaagccgcctacgaggatccggcattccccgaggcgcagctgcggatgcttgcctcgaaaacctccatcaaggatcgtttccgtcaggtcgccgacgaagccaaccgaatcagggacaagcacctgttcacattgacccccggcgacgtgacccatccaaagctcgcccaactcgatgaactgcacatccacctggtcatgcccaaggtggtcaaggaatcctatgacgacctgatccagggagagaccatgacgttctcccggttcatagaagaaattcaaggactgcaagcggaccgtccgcaaagcctgaccttgctctgacccgttcgcttcatcggacacccatgcgtgccgccagttcggcaacagcgtggccgtccccgtcatcgccgccatcggcaaggcgatgctgccgttctgaagtaggattgatagaagcatacgaaaggagccacgatggacgtttcggcaatcagacggccgcaggactggcctttccccattccgcagatcactgcggatagcattgacgagctgatcgatgcgttgcgccgggacgtgtcggactcgactctgagcatctactacgacgccgtggacggatgcagccgcgagatggcgaatgaggatcaggaaatgatggtgcgtgactactatctgcatgacggatgggcggtgaagcatggagcagatgcatgatttctcgccgtatgcgttgaaagtcagcgtatatgacggtgccgccgagaagcggactatgctgatggacggccacctctacatggtcaagttcggctatgacgcgaacccgcggacggagcactccagccgtaccagctatgtcaacctgcccgtcaatgaatatatcgggtccaaggtgttcgccgcttcgggcatccccacgcaggatgtcatcctcggtgattatcagggacgctccgttgtggcgtgccgtgacttcatgtacgacttggacccgaacctcatgctgcttcatttcaagcagctggagatcagcatgcccggagggagcagcaggtcgaaggcccgccccgattgggagttcgtcagccaggtccttgacgagcatgacgctctcgaaggcatccgctctcaggcgtggcatcgctttctccagatgacatgcgtcgatgcgctgataggcaacttcgaccgtcatgcgaataactgggggttcatcgcggacagaagaaacgcggatattctcgggctcgctcccgtgtatgactgcggttcgtcgctgtccccaagtctgtcccgcgagggaatgagggaacgggtcgaagatcccggtcaaatgcgcgaggcgaacatggcctcgccgtatatggcgatgaatgtcggaggcaagcgacgcaagttcgccttcttcctgacctcggacacggcccggcctttcagggcggagctgccggaactgtggccgcgtctgtccaaggaggtcacggaccgcatcgtggagcagactccagggctcgatgaccttcaacgtgatttctacaaggccacgctggacgcccgccgcaagtacgtgctcgaacctgcataccggatggcgctcaaagaagtggaaacttccactgccgggaatgacacccttgcgaccgacattgttccgggaatcccgattccgggtcttacggacggcaccggtttccttcgctgaggttgttccgcagtctgctgtctgcggaacaacccagcttcgccgtcaatcgttcccggaccgttcgagaatggcatcgagatggtcgattagctcccggcattgccgcatggcgtaggacgccgatgcctcgtcctcgatggtcgcgttcatctcccggttcgcgttgtgcgcgatctggttgacgtttcggccgatgcggcgcaactggtattcgatgtccctgagcgcctggacggtgggtgaatcatgttcctcctcctcgacgtacaggcttccctccaacagcttcaccgcttcgatgacggtgagggagacggtctggcctcgtcgtcgcgcggcatcctggagcatccgcttctcgtcgtcatcgacgcggataagcaccgctttcccgcgtggcccgcttggcctgcttcgtctttttctcgccatcggtttcctccttgcgtgtattgctgatgattgagccttcggcactcgggttgttgctccagcgccgcagggcgcgggaggaggcgggctcggattgtatatacaatccgtctagcttgcttaccttcgatttgatgggcatctccatgtgggtgtccatggacatatccatgtgggtgtccatggacgtgtccatgtgggtgtccatggatatatccatctgagcgcataggaaaacgcatgagggtggatgatcgttcggggtgatgccttcttccacgaatgggaaggggctcttcctttttttggaatgtcatcttcccgcatccttcgtcttgagctccttgagcagcatcgtcgcgttgtcgcggatgctcgcgtccgtgagcggggagagctcgtccgcataggagcggcagaggagcgcgtacacccgttcccgcacccaggcgctgcgcgcgatgcccagcttgaatgcggcccggcacagcatctcgtattcgtcgccggtgagcatgacattgagctggcgtccctgcttcagcggatgttcggggtcggggtcggtgcggtacacgtcgttccaatcggtggtgccgggggcgagttccgtgtagctgaacggctggatggcgtatctcacgaaacgggatttgggtatgcccgtcttggcggaggcctcggcaagcagattgaacagctcccggtccatgaggacccggaaggcgtggctgtatcgtcgcatggtttcatcgtctccttggtcgttgccgtgcccggcgcggcatggtgcgtcgggcacggatggttggctttttggtcagcggtcgaagtcgaacgccgtgccgcgtaacttgtcgatgcggatggccgcgtcgaacttcttcccggatttggatgtgaagcccttcagggtgacggattgtcccgcgaggagcctgcgcgcggtctggtcggtgatggtcttgcccgcgatgcgcgcgaacatcttccatccgcagcctgcggtcgtggcccacttgccgtccttggtcttctcggtcttgttcgtggaacactgccacatccggccggttttcctcaccggctggccgcagcgcgggcagtcgccccattcctgcgcgtcggtgttcgcggttcgtgtgacggcatcggccttgaggttcgcggtcgcgtcggcggggattcgcaatgcctcccggtggaacatgtccatcacctcagacgggtcccgtttgccgtgttccacgtcggacaacgcctgttccatccgtgcggtgagcagcacgtccttcagtcgtggctccaccacgtcggtgaggcgttcgccttccgtggtggcgtgcaattgccggcccttgcgttccacgagtttggagcgcacgagcttttcgatggtgtccgcgcgggtggcgggtgtgccgatgccgccggaatgtgattcgtcgtcatcgagtgccgccttgaggtttttgtcctccacgcaccggctcgcgtgctccatcgcggccagcagcgtggcctcggtgaacggtttgggcggccgggtctcgccttcctcgaccgtgaccttcccgaccgggcgaatgacgccgccttccatgaggttcgatgggatcacgttccttcctcccgccgggttcgcggtttcctcgtcttccggttcgggcccgtggccggtttcgacggccttccatcctgcggatacggtctcgtcggaacgactggagaactccctgtcggtgtcgtcggaaagccgggccttcacctcggtgacgatgtgcacatggtcgtcgcccacggcctcccacatgcggcgcacgatgcgtgtcatcaccttgcgctcgtcatcgtccaggccttccagcttcccggcgtccaattgcatggtcggcagtatcgcggtgtggccggccaccttcgcgtcattgacggccagctccgggcgcgggtgtccgggtatgccctcgcgggtgacgaacccttgggcgagacggccggattcgaggagcgccgtgagcgtttcgaggtcgtcatgcgtgatgtaccggctgtcggtgcgcggataggtggcgagtttgagttcgtagaggtgctgcaacgcctggagcgtgcgcgcggcggtcatgccgtgcatgcggctcatgtccttctgcaatccggtcaggtcatacaggcggggcggccggtcgttcacccgcctccggttcacggacatgatgcggaagcggccgtgttcggcctggccgcacagcagcatcgccgcatccttgctgtcgatccgttcgctggagagccgccatccgcccatgtccgcgatcacggtccagaacggcaccggtttgtggttcctgatctgccggtcgcgttccgcgatcatggcgagcgtcggcgtctgcacgcggcccacgctgaaccgtgcgttgtagagcagcgagtacgcgcggctcgcgttcatgccgatcagccagtccgccttcgacctgatctccgccgaccatgcgagcccttggtattcggattcgggtttcatcgcccgccacgcggcctggatggcctccgcctccaggctcgccacccacaggcgcagttccggcttgtgagagccttccatgtccgcgatgcggcggaagatggcctcaccctcgcggtctgggtcgcaggcgttgacgaggcaatccacatccgttcggcggatcagccgcacgatctgccggtagcgggagccggcaccgcgctcctcgctgatcttccaccgccaatggccggacgggtccaccggcagcgtgtccagactccatttcctccaatccctgtccttgtagtcctcgggcatggcaaggtcgatcaggtggccctgcgcccatgtcacgagcagctggccgcactcatagcatccgtccctttggacgggcgcggcgcacaacgcctgcgcgatggccgtggcgaccgatttcttttccgcgatgacgagcttcattcttcgttcgcgttccttccgttttttgggattccttgattcttgtccgacatgcgaggaccggcgcgggaatcccttcccggccggccctggatggaaaggcgtcgccaaggtcaggcggcgaagccgagcagcggcgcgaacacggcggcgatggccagcaccgcgatcagcatgaggatgacgccggcgatccacgcgatggccgtcaccagcgtgcggctccaggtctgtccgccggattccacgatcatcgggctgcccatgcgtttgccgatgatcgcgcacacgcccgaggcgaccacgcacagcagcacgagcaccacctggagcatcccgttgagctcgaccagccacgtccacaggcccatgaaccagccggcgagcatagagagaaacgattccattgattttcctttcacctgattggaacgacgcttccgattctcggccgcaaaacggccggccacggggcacggcgtctacacgccccgccttccgccatggggaatgtagacgccatgccccgtggaacgcgcgacgggaaggcagactcgccttgacggaaaaacgagcgaaaggaagatcgtcgtggcgaacaaccagaacaccatgcgcgacatgaaacgcagcatcctcaaggcggtgcgcgacagccagaggacgaaacaggatgcgatggacgagtacgtggcggcgcgcgtcaacatcaaatcattggaggaacgtctggaagaggcccgcgagaaggccaccctgctgcgcaggaaggcgaaggacgcgggaaacaccagcgccgaactgaaaacggcggacgacctcatagacgcgcggtggacgggggcggaagacgggtcggcggaagacgggtcgcccgaaaacgcggatccgggaaccgtgaaccccgagcgggagcatccggccatggaaggaaacacgcaaggcggcatgccgggtgagccgaaccgttgggaaggcggtgaatcgtgaaccggccggaaccgcgtcagctgccgaaaccgctgcgcgtcctgtgcctgttcgtcgccgcgctcctcgtgtgctcgctgggcgtcatcgtcgccaaccaccagccgtcaacggccggcgacgaccacggttccgcgacggacgcgaaacaggagtccacgggcaaaaggaaaacggattcgggcccgcgacggtacgccggcctggaggcggcgggaatcccggttcccggcgactggtctcagcgcaccaccgcgttccccgttgacacccacaaggacggcacccgcacgctctccgaaaacgcggacggcatcacgctgcacaatggttccggcccgatcgacaccgcattggaaacggtggacgcgctgctcgatccaaacggcagcgacgacgaatggcgcaagaacgtgttcgcgctgctcggcgacgacggtgccggggaaagccatccggtctccgacgcgccgcgctggtggtggacccagcgccgcttccacgccggatccgtatgctcgggccaatacgatgacaagtacgtcaactacgcctacacctgcacctccgacggcaaatgggagggctcggatacggatgccatccagtcccagccgttctggacgacgaaggaaaccagcttcccgatcccggaaggcggcggaccgtcatccacgacggatccgcagcagaccgtcagccaggcgtacaacaccgtgctcttgccgatggacgacggcaactggcacgtcaccgtctactgcccggccgcgctcgacgcgtcattgctggacaaggatgccaacgagctcgaccccgatcaggtgaaggccggcgacgaggcgtacacggtgatctccgccaccggatacggcacggtccagcatccctgccggaccgtggaggtcgtggtcggcgggcagaagcccttctggtcgctgaggaacacgcaatgagccgggccagccgccatcggatcctcgcggccatgctctcggcgtgcctgctgtccctgctcggcggatgcacgccgttgaccgtgctcgcggtcctcggcggctgcaaggacggcggctccaacggatcgtcgggaggcgtcacgggaagcgtcgtcaccggcgaggtgcgtgacggcatgaccatcgcgcagaccaaggcgtggttcaacggatccgacgggcccgacaacgtgtgccaggcctatccggacgggcaatgcacatggtgggcgtgcatgagaggccataaaaacggattggacgtgggctcctactggggcaacggcggcgactgggccgccagcgccaccgccgccggatggaagaccacccgcaccgatcccgtggccggcagcatcgtcagctacccgcccggcgtggccgacgcggacaccctgtacggccacgtcgccgtcgtcgaggcggtcgaccggacggccggcaccgtgaccatcagcgagatgaacgggcgcggcggcctgggcatcgtcaaccaccgcacgcacaggatcaacgtcggcgcggtctacatcctgcccaacggcagtgtgtccaccaatggttccgccggcacggattccacgtcatccggttccgaatcgtccgattcgtcgtcatcgtccgactcgtcgtcctcctcttcggatccggtggaggcggcatggacgtgctccagttccgactcgggctccacggacgtgatggtggactacgacggcgacggcacccacgccacgccggaacaggcccgggccatcgccaggaagatgatcgcctcgtacaaggactggggcgacggcgactatgacgcgctcgtatggctgtggaacaaggaatcgggatggcagtggaatgccaccaacccgagcagcggcgcgtacggcataccccaggcgttgcccgcctcgaaactcgcctccgcaggagacgactggaaggacaacgccgccacccagatcaaatggggattgaactacatcgccggacggtacggcagccccagcgccgccaagacgttctggctcgcccacaactggtactaaggagcgggacacgtaaagggaccgagcatcagatctcggcggaatcatctgacccgtagacgccatgccccgcgcgaccgcccgtatgggctgatgatcggagccatgcccgccggacggcgcggcaccgatcatccaagggaaggaaggacgcatcatgctgatggaacccgacgaatacacgccccaggaacgggccctgaccgacaaggcgaaggagctgatcgagcagcacgagctcgactggggcaacggggaatgcttcatccaacgcgacgccggccacagcgaactgtacatgacgctggaggcccccaaccacgccacggtcacggtcacggtgccggccgaggcggacgagaaggggctgaggcgcgccatggcggacgggctcctcgacttcgaccccgacgaggagttcgacgaatgctggtcccgcgagttcgcggcacgcaacgggttcacgccctccggcttcctgtccggcctccaggaagacaaagcgtatttcggtctccgatccgaggcgttgcttcatcccggtcaaagcaacgccgggcaaggcaacgaaacgattgcggagatccgctggacggaggaggaccttcggcactggctgaaagaccatgactggcccgacaacaacgagaacatggacgcgatgcgcgacatgatctcggccagggaattgcgggaccgcagcatcgaggagggatgggagatcatcgacgcgatggtggacgacggccggctcgcccgcaaagacgaaggcgagaaggccgaaacgtccgaaacctacgatcccgcgaacccggccgacccgttgagcattgccgatacgtctgcctcggccgcagccacacgataaaagacccgagcgaaggagcatcatcatggccggattgaaggactaccagatcagcgtgtacgtcgccaacctgggcaaatacgtggagggcgtgttgcagggcgcgtggatcacgctgcccatgcccgccgaacgcttgcaggacaccctgaagaccgaggtgggattgggcggccggtacgaggagtacgcgatccacgactacgagggcggggaaggactgctcgccaccgtggcgaatcccggcgaatacgagtcgctgacggacctgaacctcatgtgccgcgcgttcgaggcgcgcgaggacgacgacccggacgtgtacgagaaggtgcagacggtccgcgacgatcttgacgcggtcccgcgcaccccgttgcagtacgcgaacctcgcgttgaactcggacgagatcccctatcactcttatgatgcgccgtcctcggccgaatcgaaggaggcgaagtatgcctggaccgccgtgaaccaggggtgggcatcggatgccgtgtggtccatgttcgatacggggctcggctatctgatcgatatggagatgtacggccgggacctcacgctcgacggcgatgtgtcgcttggcgacaacggctatctggaggacgcggactggccgagcgatatcgacggacggtactcgcgcgaggagatcgccgaggaggtcgaatggctggatgatttcgacgcgaagaccggttcgccggccgcgttcgacctcgcctcgctcgtccagccgggcgaacgcatcgcggactacacgatttccggcaccggcacgaactggggagccccctcataccagtgcatcgtggaggagggttccaccgatatccatgccgcgcttgaggacacgatgcaccggatcatcgacgcgcgcgccgctactggcgacgccgtggacgtgctgcgcgagaccatgggcgcaatgcccgcagcgtccgtcggcgaagacgacggcgtgagcccgatcgaccttgatctgggatatgtgctgcccggtgccgtcacctcgttcgcggaacgcgcgcaggcgtgcgacccctcggacccgctgaatatgaccgatacggccggttccggcctttccaagtgagaaagggcgagcgagatggccttgacgccttttgacatggagggtgtgaaccgcgacctgctcgcggccgggaatcccgccaagcccgacatgcaatccatcctgcgcaggaacgcgcgcgatctcgtgctggggaacgcgattctggtctcttccgccgatgccaaggaattggagttcggcgtccacatggcgtattccgacgcggacggcggcttcgacaccgatccgagcgaggacgtgtggttcgaggcgtcctcgctcccgattcccaatgaacgccctgatctgcctcccgacaacgcgctcaggatcagggtcacggacgtgctgaccgaatacgggttcacggacattgacgtgaaagccccggacaggacgccggaaggcatctggatcggtttcgaggccatgcagccagtcaggctcgacgtgacctcggcccaggaagggcgttccgtttccttcaccctgacagcagccgaggccaacgattggcgttccggccgtctcgacgcgcacggcctctcacgcatggccgtcgaacgggttctcgccaggccgggcgacacggtgacgctcgcctacggggattcgctgttccggccggcggtgatgtgcgacggttcgggaaggcttcccgagcatcgcgtcaaggccggtatcggcacgttcgtcatcggccgtgaaagcgaggcggtcatgcccgagatactgcggatcgaccgcactgttgacccacgagacccgctcgtgatcgaaaaggcgttcggaaaggagaacgacatggagaacgggaatgtccccgaatactggaaaggcctgatggacgaggccgatctgccgttggcgggcatcgtgcgcgagcacggcggcgggttgatggacttccaccgcatgaaggacatcgaacgcctgaccggttcgagtgactgggatttctactcctggacggtggaaaattacgacgatgacctgctcgacgtgtgcgaacgggagaacgccgccgacgtgctcgccgacttgcaggcatggtggaaaacgagccagcccgacatgcggcaacacgtggacgagatgatggcgggcatcgacgcggccatggaaccgctcgacaagcgcctgtacgccgccgccgaaaaggagttcaaggagcgcgcgttggacccggatggggaatgctaccaattggacggcggcacgttcatctcccaggaatcattcgacggcatctgcggcgaccaacgcgaccgctacatggcatggaagaaccaggccgaacccgccagactcgtgagcgcatgggacgaccccgcacgcctggaccggctcgtgggcgacctgatcgacgcggacgatggcggcggatgcttctacaccgacgcgcagcccatcgactacacgcagggcatggattacagcccacagcagctggccgcagacagcgggctgggagatacggtcccgctggcgtgtgagtccaacgcttcctacagcctcgcgcaccaccccgatatcaaattcaccgccaccgggtctcccgacggcagaaaggcgctggaggtctcggctcccggttccgcccgtcatgcgctgatcacggccaaacccggaacgttcgacgtgagcctgcatgacgagcgcggcatcgtgtccggcgaatccttcccttacgaggcaaacgattcctggacgtaccggctttccggccaggcgttgcgcggcgcgctggacctcgccgtcggctgggccgacccacaggaaacgtctcttgagaccgcagggctcggcctcgcgttggatgacggcatggaaacgacacacggccgctgacgccgtacggcaacgacgaacagaaccaaggagcacacgatggacatgaattggatcgacgagattcgggatcccgaaccccgcaaacggtacatctacaacgctgacgactacgacccgcaatacggggacccgtattaccgtgaacacagcacccgcgccgacagcctgtggcggctgtacgaggagagcggcacgtcgatcacgttcgatgccttcgcggacgaatcccgtcaaaccgattacaggatggagaccggcgctctgcgtgatttcttcaatggatcccagtcggtgctctcctcgtacaggaacccgatgggaggcaacccgctgatcgcgttcggaaacataggccgatgggacggcgaacgcacgggcatatcctcgttcgagaccttcgatgatctgatgaacggcgatgattccccgttcaaggactgcgagatcgaccacatctgggacgagaacggaatcctgaagatgcgcggccaccaccacgacggcagtgtggaggtggagatacgccagctcaccgaccagggatgcgaggcattggaatcctacgagcagtcatgggctggcgaaccgttcgacgccgcaggccgccactacgacggcggcaaggaatccgtggaccgcttctggaacgacctgaaaaaccgatcggggcctggccgtggagccccggtacgtggaactcgcgttcggatgcccgcccatcgaatgggacatcgatgccagggtgagggacttcgccgaacgcatgggcgacgaatatacgagcctgtacgagcaggacacgaccggcatcaagggcggtgatttcgaacgtttcggcgcgttcgcggacaatcacctcgacttcatacgcgccctgacgaaggccaggggcatggatcccatcagcagcgaccgggagatagccgcattcctcaacacattcgacaagctcgccgcgatgcccgaaccatcaccggcatcacaggaaaaggacgaactgtccgccggagtatgcgatccggccgacccgacgatgggctgcctgcaaccggattcgccggcagccatccgatagacgcgaaaggagtccatgatgattttgacgcaatccgacctcgaatcggattccacgcgatgttcgagaacatccatccattcacggacggcaacgggcgaaccgggcgacagattctgaatctcatgctcatggctgccggctaccggcccgtagcaatcaaacatgatgccggccgcagctatgggaaaagtctggaagcatggcaggttgacggcgatcccaagccgttcatttcccagcttgtccaatgcgttgatcaggaagagcgcgccgtagcggaaatcgtcggcagattaagagagaaccctttctcggaaaacgccatcgacgggattagtctcgaagacggtccggcacgagggcgttccctctgattggaacgcttcaggattgtgataggtgtacatgaatatgcgtttttgcgtatgttcgtgtatactcacaaacatgaaaaggagcgaggcgattgaccagctgcgcgagatggacgccaagtactcgtgctacgtgtattgcaagaacgaactggccgtcgtgctgggtgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggtcgcgaaggcgagttccataccccgtatggggtgatcgagttcacgcactgcaagctcagctgggaccgcatcctgccgaacctgatcgcccgcgatgacggactgacgccgctcgcgtcgaaacagtgggcgtatcgtgacctgaaggccgtcggacgcaatctcgatctggtggatatggatgaattggaggacgacgatgactggaactgacgaaccgttcaagtacaaagccatggcagcacagatcgtttccgccgagggcatgggcaatctgcttcccgtggtcgagaaggaacttctgcattatcgaatcctggacgccatgatgcgcgagggtttcttctcctcgctggtgttccagggcggcacgagtctgcgcctgtgccacgggtccccgaggtacagcgaggaccttgattttgccggcggcacctcgttcgacatggacacccttaaagggcttggctcctgtatctccgattcgctctcggggatgggcgatgatgtgacggtccgggtcaaggagccgagacccgacgccgatgggctgacgcgcagatggcgtatagcgattcgcacggccggtcagcgcaaggatctgccgagccagacaatcaagctggaggtggcatcgatccccgcgtacgagccgcagcatcgtcccgccttggtcaactatccgatgttcccggccttgtcgggtcagatcatcctcgatgtggaaagccccaccgagattcttgccgacaagctgctctcctatgcctgcgcatcgcacctgcggcgacgcgacctgtgggacatgtgctggttggcgtcgagaggcgacgtcgattcccgacgggcgatggagcttgcggaattgaaatcatctgattacggcgaagaaggactttgggcagaccgtgctgatcgcgtggcgggggtcgccgatgtaatcggctcggatgccttcgccgacgagatgcgccggttcctccccgccggcctgatgacatccacggtcgaatccccacgttggagcgcatgggcgatcgaacagatcgggacgttgtacggcactccaggcactccatcgtcggccgatgcggtttccggattccctattttcggtgcgtcgaacgactccagtccaacccgctgaacgctaaggaggtctgcgatgtcgaatctggactataagttacctgagccgacaaaggcgcaattggagtacgcgtgtcaccttagtcgtttccaagcgccgcgtgaacgccggactcttttcgcccgcaccgaatcagatatcgcagccgccttccgtgaagagaccgcgaaccattcctggaacgccgacgaccttgcctcccaggccggtatcgatccccggcttgccgatgctctgctccagcggggcgaagccccgattgaagcgatgttctccgcagccgatgcgctggggatagacatagccgcgttgccgctttccagtctcgggaacactcggtgagcggtgttggcatgcgccaatatgcgcaaagaagcatgttggcgtataccgtttgttcatccgatcctcgcggtgctaagggaataggtggcgacgctgccggctgttccgacgacctggttcatgggcatggtcagtctcatgtccgtgcgggtggtggattccacggcgttacgcatctcgtcctgcacgaggccgatgtagcgcatggtggtggcgatgttggcgtgccccagcatacggctgacaagcacgatgttgcagccgttcctgtagtagacgcatgtggcgaacctacggcgcaggctgtgcgacgggtatccggttaccgtcttgatcctcttcgccacgtaatcgacgccgcagtgtccctgcacgtctccggggaacagccatacgccggtgcgtttccgcaatgccgaagcgagctttgccggcacgggaagcatccgctccttgttgcccttgccgtggacgtggagcaccatgccctcggcgttctcctccagatcggtcttcaggttgattctggtcatttcgatgcggcgcaggccgcagaacgcgcccagcatgacggccagccgcgcgttctcgtcgggtgatgcgagtccttgttcgatgttctcctcgggacagatgcagccggacggaagggtcatgggcacggtgggcacttcgtccgccggattgcggcgggcgagccctcgcttcatgctccattggtagaagaccttgacgcagctgcgtactccgcgtctgccttcggttcccatgccggctaggtagaatatgaggtcgtcttcggtcacgtcggtgatgcttttatcgacggctttggagaatcgaacgatctggtaccagcgggtgcgcagggtgtcgttcgtgcgtccgatggcgtccatccagtcgatccatttctcaatggattctttccaatcctcccgtggctcgacgtgttcgcagctcttcctgttgtcgttccaatacctcatggggctccttaagcgcatagaaaagggaagtgacttcttcatcacttcccaaggaatactattgcgcgtttctggccgatgctcttcggaaaaccagctgcaaggcgaacatgcgcgatgacacgccgatttgaaggaacagcaaggctggtgtattgtctactcctgttgcaaaaagccctacggctgcgagccagaaccgtatatcggacggtcactggttcaagcccagtcgcaggagccatcgaaagcctcggttctccgaggcttttttattttcatcgtattggtggccagacacgacaccccatcatcaaccgggaaatccatggcgaagacctcaccactactcacatcaggcagacaggtcactgtcaattcaccgatgagaggcacggtattcccagtatcagtttgggaataccgcgcaaatcttacatcgagaccttggtcaggggcatggcggagtcaatcgggaagtcgggggcgctgggggccacgccggcttcgaccaggttcacgccgagcatggcgaccatggcaccgttgtcggtgcagagcttgatttgcgggatacggacgtcgacgccgtagttctcgccgaattcgagcagtttggcgcgcagctgcgagttggcggagaagccgccgcccacgatcagcgtgttggaatcgtactgccggcagccgcgcatggccttacgggccagcacggtggccacggaatcggccagggatgcgcacacgtcgtccaccggaatctcatggccggcggcctgctcgctttccacccaacgggccacggcggtcttgacaccggagaaactgaaatcatacgggtgcgcggcaccggccttgccttgggtcagacccatcggcaccttgatggcgtgcgggtcgccgttctgaccatggcggtcgatgtgcgggccgcccggatacgggaagccgagcaggcgggcgaccttgtcgaagcattcccccgccgcgtcatccagcgtggtgcccaccacatcgattttgcgcggcatgtcttccacgtgcagcagcgaggtgtggccgccggagacgatcagagccagcgtgtccttggggaacgggccgaactgcagctgagtgacggcgatgtgcccgatcacatggttgatgccgtaaatcggcttgttcgcagcccaggccagcgccttggcgccggacacgcccacggccaggcaaccggccagtccgggaccggcggacacggcgatggcgtccacatccgccaacgtcatgttcgcgtcgacgagcgccttggacacgcatggcacgaaggcctcggcgtgcgcgcgggaggcgatttcggggatcacgccgccgtatcgcgcgtgttcctccatggatgaggccacgacgttggagagcagttcgcggccgcgtacgatggcggctgcggtttcgtcgcaggtggattcaatacccagtacaaccggttcgctcatcgtgcttctccgttcttctccgtttgcttgctggtgatgtcttcaatgtccgccgatgccgtctgcggggcggcaaagcccacgaccctaggtttcaggtccaagctcatggtgtatgcgtcgatgccttcgggctggtagtagcgtttgcgcaatcccatgcgttcgaatccgaaccgctgatacagggccagcgcagggtcgttatccacacgcacttcgagcagcatgcgcgaggcgccctgacgtttcgcctcgtcgaccagtacctgaagcaacgcagcggcgatgccttgccgctggtatgccttgcccacgccgatggtcatgagctcggcgtcctcgccgtcgtaccagaagccggcgtagccgcggacaacagcctgttccgcctctcccagcacatccagcagatacgtgcgggccggtgcgtccagttcctctcgcaccatgttcgcattccatgcgccgcggccgaacagttcgccttccaactgtgcgatggaacgaaccgcaagatcacgacttacggcagtgatgtcaacaatcatcggaccacaacccacttcacgccttatcggcaccggcatggccgagcacgtgcttcagtgggttcggtacttcggcgtccggccggcgcaggtacaacggttcgatcggcacgacctggtcgccgcgcagttcgcggctcaacgcggtggtcgcaaagacggcgagcccggctttcccggcatccaataccgatccgtccaccacggagcccagcgcacgcagtccctgccagacggatgcgtatttggccgcgccgtggccggtcacatccaccacatagctgacgccgtcgcgttcgccgtgttccgcgagcgccgcgttcacccgttcgacgatatgctccgggtagtcgatatccatctcgatccagcgtcgttcggcggcgtcctcgtccggcaggctgatgctgccgtggttgagcgagaagtacagctgcttgcggcgcgcatcgttgacgcacagcgtgacgtggcggtcgagttcgtgttccttggcctcggcgtccgggatgtcaccatccgattggcgcgaactcaagcgcggcacgtcggccaggaaatcgatgccgtcgaacatggcgctgtcacccagcacgaagttcatcatctcgccttgcgggtcgagtacgttctgtccgacgagcttggccccggtggcgaaggccaacgccttggcggccacgatgccggcgcgcaggccggtgaatggcgccgggccgatgcccacgacgatctcctcgatatcggcaggagtcaggccggcctcctcgaccgcgcgcgcgatattgacctgcagtttctccacatgggtgcgcgaatcggtctctacaatgggctcgcgccccacaatgccgaccgtcgagccgaatgaggtgtcaatcaccaacgtgcaacccatgaatcctcctagtcgtaaagcctctagagagtgtacatcgaggagtctatgggcgcatggcttattgcaggtcgaacgcggcccatcgcttgccgactgggacgaatgcgacggtacgagtgccgttgctggtgagttcgccgtctgatccagcggatgcgacatcggaggaatcgagaggtcgatcgatatggatttcaagtcgttctggtgccaaggcggtggccatttgttcgccccactccataagcaccaccgtgttctcgccggggtcttcaagttcttcgtccaatcccagcgattccagctcgtccaacaaacgcccgatggcgtcctgccccggcgcataggctgagccgcccagacggtaggcatccacatgcaccagatgagccggagtgccgtcggcgaaatgcccgtcaagttcgcgggcaatggtgaatgtaggagacacgatgggttcggtaatgtccagccccgccccgaagccttgggcgaatgtggttttgccggcaccaagagggcctgagagcagcaatacatcgccgccgtgtaccattccggccacgcggcggccgagctcctgcatggcctcgctggtgggagccgcaatagtgtgttcgctcataaatacccctttatcgacttttaccgacctttatgactgatgtcttcaatgcagcgttccagcgcatataccgggtcgccgccgttcgttttgctttgctcatccgcccaggcgagcatacggatgcaatgcgcgagtcctgccgaagtccagccgccaagttggcgcatcgcattcttcagcacccacggattggttttcgcttcggcctgtgaaatcgtgccggcccggaccgccgaggctttggcaatggtacggagcttcatggccaacgcgccgatcaacgcgatgggatcggtcccttgttccacagctgcacgcatcatgacgatggcttcggcggttttgccttccacggccttgtctgccacggcaaaaccggtgacctgcggattggcggtcaaatactggttgacacagtcgagccccatcggattatcgtcaaagtcgaaacacaattgctcgcacatggcggcgagttcgccggttttgccgccgagcacggataccagctgctgcgcggccatcggttcgactctacgaccgcgtttctcgaattctccgagtacgaaattgagttgggcatccggtttcttcaaatccggcacgtcctctttgcgagcgccggctttcaccagttggtcgatgatcttgcgccctttgacgccgccctcgtgctggcagatcaccacgctggagccgttcggatccttggcggcctgcttggtgtacgtcaccaaagcttcggcgagcttttcgtcggcattctgcaggttgacgagtttgaccacggcaacgtcggaaagcaacgatgggctgacggcttcatcgaaggcatattggtcggccgatgtggcgtcgagctcgatgagttcggcgtcgggtcgcgccttcaacgcttgtgcgcacagtgccttggtgcgcgcgtcgttcaaatacgagtcgcctccgggcaccacggttaccggtacgttcgctgctgttttcgccatgcccccatctcgccacacaggttggacaatgacctgccggcataacggcccggcagcaccccgcgattaggcgtatgcctcatccaacagggcgtcgatatccgcgaaacgcttgggaccgggacgccataccgggtgaccggccgcgatgaccaatgccgggtgttccaacgcgcgcaggtcgtccagcggattggcattcagcacaagcaaatcagcggatttgccgacttccaaagaaccggtctcggcatcggcgccgagaatggaggcgttgacggcagtggctgcgtgcagggcctcagccggactgaaaccggcatatgcgaccagcagctccagctcacgccatgtggcgtactgcggcacgaatgtcatgcctgtatcggtgccgacgcctatcatcaatccggcctcgtgcgcctgacgagcacctgaaaccatgcctccgaccacgtttttggaattctccaattggatgtcggtgatgccggtcacgtcctgtccaagcaaggtcaatggcaggccggcggacagtgtcggaatcaatgccgagtatccgcgcaacgcattcggattgtgccggaacatgccgatcaattcgtcgtcgagcacgctaccgtgttcgatggtatcgacgccggccagcagcgaacgccgcacgccttccgggctttgcgcgtgcgcgccgacaataacaccatactgatgcgcctcatcgcaaatcgcccgcatctgttccacgctcatctgcgggctgccggcctcgccgatttcctgtgcatcggttacgccgccggtcgcggcgattttgatggcgttgacgccagccttgagattctgcgcgactgcggtacgcgcctcttccggggtgccgctggtcagtgcgataagcggggcgccatggccttcgggaatcgccatcagcggtccggacgccaagatacgcggtccgaggatttggcctgcatcaatctgatcgcgtaatgtcacgacttcatatcccacgtcgccaagcgtgcggatcgtcgtaacgccggactccagcaatgttgtggcgttgtgttttacggttgcggccatgtacggcttgcccaatggcgaatgcgcgaatgtggcgaccatacgttggcctttgggcgtcgccagcttcggattgagcggcttgccttgggagaacagatgggtatgcgcattgatcagccccggcatcacgattttgccggtgccgtcaagatagtggtattcggctgggatactggtttcgatgctgggtgcaacctgttcgatacgtccgtcggctccgaccacgatcgtcatgttacgcagtatggttccggctttatctccggtgacgatggtggcgtgggccaatgcgaatggttcgactatcggattatgagacaacatcatcgccggcactccttcatgcagctggttgaactggtctcaactgtatcgcagttttgccggctgatggtttatgccgcgcggcctatcgcataggttcggctggctattgcgatggttgctgcaccgaataccgcattggctattcggcttgccgccgcgtaaagagacgtctcgtctcctcgcaccagagactgaggcggacacgccaagcggaaccgaagcgcacgccaggcattccggcctcataacgacggacatgctggaggcaacggctgacgaacaccagtagcatgccgataccgatttccaccgccacaatcagcacggcacccgtaacgccgtctttccatgggatgacggccatcgtgctgccacccagccacaacgccacccgttccatcaccagcgtgccccatgacgatatccacgcgaatacgccggccagccatggctcgcaccatgcgcaggccaatgccatcaatcccgccatcgtggccaatcccacaaacggcgacaccaacaggttcgccggcacggacagcaacggcaactccggttccatcaacacctgaatcggcagggtgaacaactgcgcggccacggtcatcgccatcatttcggcgatgccgtgcggcatcgctcgctcaaaggcaccggccagccgctccgcaaacagcacgatacccagtacggcggccgaagacaaggcgaatccgtagctggccgacatatccggattcaccgccaatacaccgattaccgtccagcacagggcgctcaacgcttgcgtacgccgccccatcgcatacgtcaacgcacctatcaatcccatgatgaacgcgcgggtgaccgaatcactggggaacatcgccaatgccagcagcacatatactccagagaccagcaacgccgtcagccgccgatcaagcagcatccacatgcataaccggcgcaccaatcccgccaccagtacaaagtggccgccggatacggccatgaggtgcatgatgccggactggcggaactgattctccaacgtttgcgcatacgtgctgttgaccggcatcggaccggtctcgccgccgatataatcctggccaagcacacccatcgtcaatcccggcaccaacacacgcccctgatcggacaattgttcggtcacggtgaaaaacgcctcctgcacatgcgcaatcgcggcgagatgccacggcggagcccgcacctgtgctaccggctgttttccttccaagagcagccatagtggtatgcgtccatatcgcgcttgctgcaatacgcctgtcagcagatggaccgcgcctcgacgcaactgcccacaatacgattcgtcggcgtatacacgcacagcgaccgtggaacgtacatccgtaccatccacagtgatgccgctcagccgtatgtccgtctgacaatcgtatgtgcgttggtccgaagcgatcacgggcgtcgtcaccgtggccatgacttcgtggtatgaactggattggcgagcttgtgcggaggcaggatcatgccaggcaatggtgtccgacgcgattgccgtcatactgccgatgcacgccaccgcaacgcatacggtcaatgttcccgtccaccggatccgcaggcggaaagacaccacgatcatcgccgccacggcagcacatgacgccactgttataggcaatattcgtgtgacaggccattccatgccgattatggtgacgtcaatgccagctccggcatcggcctttgcctgaccagtgccgagtccatcagacatcctccatgcgaataatgcgtgcgctcccagactcgccgcccacatcactatggcgatcggcagcatcctccaatcgcggctcccctgctcgcgcagtatccaatccctgctcatccgaccgtcacctgccctcgcatggtctccaacgtcttggagccgatgcctttgacatccagcagctgatcgactgatgtatacccgccaatcgccgtgcgatgatcaatgatccgctgagcggtaaccggcccaatacctttgatggattgcaattcctcagcggtagccgtgttgaggttgataagaccatgcgtggaagcgccggcatcgctgccgtccgtctgcatgtgcggagattgcgtggtatccgattcggggttcgctgtggcatcggaatgctccgactgctgcggatccgtgcgtttctcgtccgtggtgttctgcgatggcatcgtctgatctccagcggagccgcccgtggtctgcatggcggtcggttgagacagcatggccatattcatcgactgttggaccagcaatgccaagctgatgccaagggcgacgatcagcagcaatatcacggccaaggcatgcccaatggtgaacgacaatcgcggctgatcccgggtgagtctggctgattcgccgacggcatcggcggaacgtacgccaatcagatccgataacgcacgtttgtcacgggtcgcctgccgcaggccgctctgcgccctttggggcgggtggccagccggacggatccgtgcatggccaggaggcggcggaggcgtcgtgggccgttccactcgcggttggggcatggctgcgctctgcctgctgaatgcgcgcaaacggttggcggcatggtctgcgcgatggttatgagaaacgcccatgcatccacgctgatggattcatgggcgtttgtccagctgaaacggggtatgtggttctagcttatgaagttatccacaattgaggtgggcggttgacgctcccctcagtctcgctacgcgagccagctcccctcaaagaggggagctggctcgcaacaagtcactccgcgggaacgatggagacgatcttcggggccttgacgatcaccttgcgcggctccttgccgccaagacggtcggcgacggcggcaagcgcctgcttctcgagatcggccggatcgatgtcgaccggcacttcgagcttggcgcgcaccttgcccttgatctgcaccacggcggtcacggtgtcgtggcccacgtagcgttcgtcggccaccggccacggctcggcggacagggattcggcgtgaccgagcttgctccacatctcctcgcagatgtgcggggcaatcggcgcgagcatcaggatcagcggctccacggcggcacgcggcacagccttcagaccggtcaggtggttgttgagcacgatgagcttggcgatggcggtgttcgggcgcatgccttccatttccgcggtcacttcggcaatcgtgttgttgagcagcttcagggtcttttcgtccggcgtgtcctcagtcacatgggcctggccggtggtctcatcgaccacattgcgccacagacgctgcaggaagcgcatgccaccgaccacgttgcgggtgttccacgggcgagactcgtccagcgggcccatgctcatttcgtacaggcggaaggtgtcggcaccgtagttctcgtacatgtagtccggggtcacgatgttcttgagggacttgcccatcttgccgaactcgcggttggcatgttcgccgttccaggtgaaggtcggctcgccggaggcgtcggccgggccttccacgacctcgtcggccggcacgtactggccgcggtcgtcggtgtaggcgtaggcctggatcatgccctggttgaacagcttgtggaacggttcggccgagtccacgtagccgaggtcgaagagcaccttgtgccagaagcgggagtagagcaggtggagcacagcgtgttcgacgccgccgatgtacaggtccacaccgccttcatcacccgagtacttgttgtggttcgggcccatccagtagtcgaactcgtccttctccaccatgtgcttggtgtcggtcgggtcgatgtaacgcatgtagtaccagcaggagccggcccagttcggcatggtgttggtgtcgcggtagtaggtcttcttgccgtcgcccaagtcgagctcgaccttgacccagtcctcgttgcggctcaacggtgcctccgggttggactctgcgtccatcggatcgaaggtgcgcggctcatagtcgggcacgtcgggcaggttgatcggcaatgcggaatccggcagcaggtgcggggtgccgtcttcgccgtagacgatcgggaagggctcgccccagtagcgctggcgggagaacagccagtcgcgcagacggtagcttacggtgcccttgcccacgccggcggattcgagccaggcgttgaccttggcgatggcgtcgtccacgcgcaggccgttaaggctcagcgcgtcgcccttggcttcggtggcctcgacggaggagttgatcacgatgccgtcatgggagacgaacggcgccttgccctcgtagttggccaagtcgtcgccggaatccggcagaggcgtgacggtgtagatgacaggcagaccgaacttcacggcaaagtcgtaatcgcgctggtcgccaccaggcacggccataatggcaccggtgccgtagtccatcagcacgtagtcggcagtaaacagcgggagcttcgcgccggtgatcgggttggtggcgtacaggccggtgaacagaccggtcttctcaccggcctcgttcacgcggtccttggcggtcttggcttcggcggccagacggtaggccttcaccgcctcgaccgggttggcatagccgcccttccagtcttcgggtacatcggccggccattcggcgggcacgttctccagcaggtgatgttccggggaaaccacggcgaacgtggtgccgaacagcgtgtcgggacgggtggtgtagatttccatgtccttgtcaccgtcggcagtggccacgatgaagtgcacggaggcaccatgggattcaccgatccagttgcgctgcatgagcttgaccttctcaggccagttgatgccgtcaagatcggcgatgagacggtggccgtacttggtgatgcgcatggaccactggcgtagctcacgctggaagaccgggaagttgccacgctcggacttaccttcggcggtgacctcttcgttggccagcacggtgcccagacccgggcaccagttgaccggggacttggagatgtaggccaggcggaagtcgttcaagatatcctgctgctcggcgtcagtgaggtcggaccactgcttgccatcggactcgtggcccggaatggccttttcgccggattcgaacttggccacgagctcggcgatcgggcgtgcggagcccttggagccggacgggttggtggcgtcctcgtcgtaccaggaatcgtagatgcgcgagaagatccattgggtccagcgcacgtagccggggtcgatggtggcgaacgtacgacggttgtcgaagctcaggcccatacggtgcagctggcggctcatgttggcgatgttcgcctcagtggtcacgcgcgggtgctggccggtctggactgcgtactgttcggcaggcaggccgaaggcgtcgtaacccatggcgtgcaggacgttctcgcccttcatgcggtggtagcggctcaccacgtcggaggccaggtagcccagcgggtggccgacgtgcaggcccttgccggacgggtagggaaacatgtccatggcgaagtaggcggtgcggccttcggcgttacggcccttgccgtccttcaaatcgccgttgacgttggcggcccagaaggtgccttgctcgtcccaaatcttctgccacttgttttcgatgtcctgcgccagtgcggcgttgtagcggaagttgggctcttcggtttgcgtgctcttctcgttgtcactcataaatcagcaaggtagcctcgcaactggacacgtcgtcaatcgttattcagcatccgagacgatggctttggggtcgccgttcagcgaaaccgtgagctttgtttggcttgtgaacgtatccttggcggccgtccagctgccatcctcaaccatgtcttccaatgcttccgcgattttctgcgccaattggctggtgccttgactcacggcgatgccataaccgacctcgcccttgtccgcaatcacgtccatatactggggcccgttggccgcttgaagaccggaaagcaccgccatatcggaggctatggcatccgccgaccctacttgcacggccgtgacgcactgcgcataactgctgcgctcctgaatccgggcctgcgggtggttgccgcggaagatgccgactgtctcgtcacctttcactgcgcacaccgtgccgtcgcctacgtcacccaccgaacctgcgtcattgatgaatcggccacgctcatccgacctgaccagcaaaccgacgctggtcgtgaggtatggtccggcaaaatcaacgatcgcactggacccatcggtgataggccaagaggcgacgaccatgtcgacctgtccattgtccagcatggagcgccggttttcggggcgaacctgtttgaagacgatctgcttgttcgcatagccgagtttggcggccacgtatttggcgatggtgatgtcgaagccctggtatgtgccgtcatgccatgctcccaccgatggctcgtcggctgcgaccccaatggcgatggtgggcccctccggcgctccggagacggtggtgacttgaatttggccgcaaccggccagaccggataatggcaatatcacgccaaaggccgcggcgaatcctgccatcagtcgggagcgaaatccgcgccgcatcggacggcgagcgcggagcatgctacggctggcgaacgatgaccagtggtgcataaccgtcaaacgccttacttgaacatgcgcgaacgtgtgaggaaccaggcaaccgcaccggaaagcaccatggaaatcacgataatgagcatgaaaccccacggcttgtcagtgaacggcatacccatcatgccgccatcgaagttcatgccgtacatcgagaagatcagggtcgggatggacagtgtgatggagatgatggtgaagatgcgcatcacgttgttcaggttattggacacgatcgaggcgaaagcgtcggtcatgttcgcaagaacgccgctgtaaatgttggccatctcgatagcctgcttgttttcggtgatgacgtcgtcgagcaggtcctcgtcgtccgggtattgcttgatgcgttgcagggtggtgagcttctccatcacgatttcgttcgatttcagcgatgtggtgaaatacaccaaagtcttgctcagctccatgagcatcacgatctcgcggttctgcatggagtggcgcagcttcagttcaagcttgtcgctttcgcggtcgatgatgcgcaggtaacgcaggtacatcgtggcgttgcggtacaggatctgcaggatgaagcgcgaacgcatgaaggtgttgaagcctcggatcgtgccttccatgaatgggtggagcacgggcgtgtcctgcatgcagacggtgatgatgaggttttcggtgacgatgatcgacagcgggatggtctcgtaccagtcgcgtccgccacgctcttccacggtgggaatgtcgacgatgatcatcgtgtaatcgtcttcgacgtctacacgtgaacgttcctcgtcatccaaaggggcacgcaggtcggccaggtcgatgccggtttgcgaggcgacggtggcgagctccacatcagtgggttcgctcaaacataaccaggagccgttttccggtttctcgatctgctccacttggccattgattgagctgaagattctcagcatgtcgtctcacccgccttccgcgctttcttactgttctatcgctgtacggttccaaaccgagattagtctagacccaccgttcgaatttgcgagcggggtttcgcatagcgaccatcaccagacgattggctgccaacttggcatgtgcggtcctcgcagatcggtcggcccgttctcccagtcggcgctgtcggcgatggcgggagccttgttgtattcctccaactcccacaggggctgttcgatgggggtgccgttgacgctgtggcgcactttgagccggcaccaacaggcgttgcgcatgccgccgagtgcgttcatgccgtccgggtcgagttcgagcaggttggagatggtggcggtaatccatgagccatgggtgacgagcatcagcgtggtgggcgtgctgtctgaataggcggagtcgatgaccagtgcgcgcacggcatcggcacctcgctgccccacggcggcacggctttccacaccatgcttggtttcgcccccagtgtgctgtttccaagaggcgtagtcgtcggctgccacggctttgatttcggcgcgggtcatgccttcccactcgccgaagctgcgttcacgcagtcgttggtcacaggtgactggcaatcccaaaatatcggcgaaggcgtgtgcggtctgttgggcacggaacaggtcggaggtcatcaccaccatgcgccggccggcggcgggagcctcctcgaactggcgcgtatcagtgcgttcggcggcgtcaggaccgggctgggcgatggcttcgggatgctcggcaagtcggttcaccttggcccagtaataccgtgaagcgagcgcgaatccggtctggtcaacctgccattggcctacgatgtcgagcggcacatcgatctggccttgcaagcgatgttcgagattgtattgcgtacggccatgacgcagcatcatcacttcatcgatcatcggttttcgccacctcgttctcttgcggtttgccatactcatctcagcacaacccctagaatggcggcatggagatttctgagtcgacttgggcgttcatcgccaaacaccgccgtgaagatgtgcgtgatgtggccttgcacgccaagcatgatggcaacgtggatgtgccgttcgcgctggagcaaattgccggctggcagcgcgcttcactcaagctacctgactgggcgtcccatgatgggctgattttcccgccgcaagtcccaatggaacaatgttccagccaattcaccgcacagtacaaggctcggctggcacagcgattgttggccgaagaagcagtcgacgacgactccccggcatccctagtcgatctgaccggcggtttcggcgtcgacttttcttacatgtcccgagtgttcaatcgtgccatatatatggaacaacaatccattttatgtgatatcgctcgccataatttcccgatactcggccttgaccacgccgaagtcatcaatgatgattcaacagcagtgcttgacacgcttggccgagtctccatgatcttcctcgatccggcccgccgtgacgatcatggctcgcgtacctacgcgattgccgattgcatgccggatgtgctgaccctgaaggatatgctgctggccaaggcaccgacggtcatggtcaagctctcccccatgctcgactggcataagaccgtcgccgatttcgccggcgcggtacatgaggtgcatatcgtctccaccgggaatgagtgcaaggaattgttgctggtgttggggcgcggccgttacgcctcaccgctcgtggtatgtgctaatgacgagcaggtgctgtcgtacaaggccggcgataacagcgacaatcacaccactatcagcgattctgccttggctgcacgcaatacttgcaataccgaagattccctgtctgaggaaagcgcgaacgacttcgattcctcgcattggaagtacctttacgagcccaacgcctcaatcatgaaggccggatgctttgatgttctcgaacagcgcttcgccgtgcatcacatcagcccgaatagccacctgttcgtggcggccgaacctattgccgattttccaggcaggtcattcgccatcgaatccatcgccaccatgaacaagaaagaactgaaacagctattggccggcctcacgcacgccaacatcgccgtacgcaatttccccctaaccgtggcccagctgcgcaaaaaactcaaactcaaggacggtggtagcacctacctcttcgccaccaccgacgcccaaggccgtcacctagtactgcgcactaaaaagcgaaaaagtggctccctctgacgaggaagccaccaatacgtcagctaatcagtccttggcgatggtcttgccggcggtcggaccggaggcaaggtcctggatctcggtgacttcgagaaccggaatcacggccggcttcttggtgcccttttcctcggcgaccttgacctgctcgttgtagatgtcgtcgtcaacgtgcagcaccacgttgccgcggaagcggtagccctgcttcttctcgaggttggcgaaagcgatgaccagcggggaaccgttcttgaggttctcatagtgctggccggcggtgcgctcgtggtaggcgatgtgcgtgtcgtccagcacgaacagggacatcttcgggccgaggtccagttcgccgtccttggagacggtggtgatccagccaaggttgttcttgatgaattccttgatttccggagtaatgactgccatgtcgaatcctttcatgattgctacggataacgtatccttactctttccagagtaccggtttcgaacgcgactagcccggatgttcgctgtgagtaacctcaccttcgcacagctttcatccggtttttgcctgcttggcgatgccatgccccggtcgcgcaccagccacacacctgtcacacacccgacacccatcgaccggtcgattttggccggtagttcccgtaatctgtgagccgagagagccacaagttttcctaactgtcctgaggtgcaccatgggtttggtcgaacgtttcagcaagctgcgcagccgctggtcccgcaactttcccccgaatctcgcccgactcatgttgctgggctgcgctgcattatggggtggcagctatctgctcgccaaattcgccatggaggcgattccgccccaatggctgatgggtctgcgcatgatcggcgcctgcctgtgcatgctggccttgttccataagcacatcgtgccgtatctgacgccgaaaatcattgtgccggcgctcgtggtgggcctgacctactggggcacgatggtcacccagaccatcggcctgcagaccattgaaccgggccgcagcgcgttcctgacggccgcctactgcgtactcaccccgttcgccacgtggattatttcaaaaaaccgcccgaaggccatcaatctggtcgccggcgtgatctgtctgatcggcgtcggcttcgtctcgctgaagccgggcggttcgctgtcgctgagtgccggcgactggctgaccatcgccaccgcggtcatcttctcgttcaatctgacctgccttggtgtctacaccaaacgcttcgaccctatcgccgtcacttttgtgcagttcggcgttgccggcgtattgttcatcatcggcgcgttgttcaccgaacccatgccgaacgccagctggctggcaccctcagtagtggccagcgtgctctatctgttcctcggcgccacgatgagtgcccagatcatgcagaacatcggtctggctcacgtgcctgcctcgcaggcgtcaatcatcatgtgtacggaaagtctgttcgctgtcacgttctccgcgctgttctggggcgagacaatcatgtggagttcactggtgggctttgcgctgatcttcgtcgccgtgctgatgtcggtaatcaagccgaccaaacagtcgctgcaccggaactgacgattcagtttcggccatggatggtcatgggttctccattgccctgaaccgttacggtgaaggccgaggctcttgaaggcgtgcaatcggaaatcggacttggcatcgccaaactgcatttcgagttgggtgccggcaacggcagcttcgcttgggctgcatgacgttctgctgaacgtcgttttcgctccaagcgaaccaatttcggttgttctttgcgctactttgcgccactttgcgctgattcccactgctcatcggcaccatatttttgagtcattccacattccgctggctaggttttgaaggtctcgtgtaggcatcctctcggtatcaccgagccttaagcaaccttccagcccgacactttacggtcgtgtcttgtgaagaagtttttcgaaggtctttccctctcatccatcgtggcgggcacccttgccgccgtcacctcattcttactggcatcgaaaatcggtatcgccggctcggtaatcggcgcggcagccagctacatcgtctccgcggtggccaccaaaatctatcaaaacatactcaccgcctccggtgagaaactacagtcggcctcgtcttccggcaatgacgatgacactacggataataagtccgataaggcagccgaatccgagtccgatacgacgatgaccggcatggtcaataccgtttccaccgcgcgcaagccgcgcgaagtcgtgtccaatcgagcgaacggacgaacctattcggtcaatgaactgcgcaaggcccgctcccataattcgaagcgcaccgccattatcgtcacgctggtatccggcctgctcgccgtggcagtaaccgccggcatcgtcatgctggtcacgcagggccgtggcacggaccatatcatcactccgtccaccacgcccacgcaaaccgacaccaaaacgcagaccgacacgtccaatcagaataacggactgccgcagccgggcattaccgacggttcgaatgattccaacaccaaggactccacatccggctcgtccaacgacggcaccgattcaagcacgttcggctcaaccggcaccgactcctcaaccgattccaacaccaatggatccaccgatggttcgaccggcaccgattcctccactaattcgggcacgactggcggttccaccggttccggcaccaccggaggcaccaccggcaccggcaacggttcaaccggatcgggttcaggatcagccaatggctccggttcctcttccagctccacgggcggatcatccagttcaaactccggtaatagcggttcgagcggctcctcaaccggtagcagcagcggaaccggcatcaaattcattggctgacaatcgccgactcgatagcagcgatggcggcaatgccagtcaatgacgtggggcaatgagaacatggaacgtatgactaccatcattatgaatacctctgatgataatcgtggtcagctgtttttggctttattccaaggttttccatttttgggaaacctgccgattaccctcgtttttcacgaggcacctacaggcacccaagaataatctcgactgcccccaccggccgaccaccaccggccggtccatgatgctcattcgagatctcccgccgacgataggcgcccggacccataccgtctatccaaggggaagccaatgaaggacacggagaacaggccgcaaccgagaaaacgcaggaaatggggatcggtgatcgtccgcagggacgcggacggcaacccgaccagtttccaggcgcggtacgtcaacccgctcgacccgcccaagaaggtcggacggaacttcggcctggaatacgagacggaggcctacaggtggctcgacgaggagcgctacctcgtcacactccacaacaaaggcatcaggcaatgggttcatccatcgcagcgaggcgcaaacaccatgcccacattcagggaatactccaaggactacttcgacaaataccgcaaaccggacggcagcaagctatccggccggtccaaccgatgcaacggaatcgtactgcgtcggctcaacgagacgttcggagacaccccgctcgaccgcatcacccggcaaatggtagacgaatggtatgcaaacgccagagacacgttgacggcatggacgttcgaacaggcggcgcgaacactcaaacgaatcatgctcgccgccgcgaacgaacaggcggatggcaccccgccgctcatccccgcgagcccgtgccggtaccgcgtcgtcaaaccgcaatccaaacgacgtgaccaaccgccggtcaccgccgacgagatcaacaggctggccgagctcttccccgactaccagcggctcgcgctctggctctcccttctggcaggcggactgcgcctcggcgaggtatgcgcactgcaactcagggacatcgacctggagaacctgcaactccacgtccgccactccgtcaaccgcggccccgacgacaggggcaaataccaattatgcgagcccaagaccaaaagcagcaaaagggtcgtgcccatcccgaaaccactcgccccgctcatcgaggcccatatcagccggttctgcaaggaccgcaagcccgacaccatgctgtttcactcgcctatgctggacgattggctgctcccgcccacgaccatcgaacggacattccgcatggcccgcgaaaagatcggacgccccgacatcaccttccactcgttgcgcgccacgcacgccaccatgctcgtcctcgagggcgggaccatgcgcgagacgatggacgacctcggacacaccagcctcaccgtcgcggtggacagctaccaacgggtcgtcagagaacaccaccgcgacaccgtggaactcctcgcctaccggtacatgccatcgaacgatccgaccgtaatccgcacggtcatcgatcagaaggaacgccagatcgacaagctccgggacgaagtggaaagactcaggaagatcctgctggaacgggataccggaataccgacggacccggacaccgttttaccgaaaaaccaaaaccggtaaagaccggcatcaaacggaacagcctcacacgtctaagtgttgcaacaagtacagcggcaacgcttaaacacgtgaggcagccacggtcgaagcgcgaggcaatgccttcaaccgactggataccgcgataccggaaccggtaaataccgaaaaaccgagataacgaaaccggttttcagccctcggaatccattaccgtacgacccttgccgaagagatggccgagccattttctgattcgcgggtcgttcacgttgtcgttgtagacccatccctcgttgccggtgttgtacggaggatcgatgtagatgcaatccaccttcccctcgtactcgggcagcagggccttgagcgcctcgagattgtccccatggatgaccatgttgccgcaatcggatccatgcgaatccaaaacgctcttttcagggatgcgttcgagtacacggtacggcacttgacggtggtatgcgaccaccttgctctttcccatccactccaaagtcggcatgacccgttctcctcgctacatcaaatcgatatatccaaagtataggctttcgggctaatggctcatatggcgcccaggaccttcgcgatcaatcccggcactcttgccatccccgtcttgccgagcaagattcttccgcagcgtgtcgccgaatctgtccagcagatccgttttgctgcgaatggcgtccggcttccgacgcaatccctcgaccagatcgatgaacgcgtgttcctcctgttccacgcagtcgaggaacacagaacagaacgccacgggatcgccgtccacctgccaggtctccagactgcgggcatagtcgcgcttggcgtcatacttgatcgccacgggacgatagccgtgcttcagcagcatgaaattaagcagctggcggccggtccgcccgttgccgtccatgaacgggtggatgttctcgaacatcgcatggaagccggcggccctgagcagcggatgagcgccgctcgcgtccagcccgtcgatcagggcccgcaggtcgtcgcggatctccagcgggtcggcggtcttgacgcgggtcgcggtgatcctcgccagataaccgtaggggcggaacgtgccgcgggcgaacggctggaggtccagcgccgtcacctcatggacgcgccggaccagttcctcatccagtctcctcccctcccgggcgtattcgcgtacgtaggccatgccgtccgcgacgccgcgcgcggcgaacacgtaccgtgccggcgaatccgacgggacgaactcgccctccaaaaccagggacgtgtcctccagggtcagcgtggatccctctatggcgtttgaattgtaggtgtagcgcaccagccagtcgcggtcgtaatccgccagcgccatgtcctcgacgccgtccagggggtccagtgcgcgggcacggtccttcagcgcgtcgattcgtcgcaggcgttcgacgattcccggctcgcgttcaaggccgagcagttcctcgggcagttcctgtatgcgctgcgatagctcgggattggccatcatgtccctcttttcgtgttccggttgcaaagtccattattccagccgcggttcgttccgtcctgcggcctgcatgtcatagggaggcgcgccggccgtcccgggtcgattcgaacgccgcggccacttcttccgataccggcatgcgcatcgtcacccggccggtttcctgcgcggcggcacgtttcatggctcggcgttcggctctggtgggccgttcgagaatccactcggcgaacgcgcggataaggatggacgcgacgatcacgccgatggatccccagaagcacgggacgaagtccggctttgtatggtcggtccagaaccaggcgatcaacgcgaggatcaacgccaggccggcggacagggcggcgagcttgtggaacacgagggcgagcgtgcggatgggatgcgtgaccagtcccaccgccagcgcgacgacgacgagcagtgcgacgaagccggcggcgatgacggcgacgcccaggtatatcgcgagcatgtagagtccgaacatgatcggccttccttccctctcctattccgtttcttcgggcagataggtgtagtcgacggcgacgccctccgcctcaagcagcacggctgcctcgcgcacggcggcggcgcggcgcttcacggattcctcggcccggacccagtcgggcagcccctcgggcaggtcggagacgcgggagaacgagagcacggcccgctcatctcccctgtgccgttccatgatggccgcgacggcgcgcctgtgctcggcgagatagtgttcgagcatctcccgcattctccccgagggttggatccggtatttctccgactcgtatttcttgaccatgtccacggtgaggttcgcaagcacggccgcgtcgtgctgggtcatgccgatgcgttcgcgcgtcgcgcgcatccacgccttggcctcgctccaatcctcttttgccatggtccctcctggatataagaaagccggatccgcctgcgcgaaccgtgattatacttttagtataatcgaggttttctacagggcggacccggcgtttcccgggacgcggccgtggctgcgccccggtttcgtcactcggtcggcatcgatggattatcgtcggccgtggccttgcgctgctggtcgagcatctgctgctggatgagcacgctgttggtctgtgccgtgtactgcttctgggccatgtccatgctttcctggtggcgttggccgaagtcgaaggcgacgcccttgtccttgtcgatgacgagcgcggcgtcaaacgtgccgcccttcctcgaggtgaagcccttgaggctgaccttccggccgtcgagcagcctgcgcatggtcgtgtcggtgatggtcttgccggcgatggtcgtccaggcgcgccagccgcatccctccgtggtcttccatgtgccgtcgggttgtttctcacgccggttggtggagcattggaacaccttgcccgttttgacgacgggcttgccgcagcgcgggcagccgccgaacgattccgtgttccgtgttttcgtctgcacgtggtcctgccggacggtggtctgcgcgtcggccgggatgcgggcggcgaggtcgcggaactccgtttcgacctgcgaggccgcggcctgtccgtgttcgacctccgagaggcgtcgttccatgtcggcggtcagtgccacgtccttgagcttcggggcgaccacgtcgatcagggaccggccctgttcggtggagcggagctgcttgcccttgcgttccacgtatccggtgcggatcagcttctcgatcacgtcggcgcgtgtggccggcgtgccgatgcctcccgagtgggattcgtcgtcgtccaatgcggccttgagatccttgtcctccacgcggcggctggcgtgttccatcgcggcgagcagcgtcgcctcgctgaacggcttcggcggtttcgtctttccctcggacaatgtcgcgccgcattgcgggacgggcgcgatggagaccccggtgacgaggttcgcggggatgatgttgcccgcagtctcgtcattgtcgtcctgatcttcctgtggcccgtcatgttcgatggcgtgccagccgagggagacgggctggtcggaacggctggtgaaacggcattcgccttcggacaggaggcggccttcgtccggatgcttttcgcaccaatgcgggtcgatgttcgcgacgacgttcgtcacgtcgtgcacgtagtcgtcgcccacggcttcccacatgcggcgcgccacgcggacgagcacgaggcgttcgtcatcgccgagttcgtcgagcgccgccttgtcggcctgcatggtgggaaggatggcggtgtggccggcgaccttcgcgtcgttcacggtcagttcgagatgtggccgttccggtttcgcgtccggttcgatgaagccggtgacgaggcgatcgccttcggtgaggccgcgcagcgtgtccaggtcgtcgtgcgtgatgtactgcgagtcggtgcgcggatacgtcgccagttttttctcatacagggattgcaaggcggccaaggtgcgggcggcggtcaggccgtgcagccggctcatgtccttctgcaatccggtcagatcgtacaggcggggcggtgcgtcgtgctgctgtttgcggtcggccttgaagatcgagaaggcgaagtcgtccgagttgacgatccgcagcagcgtctcggcgtcctcccgcttgtccaggcgttcgccggccagtttccatccgcccatcggggcgacgaccttccagtacggtcgggcgacatggccggctatctgccggtcgcggtccacgatcatcgcgagtgtgggtgtctgcacgcggccgacggtgaacctcgcgttgtagacgaggctgtaggcgcgcgacgcgttcatgccgatgagccagtcggccttcgcgcggatcatcgccgaatcggcgagtccctggtattccgtctcgtccttcatggacgcgagggcgtcgcggatggcgtcttcttccaggctcgcgacccacaggcgtcgcatcggcttggagacgccggcatgcgtcacgattctgcggaagatggcctcgccctcgcggtcggggtcgcacgcgttgaccaatgagtcggtgtcgcctcggcgcatcagtcccgcgacgatcttgtactgccggtccgtgcccttctcccggctgaccttccattgccagttgggcgtcgggtcgatgggcagcgtgtccaggctccacctgccccagtcgtggccctggtattcgtcgggcgcggccaggtcgacgaggtggccctgcgcccaggtgaccaggtcgtcgccgacctcgatgtagccgtcatgcttttccgcatgcccgccgaatgcttgcgcgatggcctggccgaccgaatgcttctcggcgatgatcaatcgcatcccgcatcacatccgatcatcagtagctgccggacgcccacgcgggtcgtccggcatccgacgtgtccggtccggcggcgtcctgcggggcgggctcgtcgtccgtcgcctggatgtcggatccggtcgtctccggatccgattcggcgacggtctccggttcggagggtggggtctttcttccgcccggcgcggcgacgagttcgcccttcgcgtcgaacgcgatgttcttctccgttccggtcatcgccagcttgtccgcgatcatcgtccgactcatgccggggaacgcctcctcgaattgcctcgccgcgtcgcgcagcgcctgcgcgcttttgcggaaattgtcgaggcggttgtcgaacttcttcgccgccgtctccttgcgtttgaacgactcgcgttcgtcgcgcaggaagtcgtccacgtaatcggatgccatggtccgtttcctttccagtcttgttttcatcggttcccggttttgatccggctggaaccatggtcacgcgattggacacgcgccggtttggacagtcgggctccgccaggatcacacgcttgtgatcctggcttcgccggaaacggagcgcggccctgggccgcgcgctatcttcgccgacccttccgggatttccaggcgtcaacgcctggaagggaacggccgacccggccatggttcatcatcacagccccgcgcccgcgtcttcggaactgcgtgttccatgctccgctccgggagggtttcgcccgattatcccgaagcgggcacggcccacgcgtcctccaccgcgcggcgggaccgcgaggctgccccatgtccggcgaaaggaaaacaggaacgccggcgggacactaaggagtggaaccatgcagatggaaccgatggaattgcagcacgtcgtcttcgagaccgacgggggacgaatcgacgcgatgtggagcgacgtgcgtctccacgagcacgacatcaccgacggatggcactgctacgccgtcaggggcggcgacggcggatggccgccatgcagcatcgagaaaacagtatgggtcaaccacgcgggcgacatcatcacgcccgacgacctcgacccgctgctcgaaaggaacgggtggatgctcgtcatcagggactggtggttcaccgacgaaccgttcgggcgcgcagaatgaaaggagacatggacatgaaggagaagaacagggccgaggaatggttccgggccaaacacgacgagctcgccgaaacggcgcaggccaacctcgccgcacacgacttggaacccggacaggaggcctaccatctggacagcctccactatgcgaccgccgaacagatggaggccatatgcccgacgggcatcgacttcgaccggtacgcgactctggcgaacggcagcgtcggatacgacgaggccgacgcgcattgggccgacgcggcatggtgggacgaacaggcgcgaaccatgtgggacgaagtcgacgacatccctgacgacggcctctactggacaagcgtcgaagactaaaacgtcatcgccgttcccggccaagtgacgccccgggaccgatgccgcccgcatgacgcgggcggcgcctccggcggccagaggacgactaccgtcctctggactccacgcgccgggaaccgttcctggacccgacaaggcgtcgccgtggcacggaggccacgtctcgccgacgggaaacggagcacggcaccaatgccgcgcgcatcccgaggattttcttttgaccggccggctgacgccttgatcatagcggcacgcggaacccgtcaacgcccgcgcagcgaaacccgtggtttcgacgcgttctcatgacggaacccgctaccaccgctagcgctttcgcttgaccatccggtcaaaagaaaaatatcctagaatggaagacaacgaaaacaaggaggcggacatgccggtcatcagcatgttcttcggaatcatcatcaccatgaacgcggacgaccatgttccgccgcacatccacgccagataccaaggccacgaagcgtccttcaccttcgatggcaacctgctcaagggagacctcccgcgcaagcagcgcaaactggtcgaggcatgggtgctgctgcatgccgaagagctggaagccgactgggagctggccttcaacctcgagcacccattcagaatcgacccgctacgctgacaaggaggcaacggacatgaccatcgactattcaatcaaagtgacccaatgcgagcccatgcccggctacaagctcaaggtcacctgctccgacggcgcgaccggaatcttcgacatgtcccgatacatcgaccgcggcatgttcaaaccgctcaaggacccgcagacgttcgaccgcgtgcgcctcgcgttcggcgtgccctcatggcccggcgacatcgacatcgccgcggaacgcgtccgctccgacatgcaaatcatctagaagcccacgcgcatccgccccgaccgtcatcaagacggccggggccttttcatgcccgtatgcatgacggacatgacgcgccaccaacgacccaccggccccgcgattttttcgcggggccttctcgtttccctgctccaagtgtccaaacccatcgccgtttccacgacggacgattggcgtaagacaccggccgtgccctcaaggccatgggcgaaaggagcaaggagtgaacgcgatcatccttcacggcattgcgcaatcatgccgtgcgaaatcactcccaatcaatgaaattgatatgggagtagcaagtgacgtgaacgtatatacgttcactcgattcgcaccgcgaatcggcttgctcgggagacccagaccccatggtcgagcaagctctccagaccgcttcgcggcatcacggacgtgccgtccgcacacctccacgggaggtgcgaaatgagctgggcgaacaagcgccgacgcaccgtgcagaagctcgtcacgttcactcccgacgagtgggaacgcgtcaattcgctgcacaaaaaggtgaacaagtacacgacaagataccgttcgttcaccgtgttcgcacgcaaaatgctgaccgatggcgagatccgcgtcaccgagatcaggccgctgacagaccccgagccgctcgccagagagatcggccgcatcggcgtgaacgtcaaccagatcgcccactgggccaacgcgaacgagcacatcaccgccgagcaggtggccgagctccgcgcgtcgttcgaccgcatcgagcgtctgctcggcgacctgttcgccaacaaacgcaccgccgggaaggacgtgtgagcatggccgtggtcaagctcggcaagcccgtgaaatcgaatctcggcggccccaacggggcgatggcatacatcatcgaccccgccaagaccgacggcggaagactggtcagctccaactacgagcggaccggaacggactacgacgcgctggctgatccaatgctcgaagacaacgagaactcacccaaaggcatccaaaagaacagccgtctggcgtaccacatcaagctgagcttcagtcccgatgaccccgtgacgcccgagcgggtgcacgaactcggtgtggagtttgcgcaccgcatcaccagtgatgaatacaagttcgtggtcgccacacacaccgaccgccaccacctgcacgaccacatcatggtgtgcgccgcctcccgatacgggaagcatctgaaggcggaactacccaaggacatcatcgaacagtggcgcgtcatcgccaacgagatcagcgagagggaggggctaagcgtcatcttcaaccccgccaccgagcgggtcgcacgcaaaatgcgcggcgacgaaaccacgccgaacgaagacccgacgacacaggcacgcgaccccaaacatgtcgaagagacttccgaaccgggcacggcggcgacggcgcgaacgacgcgacgggccgaaaacgaggagccgatggagcgtcgctacggcatgtcgatggaggagatctacgcgtccgcgaagggcctgggcgtcaaggaccagctccgcatgctgatcgacctgaccctggccggcgcggagaacttcgaggactggaggaacatgctcgacgtgcagggcgtggacgtgacggtccgaggacagcacttcacgttcaccatgaaggacaccggcttcaaggtccgagacacgaaactcggctcggcgtacgacatgacgaacatcatggccggactgcaaagcacgcccgtcatccccatcacgttcaaccgtcggctcgtcgccaaacagaccaggaagacggtcaccgtgtggctgcccggcacccaccggaagaaaaagatcacgttcgacgcgaagcgtctcgtggacgacggcggatccacgctgcgcgcgttcctgcccctccaccgcgaccagatcatcctcgacccgtccaaccggtacgccggcaagaccaccacccacggcctctaccagtggttcggcgagcccgcgaaccgactcgaaccactggcctcgcccgaacggctgcccctgcgctacggggtaagtcccgcccagcagcgctactaccaggcacaggcgcgacgcctcgaccggctcgccggcgaggcgaaggcgctgaacgcggcgatccgctggaccaggctcgcgggcggcgacagcgccaagggactcaagctgctgcgcggaaaggtccgcgaatcgcacgacgaactccaggccgccgtcatcgcgttgcatgacgcgatccaacagggaaaccccgacctcgtggccgagacgcgcggcgagatggaacgtcgcgaggccctgtgcgaccggtacgagggcgagctggccgccatcgaacgggagatccacacgacccgcgaccgcgagcaaacggagactgagcagcgcgaacagcatcagcacaagcgtggacggtccatctgaaccgtcccaggaaacaccaaccgacaacagaaaggaaaccgcaatgccaatcgaggaacaggctgaggagaagatccagaacgccgtccagaccatcatcaccggaggcgcgaagctcatgctcagaatccccaagggcgtggccatggcgctgctccgttccggcatgaagctcaccaagaccggcgtgcacgccgcgggcgaggccgtcaagaacaagatcgacagcggcgagatgtccgagaaacgattgcaaagaaagaaggacggcgacctgcacgagctgcaactcgacgactcgaccatgcgcgaggtgcagcgcagcctcaagaccgccggcatcgactaccacctcgaacgcaccgaccaaggccagttcatcctgcacttcgccggcaaggacgaagaccatgtccgccacgcagtgcaacgcgcgttcaaaggcatgggcctggacgtcaccgacgacgacttcaccgtcgagcagacggaacagacccgaaacgagccagaacccccggcgcgggagaccccggccgaaccggcctcgaagcccatgccgacgcagcgcatcgcctgggacttcgtggatccggaggtcatggagatggccgcgaacagcctcgccgcccggcatcccgaactctcatgggacaagctcatgggcgacacgacatggaacgagcaggccggccgcgatttcgcggaccggatcatcggcaaggccgccgccgacccgagcctgcgcgacgagctcgacgtcatcctgcgcgacgactacgggcagggcgcgcaaacccaggagcagacacgcaggcagacgaccgagccgaaccgggagaagccggcaccggagccggaaagcgaaccggaacccgcgccggacgaagcccggacaccggccacgcgacagcagacgcaggccagagcagacaatcccaggccggccggcaaggagcggaaaccgaagccgatccggtcgaagaaggcactgctcgaacggttcaagacccggctcaacgagaacctcgccgaacaaaagaaccacatgccacccacccagaacagggaccgcacgccccgcaagggccgctgaaaggaaaccataatgaaccagcaggaacaggcgacgaaacacgccgcgatcttccaggacaccatcaacggaaccaacgacccgaccccatggccggtgaccatgtgggcctcgtccggcgacacgatatggacggccggcactgcaaggacggccggcgaggactcggtgggcatgatctacgatcccggcgacaccatcgtgcaccggaacacaatcgccggcgacgtgacccgcgccaccgaatccttcgccatcagaccggcggacgggcagagcccgatggacgcgatgctcgcgggcatcgaacaatggaaccaccgccatcccgaccggtgggacaccgtggccacgccgggccagtaccgcatgacggatccgacgacgggccggcagctccctatgggatggagcgccagcctcgccgccgccgcgtccgcggcgggacggctcgaccccgacctgctccaggccagcctcatgcagaacgcggtcgagcacgagccgcgcccctgcgtgttcttcctggaggataacgggtacgacctcatggtcttctcctggcatcggaaccagcagggactgttcgacgcgatgagcttcaaacacctgcaatacgacgacctgagcatgcaggtcaccaccatcagccacagcgaggacatgagcgagcccttccccgccaagaccatgagcgacggcgaactgctcacacaaagccgcgtctaccgggacgaataccagcactggcgcgaacaggacggcggaaccgtcgcccagggcatgaccggccgcgtcatgcgcagcggactgctcaaaccgggactggagcagaagccgctgctgaatctgaacgacggtcgacgcgccccggactgggacgagttcaccgaccaggccgccatatccatcctccagggccaacccatctcgccgacgcccgcgctcccccagcaggagcagccggagcgggacaccgaccccacagccgtgacacagacgccggcccggacggccgcggcgacgaagcaggtctggccgaacgcgtgggtggcgaacaggctcgcgcacacctatatattgcatgcgaaggacggacgcgactggccgaagatgatcgtcggactcccccgcggcaccgccatcgatggcaaggacctgaccggctgggcgaccgacatgttcatgagcgcgaagaaccagaggcagaagaacgagggacgggccgtcaacatcaggttcagacccggcaccccggtcgagctgttcaccggccgcggagcggaacgccgcaccatgcaggtcgacccgcagacgctcgtccaggcggtcatcgacgcgcagaaacgcaaccgcgacgccgagaagacgctcgacacggcatcggtggagctcgcctcgaagaccgtggaggaatcctggccgcagatcgaacgcatgcagggccggttcacggaataccagcgtgccggcacgtacaagccgtccgtcgcaatgaaatgggcgcgcagactcgtcgaccggaccgccggagaggacgagggacggtggaccaaccgccaacgccgccaggccgccagactgctcatccaggaactcaccggcacgcaggatccgacgcaggccaggagcaaaacaacggatcgtccgaccgtcgaacagtacgtgccggaaggcggcaaaacgcccgacgccataggcgatgagacacccgcgccgccacggaaaacagagacggacatggcgacgaaacagcggcaagaccccatcgttcccgcctcgcaatccccggccgccggtccggaacgacggcacacggacctgaagtcaacgcttgaccggttccggaccaggctcagggagaacctcgacggactcaacacagccatgcccgcacccgggctcgaccagaaccgcgggcagcggaaaaccctataagaaaggagagaaccatggtgagaaaacgcctatacgcgaagcggacggcctcggccgaatacgagcagctggacctgttcggccttctcgaggaggagcagcgacaggccgacaggacggcggaacaggtgcgcggatacgagataacggtgagccacgtcgcggtgcaacgactccgcgcacgcggcgcggacgacgagacgatagccgccgtggcggccgaataccgggagaaccggctccgtggactcggccgacgggacgcgcggatcgccgccgagaacaagctcggcgtcggtgccgccacgcccggcgaaaccacgccgcaacctgtggtaaaacgtttcacacaatcctccggcacggaaaacaacactgaagaaaggaacaatgatggacgagatgacatggaccgacccgcagctcaaggcgcgctacgagaggaacctcaaggcgatggagcagcgccgggcggcgcatccggaactgttcaacaagtgggcgctgccgtacaaggtgttcacccgcagcagcctgcacgggatccagaacatgcgcatcaactggctgatggacaaccatccgcagcggttcagggagatgatgatggccaacgtgctcgaggagcatctgcgggacatcgagaggcggacgagggaacgccaggcgcagatcatggaccagctgatggagtccaggcacctgctcaaccggacggactgcctgaaggcggcaccccagatgaccgacctggaccggctcaacgggatgaacgaggcgcaagcggagtcgatgagcatggcgatccacgagatcgtggaaagcttctagcatccctcgactcgcaacgcgcgcgttcgccccgcgaacgcgccgaagcgaacatcgccgccattcggacactcaagacgctcgatgggaacggcgacgagccgctctccgcggagcagctggacacgctgcgcggatactcgggatggggcggatgcgcggacgcattctccgacaagcccgaatgggccgacctgaacgccgagatccgcgaactgctcgacgacgatgagtacacgcaggcgcgcgcctccacactgaccgcctactacacgcccggccccgtggtcagggccatgtgggacgcgctcgacatcggaagcacaccgatccaggtgctggagcccgggtgcggcaccggcaatttcatggccggcatccccgaaaacatcaaagcgaacgtgtcgggcgtggaactcgatccgatcagcgcgcgcatcgcggccgcactgaacccggacgccacgatcctcaacgcggacctcgcggactgcaccatccatccgggattcgacctggccatcggcaacgtgccctattcgggcgacatcagcctcggctaccggaccatggacggcggcacgtcccgtcttcccctgcacgactacttcatcgaacgctcggtggacgcgctgcggcccggcggcgtcgccatgctgctgaccagcagatacacgctcgacaaacgctccgagaccatgcgcgccgacctcgcgagaaaggccgagctcgtcggcgcagtgcgcctgccgtcctcgacgttcgcccgccaggccggcaccgaggccgtcaccgacgtgctcgttctgcgcagacgcgaacggacgctcgaccgcacgcccgacgaggcgtggatccactccaatccggtcgccgtgcccggataccaggacgtgaccgtcaacgtcaaccaggcggtcgccggcgacatggccgcgcacgcggtgggcgacatcagacctgtgatcggacggttcggcggcgacttcgacgtcgtcttccagggcgacgcggaacaggtcggcgaacgactccaagaactgctctccacacagatcacccacggcccggcgctgtcgctgggcgaggcggaaccggccggacgggcggagatcacggtccggccggaccatgtggcaccgttcgaatactccgtcgaccagcgcggagtggtctggtacggcgacggcaccaccgtcaccgagatagcccacggccagggcgacgaggcgcgacgcctgcgcggcatgatccgcctgcgagacctggcgcgcgagctccaacggctcgaactcgaccccgcccgcgtggacgaccctctcgtggaggacaagcgcgccgagctcgaccgggcatacgaccggttcgccggcgagttcggccgactgtgcgaccgcgccaaccggcgcgcctacagcggcgaggaatccggctgccatctcgtcatggcgttggaggagaccgacgaaaagggaaggttcgccggcaaggcgaaatgcctctcgcagcggaccatcagcccggtgccgcccatgcccgaccatgccgacagcctggacgacgcgctggacatcagtctcgaccgcgccggcggggtcgacctggaactcatcgcgcgcctggccgacaccaccgtcgaggaggccgaggccggtctgggcgaccgcatcatccgtgacccggacaccggcgaggtcatgcccgccgaggactacctcgccggagacgtgggaacgaagctcgaccacgtcacggccatggccgaacacctcagacgccgggcggcacgcgaggccatgacggagttcgcggcatccacctacgcgacatcggaggacatgctcgccatagagcaggcacgcgaatggatcgacaccgcgggaacggacgtgtggcgcagcctcacggacccgtacgccgccgaatcctacagggatccgacgccggtcatcgaacgcatcaacgacggacggcacggatggaccatgggctggaaccgcaacccggaactcgtcctcgccctcgtctggcgggcggtggaggaactgcccgagcgccactcacgcgtcaccctcgaacgatccgacaccggagagcggaagccgtggcacgcgccggcatggcaccgatcgcacggcaccagcccactgtgggacgcattgtgctggacatggcgcgacggcgacgcgccacagcactacgcgccgatcctcgccgaccggcgcatgcccgtcagggacctcgccctgttcgtccacaagatcgcccacaccgaccggctcgaaaccgccgacaagaccgcgatcctctccaacctgttcgagagctattcggcccacgacgagcatggcagcacgatatggacggacacgaccatcggcgcgatggcacgccgtctcatgcccggcaccgacgaccccacgcggctcgccgaacggctcgccaccgacatgtcggtcagcgaatggatctggggcatcgcccgcgacctgcccgacctgcgccagggagcggcacacgacgcctacggcgcgccgccacgcgccatcgacgcgcgccccgacgactaccaggcgttccgcgcacgccgcgaggaacagctcggacaatggcgggagcagccggagcacgccgaggccgcgcgcgccgaccagacggacgcggaacggctcgaacacgtggccgatctgctggaacgcgtacagcccaccccgctggagaccgagcagatcaaggtgccgttgggggccccgtggatccccgccagggacgtccacgacttcatgatggagacgttcaacgtgcgcggccacgggctcacgcccggcaagctctcccagtactcggtcgactggatcccccagctcggacaatggcgcgtcggctactcgggcggcggcgacatcgactacaaggcagcaaggacgtacggcaccgaggaccgcaacccgttccaactgctggaggcgtgcctggacaacgcgcagatcaccgtcaccaaggactcccccacggagaccacggcgtccggcaagcccaaacgggtcaaggaccagaaggccacgatggccgccatcgagaaggccaacgcgatccgcgacgcgtggaaccaatgggtgttcaaggaccccgaccgcgcgcaaaggctcaccaccctgtacaaccgcagattcaacggcatgcggccccgccacgtcgatggatcctacctgaccacgcccggcatcgcccacggcgtcgccctgcgtccgcatcagaaggacgcggtggcccgcgccctgcgcagcgacgagggcaccctcatcgcgcacgtcgtcggagccggcaagacgttcgagggcgtcacactctcccacgaggcgaaacgtctcggcaaggcgtccaagccgatgctcgtggtccccaaccacctcgtggaccagtgggccggcgacgtgctcaggctctatccggccagccgaatcctcgtcatggacaaggacgcgcaacgcaaccccgaatcggtgagacgcttctggggccgggtcgccaacggcgactgggatgcggtgatcgtgccggagagccggttcagccagctgcacgtcagcaaggaacgacggctgaggaacatgcgcgcccgcgtcgacgagttcgcccaggccgtcgaggccgccgccaaggccaggggcgacaaggaccccaccgtcaaacggctggaggcggcgcgcaaaagcgccgagaccgccatgcagcgcctgcgagacggcaaggagtcgcgcgacgacaaggcactggcgggcatcaagttcgaatcgcttggcgtggacatgctcatcgtcgacgaggcccaccacttcaagaacctcggcgtgcccgtcgcatccgccgacctgggcatgcaactgtcgtccgccgcgaaatgcgaggacctgctcgacaaatgcgaatggctgcgcgaggccgggcacggaggcaacatcgcgttcatgaccggcacgccggtctccaactccatgagcgagctgtacaacatgcagcgctacctcgcgcccggaaccctcaaggcccagggcctcgacacgttcgccgcatgggctggcgcctacggccaggtagtacccaccgtggaactgaagcccgaaggcaacggattccaggtcaagcaaaggttcgcgcgcttccagaacctgcccgaactgatgaacgcggtgaagcagttcaccgacatgatcaccaacgacgacatccagctgccgctgcccgaactggagcaggtgcccgtccccgtgcccatcaccgaccgccagaagaaggagatggaggaactgtccgacagggccgacctcgtgcgcgacggcgacgtgccgccggaggtcgacaacctcctgcggatcactggcgacgggcgaaagatcgccctcgaccccaagctcctcaaaggccacgagaacgaccgccccctggagaacggcaagatccaggcatgcgccgagaacgtcgcccggatctggcaggaggagacgccacgcctgggcacgcagctcgtcttctgcgactcgagcacgcccgcgtcgggcggatggaacgcctaccaggacctcaaggaccgcctcatccaattgggcgtgcccgccgagcagatagcgttcgtgcacgacgccggcgacaaccccgccagacgcgagcaactgttcgccaaagtcagatccggcgagatccgcgtgctgatgggaagcacccagaagctcggcaccggcaccaacgtgcaggaacgcctcgccgcgatccacgacctcgactgcccatggaggcccgccgacctggaacagcgcctcggccgaatccaacgccagggcaacacgtacgaccacgtgcgcgactaccggtacgtgaccgagggcacgttcgacgcgtacagctaccagaccgtggaacgcaagcagcggttcatcagccagctcatgagctcgaagagccccgcccgcgaggccgcggacctcgacgccgacgtggtgaccctcgccaacatcaaggcgctggccaccggcgaccccgacatccaacgccgcatgacattggagaacgagatcaaccagctgaagctcctgcgcgcctcatgggcgcagcagaaggccgacacccgcagggacatcaaccagcagctccagccacgcatcgaggggatccgccaggcgatccgcgagaagaccgacgacaagccgctcgcgtccaaggccctgagcatccaccagaccgcacgcatgaacggcaagtgggagggcatgaccatcaacggccggccggtcggcgaccggcagaccgcatgcaggctcctccaccaggccgcccaccaggcgcacgacggggacacgatcgccgaatacgacggactgcccgtcatcgcacgcagggcggccaccaccggacggatcaccctggccgtcaaggccgtccacgagcacgaatccggtaccgagatgcccggaccctacctgaccggaccttccagcatcgtcagccagctcgaccggatcgtcaagaacatggccaccgaccccggcaagctcacggaacggctggcggacgccgaaagggaactcgccgccgcgcaggagacgctggccgaaccattcgcccacgaggacgagtaccggcaaaaacaggcagaactcgaacggctgacgtccaaacccgacgaaccccgggagacggaaagtagagaccaggaaaccaaggaaaggagcgcaggaatgccattgacaacggaaaacgccagacgactgctcgaacaggaccacgacgtcaccgaagtcacccagggcggcaacgccatgggccactacctcgaagcgaggctcacggacggacgcgccgtgcagatcgacttccacgacaaccccgcatggaaagacacggaccgtctggccggccggatcgaggtgtcctacgccaaccgcccacaggcggaatggcaatacgacgacaacgacatggccgaccgcgaacacaccgtcatcgacccggccgacccagccgccgggaaaacactcgccaaggcggtggagggctgggaacgcgcgggcggcctacacacggcccgcgcagccgggacgagccatctggccgcgaaccagccgccggaggaatacgcctaccggtggcggaagcccggggaccccgacaggcacatcgcatacctgagcaccgccttcgaccgcgaccaggcgatgaaggcgagggaggacgccggatacgtcgtgacgaaggtcgatgaggatccggccgtgctctacgagcagcaccgcaaggcgtcctgcatgcgcgcgagccacatcctggaacgatacgaatcccccgaccaggacgcagtcagaatcctccacggcatcgtgggcgaggtcaacgcgcacgaccccgagaacgacatcgccacctacctcgcctacccatccgacaaggcggtccagatcgacggagacggcctcacctccgcggacatcgcggagaaacgcgagatgggcggatgggacccgcgaaaggacccgctcatgcgcatcaacgcgcagggcgactggacgggcatcacccaacaacaggccgaccagatcgtctgggacaaccgcgatgagatcctcacccgcgcgtcatacgacagtgaactgtccacgtggacgctccaccagcttgaccagttgaaggagccccagccggcccaaagcctggaccgtgaccggccggaaccggatcacaaggcgcccgcacaggccgattccacgacgaagcgtcacgggccaagactgtagtcctctccagccacggggtggcgcgctttccgcgccaccccgcattcattccatacgaaggagcagaagacacgcatgacaacagaaacaaacgaccagccggaacccatcatctggttcgagggcacactcatcagcagcccacggcaaaacagaagcgcggaagactggctgcttgaaaccatggccatgggaacagccacgaggaaaatcaccatccacgccagcggcagggagcattcggagaacatccgcgaccacgcgcgcaagggatcccgcctcatggtcaaaggcaccgcgggcgacgaaggatcaggcatcgacatcgaagccacaagcctcgcgttcgatcccagccatgacgaaccggacgggaatcgatgacacggaccaccaccgtcagcggcatcagaccggacaaggccggcgacggcgaatggatcgacatcaacggccacgtcggccgactcatgtccacgctcatggccgacggccggccattcagcatcgacgtcacgccgggcggcatgaccaccgtcacgcccctcccacccccgaaggacgcggaagcggccggcggcgacgcccaggccgaaacggagccggccgacgggaggatcaccagcaggaagacgctgtacgaccggttccgcgccaggctcaaggagaacctcgccgaaagaaaacaatagaaaggaacaatcatggaacaagcaagaggaatcatcgtcaagacgctgaccatcctcgcgggattctggctctccgacctcgcggccgcccgcgtccaggccggcctcgccgccggcgaaagcatcgaacggatcatggacggcatgacgaccatgctccagcatccgctcgccctgggattcgaccggaccagcctcctatgcggactgggcggcgcgtgcgccgtcggactgttccacctctaccggtggagcatgaaacgcaactggcgcgacggcgaggaatacggctccgcacgctggtccaccagccgggagatggccccatacaccgacaacgacacccgtcagaacctccagatgacggccaccgagggcctaagcctcgacgcccgggccacgcgacgcaacctcaacaccgccgtgatcggcggatccggatccggcaagaccgccacccacgtcatccccaacatcctcaagggcagcatgaactacgcgtgcaccgaccccaaaggcgaactctacgcgcgcaccggcaaggacctggagaagatgggatacacggtcaaacagctcgacctggtggacctgaccagcgagacgaaattcaaccccatgcgatacatcgaccccgacaagcccgacgtggcgatcatgcgcctggtcaccaacatcatggacaacaccaacggctccacacccaaggagcaccagaccgacgacttctggaccaaatccgaacgcagcctgctgaccgcgctcaccgcgttcgtctactacctgcccgacgacatcctcaaggactgcctgcacatcgacgccggacagaccctcaacgcggtcgccgacatgcgcgacctgctcgaagccagcgaacaggacgagaccaaggaaagccaggtcgacgccgtcgcccggaccgccacggaaatctacgaggagacccgcgccgaatgggagcgcgaagacgcggaccacaacgatccggacctgcgcgaggcatggcgtctcgcccagggcctgaagttcgccgcccgccagtacaggcccttcacccagggcgccggagagaccaagaagggcatcatcatcagcctcggcgtgcgcctcgccccattgacagtcggcccggtccgggagatcctctccgacgacaacctctgtatcgaccggatcggcggatacgcggacgagcacaagggcggatacaggcatcccaacgggaagacggccatcttcctcgccctgcccgacgaggacccgacattcaactttttggccgcgatcttctaccaatgcctgttcgacagcatcatccgccgctgccgcacctaccccggcgaatgcctcgccacgccattgcactgcttcctcgacgagttcgccaacgtgggacgcatccccaacttcgacaagctcatcgccacaatccgctcgcgcaaggtcagcgtcagcatcatcctccaaaccatcgcccaattgaagaccatgtacaaggactcgtgggagacgatcgtgggcaactgcgattcggtgctgttcctcggcggcaacgagcagtccaccaccgaatggctcagcaagctgctcggcaaggaaaccatagacatccgcaccaccagcgactcgaagggcgtgtccggcagccacaccaccaactaccagcgcaccggccgcgaactgctcacgcccgacgagctcgcgcaattggacaacgacaaatgcatctacaacctgcgcggactccacccgttcctcagccgcaaagcatggcccaacaccagcatccccaaacccaaatcaaaactcaagcactccaaaggatggaggaaagcagcatgaggaaacccgacaccgacgaaaccatagggaacaacgtccacggcataaggatcgcacggcgcatatcaatgcaagaggctgtgaacggcatgagggaactcggacacagctggagcaaaaccactttgttcagcattgagcacaacacccgccgcctactggcatcagaagcatttgatcttctcatctgccttggatatgaccccgaaaaagacctcatgctgatctttggtgagccgccgtccccagctgactattccatgcaacgctgcggccgatgcgccaccaaggtagaagacgcctggaacgtttatctcggagctctggaagtcgccgaaaagtcgctcacagaagaaacagaaaaaggagaaatcaccaaagaatatgccgatgcacaacggaagaagctgcggacttgggaaaggtcgatgagcgaggcaatcaaaaaaagacgctctgaacacggcacaggcacgatagcgctcaaaacaagttaatcattcatatgtttctctcatatcatgcgacggatacgagttagatgccgacaatggacaaacccgaagcatccacataattatgacaaggtgttgttaccctcgtcacttatttgactaagagtcacgttggcatatgattgcatggtcatctttctcgatgcaaacatatattcagaatagtagcctcttttattcgctgaataagctatctgatattcatattgtttaacgttcttatcggaatacaacctgcatatttgaggcgctttgtcataagtgagtatccagttccaatccggctcagcgacgaggcgcttcgcaaccagagagtggatggtttcggttgcatatgaattataaagattccgtccctgcacatagtaaggaggatccgcaaatatgagactgttcttcatatcgcagaatttgccatcagaaagcaatttgaagaaatggctggcctctaggttgctaacagtgattctctctttttccgctgctattcgctctatcctctttttgagtgtgcttttgttaaatcgagaagaaatgttgtatttcccgtcttgggcggcacctcctatcggcccacctttgatgacaccacttacgttcatgcgattaagcatgaagaagtcgaatcctttccgtcgaatatccgaataatggttgaaatcgtatcttttcctgatagccttccagtattccgagtacttcgaagattgagccgtgggcttttcatccgaatagtcaaaggggacgcggtcgatttcacgtagcagatattcgggttcgttgacaagagaataccaaaacgaatatacgccgtcatcaaggtcgttgataataactgcatctacacgacccgacaacaaaagattgatagcaacgcctgctccgcctgcaaaaggctcgatataggttccggttatatggttagtctccaacacgtttgccacgaaacgtgtgattttgcctttcccgccggggtatcgcaacggggtattggaaccatttgtcagcttactttgcgccataaacatgaatgatattagaagattcccattttggccagttcgttcgagtcatacaccctgttttttgaactgcacatattgctgacagagcatagcaaacaataccgcatcattcgacagcctcatgatggtatctatgtcgtaatccttcatagacttgtgcgacccaagcgatgagtattcaacggactcgccgaaatcggtattttcgattacattatgagcctcttggtaggtgtcgaatacaatcctcccggcctgcagatagtcttggaatttgttgtttttaaacaggctatggacatatgagacgttctctttatgctttgcgctgacccctgtgttgggaagatgaatctcattgcaggatttgtccaatgcaagaagggacagttcgaagatcacacgtatcgccggcgcaatcaagaatgctttcgcccatcttttggtgctgtcgtcctccagtactccatatgcgttcaaagcggaaagcataaagttcgtgtcttcgaattccggcgcgtcggtcatccattccggattgttgtacatcgcaccaaggtgccggtctcgatttgtggcgaacttgctggcgaaatcatgattgaggcgtttcgcggcaagtcttggcgacctgaccgttccttgtcctttttcctgaagaggaatgattatgtcctgcttgatgacatcgttattgaggcgtgaaataagggtgccgttctcttgacaatatcccttaacctcatcagccagttctttgactttgtccagttgctcgggggttattatatccggattcttgatatcaagatattccttgaccggagccgagttgaaaacccttctcgtgctggtcgtagcgttcgaacctccgagatagcttgtcaaggaatctccaaactgattctggaacggcgtttcaagcttgtccgaaaacgtctgccttcctgagaagcgggctttggcctcagtgctccatggaatcgtgccggcaccgtcctgagggccgttgtgctttcgattgaggatttccctcagcttatcctgttcattgtcaccgaaaacaacgatgtccagactgctcggaatgttctgcggatattccgcaacaaggttcttcaatctcttgtaatctcggtcatcaagaagttcacggtaacaatctgggttttgcagcaatttgattgcagacaatctcctattcgcatcgtgaatcacatacttgtcgccggcccttgtcgcaaggatcggctcaacatcgttctgatagccattctccgctattgacgatgcaagattcatcaattgccgctttgatgtcgattgagactgtgcactgaagttatagattttattgagttcatccatctggtcgattgatggttcaactctcgggttcgtctcccagagacataaatccgatacattgacatttatacgttccataaatagttcctccgctccaccgaaacaaactcaattcattaccttatcccatgtccaatgatatccccagacctcagtgttatcctctccccgttatctaattgaaagtacaacacacccgttagattcagcttgatgatcccgaacaccgcgcacgcttggaggagctgtgccggcggttgagagcacccatgcatgagtcagtgcagccaacatgcgaggaggtcaccgactgggtgtgtaacctcgcgttgtccgtctgccggagggagcatgaagtctttggctttccctgcgaacggcctcgcattggctgacgctcatgaaagagcgcgttcccgaatcagtttcgatgaagctcccgtcacccatcaccgttcacgaatcagagccccggatcgctgccgggcaagccggtgcccccgtctgatggcgtgggcacggaccatcccggcgaggctccgcccgtattggtggaggacgacaagcctcccgaagacgggcgtcgtccggttccggaaccggatccggaacttccttgggattgcgattggcttcctcccgaatatgagggcgtttgccgctgtggagccgattgggattgcgatgcctgggcctgctgctgcgcggcggcggcagccgcggccgcttcctgttctgccctggccttcgcctccgcgtcggccttctccttcgccgccttcgattcgttgacctctttcacggctttcgcgatcgcgtccgcgtcacgggtcttgaccgccttcagcagggtctcccgggtcttgtcgtccgccaccctgccgtcggtctccttgtacagcgcgttcgcgtcgtccacggtcttgtcgagcttgctgtcggtgacggccttggttgcggccttgaggtcggtgagacggttcttgagctctttggtcgttctgtgcagcgacgccgtggtcctgtccaagtcggatgtggcggcgtcggacgcgcaggaaccgctgatggtggtcgtctttgcgcccaggagccgattcaacgcatcaagcgtcttgggatccgcgacctggccgcgactggtgtccttcaatagtttggaggctttggccgtggtcctgtccagttcggactggatggtcctgcgtgtcgcttcggccgagtcgcatgcgctgattgcggtctcatgcgcctcttgccgcatggcggcgacgtggcggtttttgatttgcagtccccaggacacggctatgaggctcgcggccatgacgatcgcgacgagcgctttcccgaccgggaagacgcggcgaaccttcagatcgtcgaggtcggccgagtaggtgacggccgccgacagccctcctgatctctcggttttcccggtttccgtcggttccggttccgatatgggcgggaggctcattgtggttggctccgggtcggcgacttgttcgagtgccgcgaaatcgccgtcggcgtccttcagggccttctccgcggaatcgtcgggaggagactgctccgccggcgcagacacgggttcctgccccggctcgtcttccggcggcagcggcgcggatggtatggcgacgcgacggcggccgcgcatggacgcgggcggcagcggcgcggcaccggccgtgtcaaagccttgctcctgcgcggtatgccaccattcggcgagctccggccacgcgtgtggatgttcggcgattaggcgcatccatggacgccaaccgggctcgttggccatggcgtacagctggtcgaccgtaagcttggggctgagaatcggctcacccgtcttcctgtcgatcctggtcattcctctccgccctcgtctttgatgaggactggctgatcctgttcgtttaccttcatcacttttgttcctctggtttgccttcatgcacccggtatccgccttccaatgggcccttgaccgccgcgcatcgccagccgtcgtcagtgagcgtgtagtcaagcacccaggatgcctccagcccggtggatacggcgcatgtcgccacccgccgccccgtggacacggggaagccggtgaactcggtctcgggcaatggctgcggggctatggatgatgccggtatgtcgaggccggcggcatccggcgtgaagtattcgccttcgagttggcctcgttcgccgcccatgtagacgccgagcgctttcggcgcgaggtcggcgcacggatcatcctccgtcggcgtcgccggctcggtctcttcgtctccagccgttttttgtccgggttcggttttcgttcgcggccgggcgacggtgctttgcgtgtcctccgcggttccgttgccggcgcatatcaccgcgacgtttcctcccaggatgaggagcgcgaccgcaaatcccgtcgcggcgatgatcctgttcctctttggttccatgcttggttttcctttcagtggatgtagcggacgccatttccggctgcggccagttgggaggcgctgatttcgcgtgtggatacgacgccgaggccaagcgcgttggactcgctgatcaggatcgacccgtccccgcggacctcctcgaccatggcgacatgcccgtagtcggcggacgcgcccaatactcccggttggaacacgatgacgctgccggcggatggggagccgtccaccgtgtagccggccgacgccgcggaacctgcccatgtggcggcgttgccccaccctggtatcggttttcctatgtcggctcttctggtcgcggcccaccaggtgcactgcccccatgggtatctcgtgtccggcgtgatgccggccgtggacacgatgccgccggagaccgtcagtttcggttcgagggagccgaccgtgccaccctcggcggtccccgttgcggtgtatttggtcgctgcgagttccttgatccgccgcacatagttgatggtttcctcgaagggcggcaccatgccgtatctgagcacgctgccgaggccggcgttgtacgccgcgagggtcagctccaacgtgtcgccggtcagtttctcggacttcttggccgtctcgacctgcgaggcgagaccgcacatgtagttgccctggctccagatcgcgtcgtgcgggttccagatgtcggccttgccgtcgccgtcgccgtccttgcccgcggacgcccatgtggacggcatgaactgtgcgatgccctgcgctccggcggagctgccggccttcggattccaattggactcctggtcgatctgggcggcgatgatgctcggcgtgacgacctggcagatggatccggcgcggatcacgtcggcctcgtattccgcgggcacgcccgagaccgtggattcgctggcgctggatcccaggaacgcgcccatgacggccaggagcacgccgagcaccgcgagcatggccgcgatgacgggcaggatgggaaggctgatggaggcggctcccgcgatgacgcgggacgcggccatgcgcacgaagttcgcggcggcgcgggcggcgcgcatggcggcctgtccggtggctttcacgctgcgtaccgccttgacgggcgcgcggcggtgccgccagatgaatttggccgacgagttgacacctttcacgcctgtgcgtgccgctttgaaggtcaggtcgcgtgtggtgcttcccagcttggacgcgaagtcgtcgtcagccacggtgagcctcgcgccggcttcgtccatccagcccatgccggtggttcccattcgtttgacgctacggccggctttcccaaggcccgcgcctatgtgcttgccgatccgcttgctcgctttgcctttcgcggcgaacttgccgatcttctcgctgggcttcgcctcggacagcgccttgggtttgccggccgtcttgcgcattcccctgcccgaccgcagggcgcgtttgccgcggttcatgatgcgccgcgccttgccggccgtccagcccacgccgtgcatggtggaggacatgccgtgcatgcctgtgcgtcccgccatctcggcggcggtgtggcccatggagtcggcgatgtcggtccggtccgagccgaattgcgcggcgctggacaccacgccggtggccgcgcgtccgatgcgggcgcgtgtgcctccggcgtggtgggcttgggttccgctcatgcgtttactttccttcctggaaggtcgtggagtacagccggtagaggtcgccgcccgcggggatgcgcccgtcgaacggcacgtaggcgctgccgatcttcatgagtccctggccgggcagcacgccggtgaagtactggcgctgctcctcgctcagggtcagcagttcgcacaacgcgtccgcgtcggtgctgttctggctcaggagcatgaggaagtccgagttggacagcatctcgcgcgcgtcctggaggtcgaggatctcctcgacgttctgcgtgatgccggtgacgccgagcccgtatttgcgggcgcgcttgtagatgtccttgaactgggcggcggcgtactggttggagaagaagcggtggaactcgtcgacgtacagccaggtgcgccgcccgttggccttgttgcggatgacgcggttccacacctggtcgatgacgaccatcatgccgaacgtgcgcagctcgccggacaggccggacacgtcgaacacggtgaaccggttggacaggtccacgttggtctgcccgttgaagccgctcatggagccggtgatgtacgggttgagcgcgtcggcgaggtaccggctcacctggtcgccgcccgcctgcaattcgtcgtgcaggtcctgcaatgtgggctggaccactcccccgccctggttgcggtaacgcgtgtacaggttgctgacgcactggtcgacgagtcccttctggagcgggtcgaggccgtcgatgccgccgatgagcgcgccgatcatggagaccacgttgttggtcttgtccttgacggggtcggaggccgagtcgtcctccaggacgatgtccatcgggttgacgcgcgtgccggtgccggcgctgatctggatgatctgtccgccgaacgcggccgcgagggcgaggtattcgcgttccgggtcgatgacgatgacctcgtcgtcacggttgaggaacatgccggcgatctcctgtttgacggtgaaggatttgccgccgccggacgtgccgagcacgaatccgttggagttcatgtggctgcgccggtccgcgaggatcgggttgccgctcctcgcgttgcttccgtagaacaggccgtgcggctcgaacacctcctgcgtggtgaacgggatgaggatggccgcgctgttcgtggtcagggtccgcttcatgggcagggggttgttgcccagcggcagttcggccgtcagtccctccatctgcatgaacttgaggctctcggccgtgcaggactgcgcgttgaccttggccttcacgttcctgcacgcgacttccagctcctcctggcttgccgcggacacgccgatcacgatgatcgagtccacgagcctctggttggtggagcgcagctcgtcgcgcagctggccgagctgttcctgctggtcggcgaggtcgtcgggaaggtcgtcggggtcgaggccctgcttgcggttcttgcgccgctggtccatgacctgcatcttgacctcggcgttcttgcggcgcacgagcgtcatgctttcgccgcggtccatgggcgccaggtggatgctcacgtcgacgcgggcgcgcaggccggtcaggtcgttgaccagctggtcggacagttccggcggcagactggacacccacatggtgcggtgcaggtatttcgagtccagggattcgatgtcgagcatggtcgggttgcgcgcgtcgatgctccacgggcacacgaggtccttggtgtcgggcttgccgggctgatgctcgaaacggcgttcgtcgaaccggaactcctcgccgggccggagcacctcggccatgaggcgcagccggtgctcgcggtcgagccgggtggccttgcatgcgtcgatggagcgcatctggctgacgaggttgttgcacagggcgttcaaggtcgcgacggcggcctgctcgtcgctttcgcggacggtgacggtcagggtcttgacggtgctggtgttgcggctgacggattcgagtttgccttgggcgaggcggttgtagtcgagccggtagtggtcgaggctgtcgccggtctcgtccatcatcacgtcggcgaggatttcgcgtacgccgcgtgagcgcgtgtaggaggcgatctgcacgctttgcccggcctcgaagctgttgatgagcttggcccaccggtcgatgatctccatctgatgggattccgggctcagctggtagttgatgtcctggaagaggatggtggcgctccaccgtccgtcgcccaggctggcgatcccgctgcgcagcatcgcgtcgtatccgatgagctgtttgacgcctttcggcagacgcgtcgccttctttctccgtgccttcgtcctggcttcggcatcgtcttcgtccggcgcgacctggggtttcttctttccgaacattcctcacctttccttgatcgttggtttcgcgccggtgcggtatggtcttcccggaccgtcgagcaggtagacctcgcgctgcgtgtagtggcgcaggatgtatttcaggtatttctcgggcatgaggccctttggcctcacccatccccatacggctatgggcaggccgggcgggaagatcaggtacatggcgaggttggggtccatgcccagcccgagccacagtccgacgtatcctcccccgcacacgatggcgaggatgacggcggcgaggcactgcctccagctcattcccatgaacaccttcgattcgatggtggtcagttccctgtagacgggcatctgcaacgccatgattgcttcctttcgtggattgcgttgtgtttcattcgccgccgaagagcttcttggcgacggagttggccgccatgacgatgccgatgagcatgacgctcgccaggagcaggccggtgaagttgtccatcacccagccggagaggctgtcgccgtccttgaacttgctcgggttgagcgtgccgcccacgagcgtgcggtacatgaggatcgccagatacagggtcgcgcattggaacaccagagacgcgtactgtttgaagtagttgatgccccactggcgggtctcctcctgggcgatgaaagcgatcggcagcgggttgaacgcggtgagcatgtatatctgcacgaagcgcaggaggatgacgacggtgacgacgatggtcgcgcccttggagacgaggaacgggatgagcagcaggatcaggcacggtatctggcccatccagccggcggagtctatggcgtcgcgcatgctgtcgccaaggccgaggcccgacgacgcgccggtggtgggtgccgccgaatggatgccgccgagcacgctgtcgccgatctcgtcgatggcctggagcatgagctcgctgtgctgggccgcggtgaacacgagcgtgagcttgaacatcgccatggcgacgagcttgacgcccagctctcggtcgccgtccgcccgggtgctgaccctggcgagttccaggacgcacatgatcgccagtatcgtgctggctatgggtttgaccgccgagcgggcgacggtcaggctcagctggtacatgcccgcgttgtattcggcgggggtcttcagcaggtcggccacgaggtcgtcgccgacgccggaccctatcgagttgaggataccgacgatgaaatcgaccatgcgtggcctcccgtctacagggcgatgttggagaacagggccgcggccgcgatgatcaggccgccgccgacgacctgccagacgcccgactgggtggcggggccgttctggtccttcagtcctccggccagggtgatgacgccccacacggcccacaggccgccgccgatgatggcgaactggctgaagagctgcaacgcgctggtgacgacgctgccgctgtctgccgcgatggtgattccgtacatgatgttttcctttcgatgttttggatgacatgaccacggtatggccgtcgagaaggctccggtttggacgttcccgacgaacccgaagaggctcggacgatggtatggaaaagggcccgccgaccgttcgccggtggggccgggtcccgccgccgcgcgccgggtttcgagtgccatggttcccgtccggcgttccgcgggccgcggaacatggaaacggacggcatcatgcgaaaggaagacggaccgatccgccacaaggagattttcaaggagtcggacggtccggtgcgcaagggaaaggggtggccggccggatccgacctcattggatccggcctgccaccccgttctggtttccatggtgcgcgggaaggggttcccgcggcgtgcccccgccgggagtcgaacccggcgccgtcacaaaggagaaaacaaagacggtaccggtgggggcttgggcgcgtccgggaaggaaaggatctgggcgcgcccgtgggccgtgcggcggatcatggggaacggtccgccgcacgggcccggggtcaggttcgtcggatcactcctccgagccctcggtgtcggccggggccttcgccttgcggcggcgggagacggccatgagggccgcgcctccgccgagcacgacgaccgcggccagcgcgatcagcgcgatgcccgcgccggtctgggcgagggtcctgcggtagccgttccagtcgtcggtggcggactccaccttggtgtccgagcagtagtccttgccgtcgatggtcacgacgtcatcggacttgctctcggtctcggcctcgggcttggagccggattcgtcgtccgaggtgccgtcaccgaacggggccgacgtgtcgaccggacattcggtcaacggggtgccggtgaccttggctcggtcggtgtgggtcttggtgacgcccttgagcgtgccggtgacctcgacgctttcgccgggcttgagcaccttggtgtcccagtcggccgggtacttgaggtccacgacctcgccgtcgccgacgatggtggagtcctcgagcttgatgtccttggtgcggaacaccgcgccctgcttcgtgtcggggtcggtcttgctcgtgttcgtgatggtgaacacgatctccgtgtcgccggagacggtcaaagcgtccttcgaattgtcgcggtcgccgttcggccagccggacttgcggtcccacttctggacgtcgatgctcggggtcatgtccggggtgcgggtccacacgacgttggattcgagagtcttgtcgttgtagtgctccgtgaactgattctcgtggcggtcggtcacggcgaggcgcttgcactggatgtaggcgcgccagccgacctcatgggagtcgtcggacacgagggccctgtagcggtcggtcgcttcgatggtgacgacgttgcggccgtcgacggtggccgcggagagggtgaagaggtcgccgccgagcttcgagctgtcgaaaccggagccggcgatcctgtcgcccttggacgcgagggcctcgccgcctgaaagcaggtcgcgggtcgcgtacacggcccattggccggtgtattcgtcgaaggccggatcgagggagtcgacgatgtcccacttgtcgacctgcgggtaggcgcggttggccggcaggatggagctgtcgagctggtagaggaagctgcggcccttgtagatgctcttgccgttggcggatgcgccgccgaccttcacggtgacgtccttggccgggttgatgggcttcagggggttcgtgacctcgttggtgtccttgcggatcttgttgagcacctgcgtggccttgttcttcacggtgtagccgtcggtgaccttgatgacggtcatcggcatggtcacggtgtacgtgtggccgaggagcgtctggtcgatggcgggctgggtgagcgggtcatgctcgtcggactcgctgtaggtcttgaggtcttccggctgtgggtcgcccttgacggtctcgcccgtcgcggggatctcggtgtcgaccagcttggcgtaggcgtagagcgcgccgtccttgtcctggatgttgaacttgtcggtgacgtccttgccggtctcgtcggtgatctccacgttggtggcgtcgagtttcaggtactcgtcgtcgtagtcgtcggtcatgccgagcctccagaccttgtatgcctggttgtactgcctggcgtcgatgtcgacgcggtagtagatctcgtctcccagcagggcggtcttgccgtcgatgctgatcgtcgggtccttctgcgtgtccttcttgacggggtcgagcttcggcgggatgttgaacacctcgttgctcggggtcagcgagttgttgagggtcagcacccacttgttgccgaccttgtggtcggtgggggcgtcgtcggcgacggttccctcgaagcggacctggaggcgggggctggtgccggcgcgccactggctgatcgtctcctggtcggtgacggtcagggtgaacatgtgcttggaatcatcccacgtggtcgtgtacttcttcttggacaccggcttgccggtgttcaggtccatcatctccagggtctgcttgtccggtttcagataggcgtcgtaggagtcggtgaagctcacggacttgacctcgtaggcgaggtcggccggcagttgcggctgggtgttgagctggtattcgaccttctggccgggctggacgactttgccgtccaagctctcctggtcgccgccctggctcgcctcggacacgacgtccttcttgaccggcgggatgtagccgcagatctgcggttcgttggtcggctcggtgtggttgttgacggtctcggagccgccgttggtcaggttcttgccgttcggggcggtgcagaaggtgagctcgtcacccgcctgcttgccgaagtccttgcggacctgggccgcgcccttgccgtccgcgaagttgatcctgccggggatgaggagcgtgacctgcttcgggttcttcagcttcttcaatcccttgaggtaggatgccttggcggtggcggtggccttggtgccctggacggtgatgtcgaactgggcggtcacgtccttgccggtgttgacgatgtcgctcacgctgctttcgcggtcggtgccggccgtggcctcgtacacgcggatgttcttggtgtcggcgtcgaaaatgtagtcggcggcagtccagtcatcggtgagggtgaactgtttcggcgcctggatcaggttcctgccgatggtgccgttgacgacgctgccgaccttgtctccgtcgaggtaggtgtgggagtcgccgccggtcttgttggtctcctgcgggtcgatgacggcctgccattcgccgtcctgctcgaagatccagctcttgtcggggttgggctgccaggtgtcgaattccttgctgccggcgtcggcctcgggttcctggttccacttgccggtcgcgtggtccttgaccttcctgaagtccttcggcttgctgacggtgatgtcgaagctgaattcgtactggtggtcgaggggcatctcgcccttgtcggcggtgcgcacggccgagacggtgtccgtcttacggtcccaggtgatggtgaactcgccgctcacatcacggtcgttgtcgctcttgtcgacgagccggtagctgtcgacggtgtagtcgacgccgttggccgtgatcctgtccgtcagggtcatctcgtaaccgcccttgccggtgccgtagctgatgacggtacggttggtcatgccgtccgcgctcacgccctcgtcgatggtcttgaccggcggggatggtggttcggcgctcacgttccaggtctcggccggatccttgtcggccgtgtcgacggccgcgttcatcctgccctgcttggcgacctggatatcaatccagtactggccttcctgccagtggctcatgccgaagtcggctggcgtggcgaggttgtcgagccgggtgtcaccgttgttggcgaaggtgatcggcttgctgaccgtcttggctgcgacgtagccgttcttctggccctcgtagtggatgatggccgtgccgttcaggttctccttgatgccgctgccgttgttgctcgcgtgcaggatgtcgccgatcgggtcggtggagccgaccttcaggtcggtcctctgctgatgcgtggtggtgaccgtcagatcgtagttcggcggggcgggctggtatttgtcaagcgcgatgatgacgatgctggccgtactggacacgtaccgttccatgagcttgtccacgctcatggacggatcgtcatcaaacgcggtagaggtcttatagtgacgagatccggcgtagttgtagtcacctggtgcgacgtacttgttccagttgtccaaccatatactcacgtcggcgatgccggatccgttccatacgctggtggtggacccattgccggagaccgcgccgaccgcgacgacgcggcagtcgccgtcgccctcgcccggatggcgctgatggaaaccggcgacgcaccggctgttcgcgtcggccaacgcggcggcggccttgccggacgaatcatccatcgtcacgcccacggccttcatggcccgggccacgctgttcaagtcggtcgaactgccccatgagccgtctgccgcgtccttgtatgcccagaactgcgtcgccgcgccgctgccgccggtgccgggcctattgccaccctcgccaccggcgtatgcggtgcccgaggtcagaccgccggccagggtggccacggccgtcagcagcgccaacgtcttccgtttccgtttgctgttgttggaacccaacgttcctctcctttcagagattctgcacttgactatgtcggggcggggatcgcgatccccgcccgataccattgcaacccggtttcactgactccggtttggacattcgcgcaggagacagaaaagggccgtcccacggatgttcgtgaaacggccctgaaagagaaacggagtcgaccggcttaatgttggattgggatggaacaatcttccaagctacaggcacctggatcgccccatccgccgctgattggacccgaaccgctggaaccaccggccgaaccggacgatgagccagccgatcccgaggatgcgcccgccgaaccggcatttgtgtaggagcggcccgaactcgtgccggtgttcgtataggacggcgtgtacgactggacctgccgttgcgcctgcgcggccgcagcggcggcctgggccgcggcctcctgttcggccttcgcctcctgttcgacctccgcgtccgccttctccttcgccgtcttcgattcgttgaccgccttcacggctttcgcgatggcgtccgcgtcgcgttttttgatggcgtccaacaggctcgcgcgggtcttgtcgtccgccaccttgccgtcggtctccttgtacagcgcgttcgcgtcgtccacggtcttgtcaagtttggacgtttcgaccgctttcaccagcctgttcagggacttcccatgcgtccagtaccatgccgtgttcgcggtgatggccttcgtggccgtgaccacggcgtcccttgaatccgctttgcaggacacggtcttcggcgtggatgccttcatggccttgcccagcgcgtccagggtcttcgcgtccttcacgcttttcatgtccgtcttcacgacgcttgcggcccggccgttcaacagcgcgttgtacgcggtcgtcgcgacgtggagacgttcgctctcggccgcgcagtccgccttggcttcggccatgagacgatccgtgtgggtcttccacacgatgccacccgccgcgagcagcgcaatgacggcgacggcgataatggcgacggcccgtccgcgatgcggtttcttcgtcttctcttccataggctcggacgaaagttcgacggtctcctctttctctgtcatttgtcctccttgtttcttagcttcacagcttatcgaatcggcggagccatccgcatcaaggatcatgatgcggtccatcattcccctccattcaagcccaggtacgtttcgagggcagaatcgaccacctcctggatgcgcatgtcgtgctcggcggcgaaggtcttgagcctgcgtcgggtagaggcgcgcaggctcacgctggtcttcacccactcctccccggattccggtttttcgttttgccggtttttcggtattccagtctgcaccgttttcggtttttcggtatttaccggttccggtcttccggtatccgccggttccgtccggtcgctgttgagcagcatggtcagatcgcgcggtcggggcgtcaggttcatgttcctcacaggtcctcctccttgtccttgagctgtcgcatggtctgcttgagttcgccggccaagtcgcggtactcgtgcagtcgcgagccgcgcggtcgggtggatttcgcgttgaggatgtcctgacgcttcggaatcagcgtctcgaagcacgcgatgtccgaaccgtcgatccacgccagcgcgtcgcgcagggcggtcgtgttggcctcggtgcggcacaggaggatcgctgcggggacgccgcgccggtcgcacagatccttcacgccggcggcctggtcaaggtcgatgcggctggggctcgaggggatgaccacgaggtccgcgttgttcaccgattcgtccaacgcgcggccgtacggggcggagtcgatcagcacccagtcgacgggatcgtcgagccggtcgttgatcccgtgcaggtgcgtgatgtcggccggcgcggcggacatcacgtcgaacggcagcgggtcgtccagctcggcggccctgtaccaccagtccttcgcgtcgccctgcacgtccgcgtcggcgacgagcacatgctgctcgccccgggactggtccacgagggcgcaggccaggaacacggccgatgtggtcttcatgctgccgcccttgccggtcgccaacgcgatcaccatcggctcgcggttcttcttgtcgttcatcgttctccttatttcggtatgtcggtatccggtttttcggtattccggttagttggtttttcggtatttcggtttatgccgcgtcccacgcggatcgcgacgggaagcggtcagaagaggctgccctggaccaggcccttcggcacgggttcggtcggaaggaacagcggatcgtcggtcgcgtattcgcggcgcgagcgttggcggcgtttagcccgtcgccagtagtcgcggccatcacggcgcatgcgttcggcccagtccggatgttcggccagccagtcacggacccgactccgtgggatccggtgcaggccgccgtcggcgatgtggaggtcgcgggcgatcagtcgggagaggatccaacggctcgcatagtcgagcccgccgtacacggccttgtccttccaaccgttgacgagagcgcggctgatgcagtcgaggcgcatggggcacgcggcacacagcacgcgacccttgccgcgcatccgttcgtcgaccaggtcccggccatcgtcgtcggtcgtcgtgttccacatgcgatccgccatggccgggtcggccgcggcgatcctcgcgcaggccggcatcatgtcccgcccgttcatggccgccgtccttgcgtcatcggcgtcttgcgggcatggaggcgtcctatggcggtttcgccgggattgcgggcggcccatgcccgggcgtattggatcagcagaccgacggccttgggatggccgaggcgcttgttgcgccagtagacggcatgcagctgccagatcaggtccgcgtgcccgtcgagctgcgggttggcgaggaggaattcgttgaaacccgcctcggaacagtcgatgcgcgtgatcatgccgtcgcctcccctccggccgtcgcgtcctggccgtccaattcggccagcgtctccacggcccagtcgggcagccatggcgcagcatccggctccgacacggccgccggaaccgtctgcgcgtgtgcgtcgccgtctgtgcggccggctgcgaggatcatgtcgtcgttgagttcgtcccagtgtctggcgagggcccggccggtgcggatgcgtttgggccaccaatcgccgttcatggcaaagccgatcgcgtcgaccatcacgagggtgggccattgcgctccctggtcgacgagcctgcggtacaggccgatgatggccttgcggtcggctttggtcggtgaggacgtggccaggccgagcatcgagcgctgcgcaccgagcgaggcgaggacccgtccggccgcttcggcgatctcggtgtcgtcctcgtcgagttgttcgtttttattcttttcggcggcggccgccccgcttgcggggagatgccccgtaggggcagaggggaaggagggtttactcggagggtttacctggagggttttatccttatatagcagccctgcggcatttgcagtgctggaggtgcagctctcgcagtgctggaggtgcgagatttgcagtgccggttccggccctttttccagccctgcgagatttgcagtgctgggaatcggcttggttccaacgttttccggcagcacgtcctcggattcgccgttttccatgatggtggaggcggcgggatccacggtattgcccatggtcttcgggtcgtgttccgccgtgtgcgtctccttgatccattcgagggtcgacgggtcggattcgaccgcgaggtcccacacgatctggcagtactggggcagacggttcctgccgcccttgccgaggcgcgcgtaccgttggtcgccgcggcggatgaagccgcgttcctggagcgtcttcaacgcggtgcgcacggtccgttccgagagttcggtgacgttgacgatggtcgcgatcttcggataggctgcggtgccgtcgtcgtccgcgcggtccgcgaggtagacgagcacggccttcgcgctggcgttgcccacatggcatttgaaggcccatgacagtgcgatgttgctcacggccgctcctcctcacgctgctgggcggcacggcgttcgtcggccaatctggcggccatctcgtcgccgagacgagccgccctacacagggccagcgtcatcagccatgagaacgcgacgaacacgatcaatacgattgcaagccagttcacgcgagtctcccttccatggacgggtgcgccatcatcgacgccaggcgacgggaatcgacggagcccggaccgttgtggcgggcgaatgccgccacgaccgggaacgtccaaaccggcgcctggaaatcccggttacactcgggaaacacagagcaagacatgcggaatgctttagtaaagtcgttcatgtgtgatcactactccaagacaatgcattgggcggccacggaccgggatccggcaagatacaggatccgcggccgctcggaatattggttgcaccgcccgtccccgacgctccaacatcgggaacgggcgtttttctttcagttgcagagaaagagagaaaatcgaatgaaatcagaccatcgcaccacctccctcgccgtcgacgggccacgcgccgccgcaacggatggcgaggcaaaggcaatcaagagcctgctcgtcagggacatcaaaggcttcgatcaaagcgttccagcagtcgtcagacacgatgatggaacgatcaggcctacgtacataggcgtatggggacaggaccgtctgataggcgcggccctcatccagccagccctttacgtagccgagacgctcatataccgcaccgggacgagcggggtccatgccgcacagatacgagaagctttcgccgagcatgcagccctcatcgaagggatcgcggtcgtcaggaagcatcggcgtgaaggcatcggattgcagatcaaggcgttctgcgactcctgggcggcagaccacggcgctgagctgatactcagcatccccaccaacgagggcgcgcgcctgctcaacaagaaagccggatacacggtcgtaccgcccgatggatatctcaccatcaaggtatttgacgctcagggacagcctcttcacattccctacgccgaccagcggacccagaacagaggcactagcatgtgggcgtacaagctcgtagggcaacgcacacagcacttcgagatcggcgttctcaccgcctcctgaagttccgaagaccataccgtcgatgaatgttcccgacgggtcgcgggagaagatgagtcttccggcttcgtctctcgtctcgtcaaaggtgcggtcgaggaacatatcggccatctcggccttcacgttgaaggacttgccgccaccggacgtgccgagcacgaacccattggagttcatgtggctgcgccggtccgcaaggagcggattgccgcactgttcgtcgctcatgacgccctcccctcggtcagcagcaggttcgccaccacccgttcgcgggcggagagctgtgcatcgacctcccggaaggcatgcgtgtaggcatgcgtggggcggagccaggtgtcggccagtccgcgggtctcgccgcggcgcagggcgcgcacggcgcaggccgggcagagctccaagatctccgtgtcgcccgggacgcagtagttgcgccagccgttacgggcgaaataagcgtcgcgggcggccgaatcgtagtcatcccagaacgtgccccagaccaccgtgtggcagccatcgcacaccgtgacgcaatcccaccggctgtccggccattcggactgttcgtagattccaccagccatcacgcaacctcctcacaatcggcatcaagccccagcaaatagtcggtagacacatggaagtgctcggacaacacaacgatgtctgaagttgtccaaccaatgcgtcccaagagttttccattcgccgaggttttcgatagaccaagcaatgaaccgagttgggcacaagtaagtccctcaccctttaccagagcacttatcctttgggtcactccattcatagttctttctttctgacttggttcatttttactgtactttactatagcgtacagtttgactgaacgcaaatcgtatgagacacttaattaagaaattctgaactatttttgggaagtgatcatatgtccacatcggaagtctcgccagaaacacctttggataaaggacagcgtgctgaagcggcgatcccgaccaacgtgagagtttatctaggactaagcggaaaaacacaaaaggcacttggagaagcgttgggcattaccaagagtgctatgtccatgaaaatgtgtggcaaagttggatggtcagtaagtgatcttgtaacgacctccgattttctaggtgtcacgccgagcgccctaatggatgacacaattctcagcaaagccgaggccggatatgcaaaatcggccgagtatggagtttttgccgagaagccaggtgctttggtaggtgccggctcccccaggttccttgtcagtcccttcaaccccgacgccccggtcgagggtggaatctcaggtgcagctaaaggtgccctggccggtttcgtgccattcggggtcccgtccggctcgggttccccgtccagcccctcgaagcatgacgcgattggggtttccggccggtctcaagcccatgagacacttgggaccatgactaccatcatcatgcgcaccactgagggcagcatcaccatcaacctgttcgacgacaaggctccgaacaccgtggccaacttcctgggcctcgccaccggcgagaaggaatgggcggacccgtacaccggccagccttcccacggcaagttctacaacggcctgaccttccaccgtatcatcaagcagttcatgattcagggcggttgcccgctgggcaccggtaccggcggccctggctacgagttcgacgatgagatcgacccgagcctgaagttcgacaagccgtacctgttggctatggccaacgccggtctgcgtcgcggcatggacggtaaggtccatggcaccaacggctcccagttcttcatcaccaccgtgccgaccccgtggctggacggtcaccacaccatcttcggtgaggtcgccgatgacgactccaagaaggtcgtcgataagctcgaaacactggacaccgatccaatggatcgcccgctcgagccggccgtgattctctctgtggacgtggcggagtaagaccgacaacatatacggcaaaggtcctgattggtattccagtcaggaccttttcgtgttcttggctcccctctctgaggggagccagagtaaggcaacggcctacttcatcttgcgcagtcgaggttcggcggattccttggcaccagtgatgcggtacacgtcgaacacgccatcaatcttgcgcacggctgccagcaacgagttgagatgctgcggatcggccatttcgaagctgaactggctggtggccacgcgatcggaaccggtggcgatcgtaccggaaatgatgttcacgccatggtcggaaagcacacgtgtcacgtccgaaagcaggtttcgtcgatccagcgcctcgacctgaatcttgaccatgaacaggcccttggtgctggtccattcgacttcgaccacacgctcaggctgcttgtttttcagatcgatcatgttctggcagtcggtgcggtgcacggatacgccctgattacgggtgatgaagccgatgatattgtcaccgggcaccggcatgcaacaacgggccagcttgatccacacatcgcccacgcccttgacggacacgccggtggagctgctggaaaccttgcgttccacgggcttcagcggcaggacttcctgctcgacttcctcatcgacctcgtcggcacccgcatccttgaccagatgcgagatgacgttctgcgtggagacctgtccgtcaccaatggcggcgaacacggcgtccgcgttcgggaagttaagatcgtcggccacacccaccagtgcctcgggcgtaagcaatgtgttgaccggcagattgcgcttgcgcatcgcgcgggtcagctcgtcgcggccctcctcgatggcttcagtacgacgctccttggagaaccactgacgaatcttgttgcgggccttcgggctcttgacgaagctcagccaatcgcgtgacgggccggctgtatcggatttggacgtcagaatttcgacggtatcgccattatcgagcgtggtgtcgagcggcaccaaacgaccgttgacgcgcgcgcccatcgtacggtggcccacttcggtgtgcacggcgtacgcgaagtcgaccggcgtggcgtgagcgggcagggatacgattttgcctttcggcgtgaacacgtagacttcggacgagccaaggtcttccttgagcgagcccaagaattcgttggaatcaggggtttcgctggtccagtcggcgagctgctgaatccatttgaggttatcgacctcggaaagctcctgattgttttcatcacgctttcgatcggacttgtccggcgagctcagggcgcggccggcctggccgttttccttgtatttccagtgcgcggcgatgccgaattcggcgcggcggtgcatgtcccaagtgcgaatctggatttcgaccggcttgccaccggggcccaccaccgtggtgtgcagcgactggtacatgttgagcttcggcatggcgatgtagtccttgaatcggccgggaaccgggttccaccgcgcatgcacggcaccaagcgccgcatagcagtcctgaatggtgtcgacgatgatgcgcacaccgaccaaatcgtagatgttcgcgaaatcatggccgcgcacgatcatcttctggtagatggagaagtaatccttcgggcgtccggtgacgtatgccttgatgttctgctcgtcgagatcctcgttgatctccgccagaatctgcttcaggtacacatcgcgctggccggctcggcgagccaccagcaccacgatctcgttgtagatcttcgggtagagcaccttgaagctcagttcctcgagctccgtcttgatggcgttcataccgagtcggttggccaaaggtgcgtacacgtcaagggtttcacgcgccttcttctgggcggacgtggtcttcacatagcgccaggtgcgagcgttgtgtacgcggtcggcgagcttgaccaccaaggtacgcacgtcgcggctcatggccaccacgagtttgcgaatggtttcggcttgggcggaatcacccacttcaagctgactcagcttggtaacgccatcgaccagaccggccacggtgtcgccgaattcggcgcggcattgatccaacgtatagtcggtgtcttccaccgtgtcgtgcaacaggccggctgccaccacgatcgggcccatgcccagatccgcgagaatctgggaaacggccagcgggtggatgatgtacggctcgccagacttgcggcgctgggcggagtgctggatgacagcacgccggtaggcacggtcaagaatggacaaatcctcatcggggtgatgggacttgcacaccttcttgattggatccagcggattgagcggatcggcactgatctcacaacccaacttacgggcggcgtactgctcgccatcaatctctgccatgccagtcacctccctcgtcatgaagttcattgtagccgcgaaccggagccttgtgcattcacctgttcgccatcattggttccacaaccgttgttgccgtcatcaccttagtcattcaaccggcctaatccggtcaggacgccactcccgtcgaaccgaacccgcgttcggcgcgatcggatccgggcagtgtctcggccgggatgaaccgagcctcaacataccgctgaatcaccaattgagcgatgcgatcgcccggatggaagacggcggtgtgcttcggatcgaggttgatcagaggcaccttgatctcgccacggtagccggcatcaacggtgccaggcgcgttgagcacggtgacgccctgcttggcggccagcccggaacgcggatgcaccaacgccacgtagcccgcaggtagggcgatggccacgccggtgggaaccagtgcccgttcaaaaggcttcagcgtcacatcgacggtggtgatgaggtcggcaccggcatcgcccgcgtgggcatagtgcagctgggccggatgttcggggtcgaggctcttgaccaggacctcggtggattcgggctcgttgtaggtctcgtcgaacgccatcaggcggcgcactcctcacacaccggctggccatcctcgtccgtgtaggcgagctggctgcgatgcttgaccaggaagcactgcgagcagatgaactcgtcaccctgcatggggatgacggtcaccgaggaatcctcgttgctcaaatcggcgcccggcagttcgtagtcttcggcgatggcgttctcatcgtcgtcgatgtcgctcgaggcgttctgcgaggacttccccagcgcctgcagcgattcctcgtcctcatccttgttgcggggggaatcataatcctgagccatcatggtcctttcgtcgtctttggttcgtaagtcgatatatatagcacggtcagcgccgtactcgcccataggatacacgatttgaaatactcgtaaagttcgacacgtggggcatacttaaaagaagtaatgtctttgcgacggaaagtggtgcgaatatgccagatgatcggcttgaaaaagcccgtttcgtgcgcgtgagcaagacgggggacctcgtattctcccttggcggcagggaaatggctgtgagcgtggacgacacgctcgaacgggcgattcttgaggccaagcaggtcagaagcgagatgcgacaggctccccagccgcatcagcagtccactttgccgatttcccagatacagtcgctgattcgcgccggtgccgatccggcccgtgtcgcggagaaatatcatctgagcgaaatgctggtacgtcgtttctccatggctgtggagaccgagaaacagtatgccatcgaacagttccttgccgtggcggcacccaaagacagcagggtgcgcaccatcagcgaactggtggaacgcacgctggcctctgcgggaatcggcatggaatcagtgacctggaaatccacccgacgtggacttgagccttggcgcatcgtggcgatattcacttccgcgggccgtgagatccatgccgaatggacgtggaatatgcacgacaattccgtgatgagcctgaacaatgccgctcgaaaactgctcggcgaacagaatccggaatcagccacggattccaaactcaagccgacgattcccgaactgcccggcgactccgtacgctccgcgcgtatcgagcgcgccgtgtctgcttgggcggctcctacgccttcgattccggccgcacggcctgccgcaatccggccctctgtcacttccacaggttccatgcccccagtggatctatccacgtccatctcaccggccacgacccaggctcatggcactacggcccccagtccggtctcttcgcagaccgccggatctgtttcgccatctgccgcaggattacagcaatcgcctgccacggcaccagagcagggctctgacaatgtttcggacaagaccatacggagtggccccaatgcacagctagtagccaccgagcaggagcgggcggccgaatccgccgccaccgaacatgaggcaccagccaaaccggccaagcgtaaatcaggacgttcggccgtaccaagctgggacgagattctgttcggagactgaatttccgaatcaggccatatcgatcaggcagggaatatccatttccaatgctgtttgggagccatgcacgctcggcaggtgggtggccttgtctccttgcgtacgcgaatcgacgagggtcacggctcccgctgcctgcacgaccacatcgccgagcattggccggactcgctcgcagaccggtccaaacaatccgtccgcgatggcctcatccttggtccgcaccaaggctcggtcttgcagacaatcgcgccaccggcaagctatatcctcaggtcgttcatccggctcggcatacagcatcagcgagcgcggctcccccccgaccagtgacacgcctcgggtgagctgcggttcaacggcgatgtcaatccgctggtccatgtcggtttgcaccatgccgtggtcggctacgatgacgatcagcgtgcctttgggtgcgctgcgtttcaggagcgcgagctgggcgtcgatatgttcgaatgcggccacccagtgttcggaatcccacccgtaattgtggccgactttgtcggcgtcacggatgtacaggtaggtcaggccgggggtgcgggaggcgcgtgcggcggccagcacacgatcgcgtggggtgacgttgccttgatagtcggtgcctcgcaatgcggcttcggtcaatggcgatttggagaacttgggcaaccccgagctcgtgacgcgcacctcttgagccgcaagtttctcgaacaccgtctcctcgcgctgcaggtcgagcggatcgaccatgggcggcacaggaatgtgcggattggctggtttgggtgccagcgcgtctttgaactggatgagttggatgagcttatggctggcgggttcgagctgcgtatagcccgccattgcggtcagtcccgggcaggttccggtaccgaatgcggccatggccgccacagtggtgcttggagcgcaggtagcgatgggacgctgattggcgctttcgttcatcagcgaacgcagatagggcgcgtggccgaggcgcatggcgaggttccagtagcccaggccgtccacgagcaccacgatggccgattcggcatcgggcagccccaacgcgcgctggcatgccttgggatcggcgtggaccttggtgggggccggatgtccgatggcggcggacaaggcgggcagcacggcggacaggtgcagtgctcccccacgccgatcggccggggcgtcgtccccatagcccactgtgggcaccagccgcagcaactcgtccatatccggcgtctcaacactcatagttgcccattcaagtagcacccctccccttggctcagtgcgcagagaacggttctcaataacaactgtgcgctccaacgcacataatcaaacaaacgcacatcgactgaaacactggaatcacgccgttttatcggcaaacatgtgcgattggcgcaccgaaaccagcgcacagttgttatcgagaaccgttctctgcgcactgtttcgcgccctcccgctaatatgggggcgttcgaaagggagtttcatggcatcacaccgcaaaccgtccgcgcaaacctatgatccgcgcacggtcaaggagcatatcgtcgagacaccgctgaacgaggagatgagcaagtccttcctcgagtatgcgtattcggtgatttacgcacgcgcactgcccgatgcgcgcgatggcttgaagccggtgcagcgccgcatcgtctaccagatgggcgagatgaacctgactcccgaccgcccatatatgaagtccgcccgcgtggtgggcgaggtgatgggcaagctccacccgcacggtgattccgcgatctacgaggccatggtgcgtttggcacagccgttcgcgatgcgtctgccgctggtagacggccacggcaacttcggctcgctggatgacggccctgcggcctcccgttacaccgaggccaggcttggcccagccgctctcggcatgaacgcggatatcgatgaggacaccgtcgacttcacgccgaactatgacaacaagctcaaggaaccgaccgtgctgccggccgccatcccgaatctgctggtcaacggcggctcgggcatcgccgtgggcatggccacgaacctggccacccacaatctgggcgaggtggtaaacgccgccaagttcctcatggcgcattcggacgccaccctggaacagctgatgcgttacgtgcccggccccgactggcccaccggcggcacgatcatcggccgcgacggcatccgtgaggcctatgccactggccgtggtacgctcaccacgcgcgccgccacgcatatcgagcatgtcacggcccgcaagcaggccatcgtggtcaccgagctgccgtacatggtgggcccggagaaggtaatcgaacgtatttccgacggtgtgaagaaccgcaagctggaggggatttccggcgcgttcgatctgaccgatcgtcataacggcacgcgtatcgtcatcgagatcaagactggtttcgacccgcatgcggttctggtgcagttgttcaagcacacaccgttgcaagacaacttcgccatgaacaacgtggcgttggtggagggccgcccgcacacgatgggtctgaaggagatgcttcaggtgtgggtggaccaccgccgtgtggtgattcgccgccgcagtgaatatcgcaagaagaaggcgctggagcgcctgcacctggtcgagggcctgctgctggccatgttggacatcgacgaggtgattcaggtaatccgcacctcggatgatgcggatgccgcgaagagccgtttgatggtcgttttcgatttggacgaggtccaggctcagtacatcctcgacctgcgtctgcgccgactgaccaagatgaaccgtatcgagcttgaggccgaacgcgatgatctgaagaagcgtatcgaggagctgacccggatcctggcctccgccgaggcgctcgaccaggtggtcaccgacgagatggacgaagcggtcgccaagtggggctcgccgcgccgtaccgtgctgctggatgccgacccggatggcacgttgacgccggtcgtggcgcagggtgccggggcttcgggcgtgtccaagtccgcgctcgaagcggtgaaggccgccactacgatctcctccgccgaagccgatgtggccgcagccgcagctgcggccaagaagaccggcgaacagtccacgctgaccggagccttgaagatcgaggacgagccgtgcgtggtgatgatgagcgctaccggtttgattgcccgtaccacgccaagcgcgatggacgtgttcaatgcacgatccacttccgatgagcgtttgagagacgatcagatcaccacaatcttcgagacttccacgcgcgctacgtatgggctggtcacgtcggccggccgcctggtgctcgcgcatgtggttgatttgcctgccttgcccgctgccgccacattgtcgctgaagggaggagttcaggccgacgaactgatcggcatgaccgaatccaccgatccgattcgcggtgagcgtgtgattacggcgattgccatggagcagccgacgtccggcaagaccagtgccaaggacgagagcgaggatggcggggccgccgaggccaagccgttgccgtcgctggctatcggtacccgtaacggtgtcatcaagcgttggaatcgtgaggcacccaccaccatggattcttggcccgtcattgatctgaaagatggcgacgaagtggtattcgccgccgtggccgaggatgacgaccgtctggtgttcatctcctccgattcctcgctactgacctttgaggcgaagaacgtgcgcccgcagggtcgtactgcgggcggtatggccggcatcaagctggccaagggcgcccgtgtggcggccttcaacgtggttcccgccggcaaggtggcatggacctatgaagagggcgagaacggcttgacttccggatccggtgcagtggtgctcaccgtggccggcgattccgatgcactgcccggcaccgaaaacggcgcggcgaaggtcactccgctggaaatgtaccccaccaagggtcgcgctaccggcggcgtgcgttcccagcgattcctgaagggccagaacacgctgattcttgcctgggtgggcctctacccgttgcacgcctctacatccgcaggctctccggtcgagcttcccaagcccgatatgcgccgagacggttccggagtagacctcgcctcccccatcgccttcattgcgtaacctcaattaagctccctctgatgggccgagccgtaaagcaaacaccccagtggggtgtttgtaggcgaggagcgaacgatagtgagccaaacaatagagaagagaccctaaacccggcctacactaagcattaaggaggcggcgatgagactactggttgccgtatccaatgaaccgttggcccacgccattcgtggtgccctgcttgccggtcgtcatgaggtgtctttggcaagcaccggtagtatcgcgctcgccgctgtcgccaaggagtcatttgacgcagtgattcttgatgaatccctgctcggcatttccaccgagcagctcatcgaatccctacgcaatgcccgtgcctccgtcaagattctgctgctgacttcgacgccactcagcaaaaccattggtgaaggcagccgctggcgagcgctgcctgacgagtacgcccctatcgaagagacgccctacaactccttcagcgcggattcacgcgcaaacaactcagatgccgaagccgaacaacgctcggacaatgccgccgctagcgcacaagctaacgcacgacacccggatgtcgtgctgagcaaaccattctccgatggcgaactgctctcatacgtcggctcgcttgccaccgactcccccgccatgatcattcgtggcaatctcacgttggacaccacgaatcacaaggcctactacgcatccactcacagcgcaatctcactgtcccgtctggaatacagtttgcttgaagcgctggtcaaggctgatggccagttcgtcaacaccagcgagttggtcaaacttatcggcggcccattcttcgagcaacagggcttactcaagaacgccctctacacactggataagaagctcacccgcgccggcctcatcatgacccaacgaggctccaactaccgcattcgatagctgggctcaatcagtacagccgcatgccttggggaacgggggtgaagccggactggtggaggatgcgggcgaaggggtgacgggcgttgaggggttcgccattgatgtcgctgaatgtcacggagccggtgccattgcgtttgagggcgtaggccagttctgtggcggccttgcgcatttgttcgtcggaatcattgacagcggcttcatggccgaccgattgatcgaacgctgtcaggtgcttggctttggcggccgcgtatagtagcgcgccttgcgcattgagcacgaccgtggctccgatacggcgtgccggtttacccgcaccggcaggcgcgtccggccacgcgatggcggagccactgagatttgcggggtcgagcacactcaatgccaccacggactggccgcgatgctctgacggatgacgcaacgcatccacggtgtcgcgctcggcaaattgggccgcgccgaaaccacggacgaacatgcctcgtaccagtcgaccatgctcctccatgcgattcaataccggatacaacgctgagtagccacccgggatattttccttgtcaatcaccggctgcgcgatgacgccatacctgtccagcaacgtctcgaccagtgcgagtgcccgttcggtctggtcggtgtcttcggcttcagcttgcccgattacggcggaccacaaacctcctaacgtcatatccgtagtggctcggcgaatcggagcgacacgcccacgacgacgtgatgtagtggatttacgcgggcttgctgcgcctgcggttaatgcacgcaccggcgcgaagctggaattggtgaccttaccttgccagaccaagctccacaaggcatccttgaactgctgttcgctccactcttgcggaatgatttcgccggtgtttggattgatgtccggctccgcggtctcattccacgcacgtttggcggcatccatcagttgacgggcatggaacgctccccctgagtccagtgcggtcagaatcgcttccggcatggtggcgtctgaggcgttcgatgtcgtaccatgttccacaccgctgaacaatattgaatccgccggatagaaagcaacctcaccggggtccatcgcactggttcccccggtttttgagccgacccagaccacatcgccgctggtcagcaactcatccagcaatgcaggttggtagtctcgtactcgtgcggggaatactgccgactcccagagtgcagtgggcagtgatatgccctccagctgctcgataacgcgcatgagcccgtcagcaccttcatatcgttcgccgccgaccggcccgataccttgtcggtcgataagaaacatctggaacgcctctgattctactggcttgactgctttacgcgccttggccaatgagcgagaccgaatacggcggaatacgtccttatggagccactgttggccttgctcgtcatcatctacaaagtggccttgcagcaactcgcctttggcagccagcacatccagagtgtgcacggcatccgtagcatcgaggtgtagatcggctatgagctgatcggcggtgaaaggaccatgggttttggcgtaacgggtcacgcgaccagtcacatcatcgtcggcaagctcattccagaaagtgtgctcccccagttcctgttcgacttcgcgaatcacgtccgggttgagcacttgtgccatatcggtggcgccgagcaagcgttcgagcacgtgcggatcgagagacagcagttgcgcgctacgctcggcctgaggttggtcatactggtacatcaccacgccgacgaagccaaagagaatgttctcggcgaaaggcgatggcgactcggtttccacgtccttcacggtaatggtgccggcttgcaatccggtcatcacctcgttcagggcgggcatgtcgtatacgtcttgcaaacattcgcgcgcggtttccagcagcagcggaaagttcttggccatacgtgcggattgcaggagctgtgcggcgcgcagtcgctgctgccataggggtacgcgacggcctggatcggaacgaggcatgaacaacgaccgagcggcgcactcacggaatcgagccgcgaataatacggattcgcccacctgacgttctacatccgtttgaagatcctcggaatcgaaaaggaacagatcctgagcgggaatatgcccgtcgccatccggcagctggatgacgataccgtcatcggcggcatatacctgcccgtcgaaaccgtagcgttggcgcagtctgcggctgatggccatggaccacggttcgtgaacgcggcggccgaatggactcagcagtacgatgcgccatccgccgtcttcatcgcgtgtgcgctccacgataagggtttggtcgctggggactgcaccagtggcggcttgttgttcggagagtaggcgggccaagttggtgatggcgttggcatctaggccatcgtggtggagacgggtgaggattgttgggatgaaggttgggacagctggaccttctgcggcagacctcccctcagtccgcttcacgtctaatccggcggcgatttctcgggtgaagcgggctatggtacggctgaaaccgtagtcacggccagcgccttcaccgtgccagaacggcaggcgggcggtgcggcccggagccggagtcacgaccacacgatcacgggtgatgtcctgaatctgccatgtggaggtgccgagcgtaatgacatcgcccacgcgcgattcgtagaccatctcctcatccaactcgccgacgcgacgctggcctttgccggcgtccgcctcaggcaggaccacggtgtacagccctcgatcgggaatcgtaccgccagaggtaacggccactttctgcgaaccgggacgggcggaaatcaggccattatcccgattccataccagtcgcggccggaaggccgagaattcctcgctgttgtattcgccggacatcatgccgattaccgcatcgaacatgtcacgtggcagttcggcaaacggcgcagcacgatgcactgtggcataccagtcatcagcgttcaaatcgtgcatcgcggcagcggccacggtctgctgggcaagaatatcgagcggattgcgcggcacggccaatggttctatatcgccggcaatcatggcttccagacttgcggccccagtgacaatctgctgacgggtgagcgggtagaacaatgcgtgagagacgccaccgacctgatgatcggcacggcctacacgctgcaatccggaggagaccgacaacggcgtatcgacttgaatcaccaagtcgaccgagcccatatcaatgccgagctccaaactggaggtggccaccacgcaacgcaattcaccacgtttaagccgttcctcaatcattttgcgacggtctttggaaaccgacccatgatgagccatggcgatgacatcatcgccctcatgtgagccgacaagcatggtggtggagccgaccacagcatcgtaatgcgtggagaacccttcgcggccttccggagagcccagatcccgcacagtgtcgggattggtgccatgccgggtctgcgcatacagatcgttcaagcgcgcagtgagtttctcagccacaccacgcgaattgacgaacaccaatgtagtgcggtgcgcgagaatctcatccaaaatactgcgttccaccacgggccaaatggaaccggaggtacggtcgcccgccgctccaaccaacgcggaggaatcgaacgcatcactcgcatcagaatcgtccccagaagtggaagaaacatctctatcatccaccggcacaatgcccctgcgttcagcaagtcgctgcatggccggcgtgacaccactgatatgcggagcggaccgttcagcatccacgccaccgacacgctgcttggcattcacggactgcaaatcacgcatgttttccaacggctcaatcatgcgcaaatccattgcaggccgcccaccgggattcacgatggtaaccggttgcccgccgcccaggaatcgcgccgccttttcaggcggattcaccgtagcggatagaccaatgcgctgcatatgacgatcgccacggccagcatcgacggcggcatcaccgccctcatcagcatctgcatcgattgcatctcgcttgcgcgattctgtgacaaggttctccagccgttccagacttaccgccaaatgtgcgccgcgcttggtgcccgccactgcatgaatctcatcgacgatcaccgtatcgacagtgccgagaatccgccctgccttcgaagtgagcaacaaatacaacgattctggcgtggtaacgaggatatccggtggatgggaggctatgcgccgccgctcctgtgcggtggtgtcgcctgaacgagtggcgaccgcgatcttcggcacgggcagcccttgcgcctcgcattgtgcagcaataccctccaaaggctgttctaggttcttggccacatcggccgcgagcgcctttaacggcgagatatacagcacacgcacaccggcatgccgcgtgcgtggcacggtcatcaatcggtcgatggctgagagaaacgcggccaatgttttaccggaaccggtaggggcgatgaccaagacattgcgaccggaatggattgccggccatgcctgagcctgtgcctcggtcggctgaccgaaggcatgctcgaaccacatcttggtgggttcggaaaacaggctcaggctttcgtacatatgtacgattataggtcagctgaagtaggcgatgacttcttcggcggtaccgtaggcactttgggcaccaagcttggtggccgcataggcggagacgtaggagccgatttgcgcggattgcagcagcgtatgaccggcggccaagccagccagcacggtccccatgaacgagtcgccgcaaccggtggtgtccgctgcattgacttgcgcggcggatacgcgatgccaacgtccgttctcgatcaccaccgatcccgacgcaccaagcgtcactatcgcccggtcgaatccgtaatcggtgaatcgttcggcgacctcataccagtcgagtgattccacgtcatcatccggcaggcccagcagttgagccacttcatgctggttgaccagcagaatatccgtggcttccaccagttcgtgaggcagctcgtccataaatggcgagtcgttgagcagcacggtcacgccagcgtcatgcgcggtctgcgcggcggcgataacggtggcaatcgggctctccaaacacagtcccaataccgcgcattcggcgatggtcgtgcgatgtgattgcacatagccggcacttgccttggcattggaacccggcgaatagacgatggtgttctcgccctcagcgctcacggtgattaccgtggtgccgctggggccttcgacatgcaggatatcggcggtgtcgacgccggcctcatccagcttgcttaataggaagtccgcgttggagtcctcgcccaccgcgcccagcaactggacattgacaccgagacgagcggcggcagacgcctgattcgcgcccttgccgcccggcagcactttcatggcaccaccattgacggtttcacctggcttgggtagtcgtttagtggttacggtgtaatcggcgttcatcgagccgaccacgattaccgagcccggcgcatccttcagcgcttccaatcgttcccgtacgggctcgggcatctgttcatgttcttcttcacttatcaccatgggctccaagcatagtaggcgtcgggcccaaatgcgcatatgatcagccgcgcaacttgcgaagacgctcgtgcatggccaccatcagcaccaagagcaccagcaaataccacgggtagagactgattgtcgcatattgcgcgatgatgccgaacagtggcggcatgagcagtgagcccacataggcgcaggccatctgcacgccgacgatggcctgcgatttgtcttcgccgaagtaggccggcgtcgagtggatgacgcacggataaatcggcgcgcacccgaagccgatgaccaccagcccaacgaccacgccaaggtggtgaggcaatggcacgaacatggtgaggatgccggcgaacaccagcacttggccgaggcgaatcatgaccgggtccttgaatcgcatggtcaggaagccggaaagcgcacggcccacggtgatgcctacgtagaataggctggcccagctggcggcggtgatcttgtcgatgccgctgtgcatcaccatatagctggaggcccacaggcccgccgtagattcgacggcgcagtagcagaagaacatcacgaggatttccttggcaccgcgaatggcgagcacgccggccacgccgagcggtttgcgttcagcaacagacaccccttcagcagtgccaaatctctcggcattgccgtcagatgatgcggtgtcatcggtcgattcgccgaccgcaattgcgccacgtttcttccacagcggcaggctcagcaccaggatgacggtcagcatcacctgcaggatcgcgatgtaccgatagccccacggccaaccttggccttgagagagcgcatagcccatgatgtaggggccgaccgatgcgccgacgccccacatgcagtgcagccagctcatatgccggctttcgtagtgaatggctacgtagttattgagcgccgcatccactccgcccgcgccaaggccgtatggtatggcgatggccaacagcacccagtaattcgaggtaacggagaaaccggccaaggccgccgcagtcaacgccaccgaaacggcggtgaccttgcctgccccgaatttcaatgtcattcggtccgaaagcagcgccgagacgatcgtgaacatggaaatcaccgcggagatgccgccggcccacgccaccggcacgttcagatcctggctcatggtgggccatgcggatccgagtagcgaatccggcaatcccagactgataaacgccacatagatgacggcaagcaacagactggccatgtcccatctcccattcacagtacggcaccggttgtgataacgatgtcatcagtctatcgaatagcgcttcagcaacacgcaaacatcacagtttggagtcttgcccgcagtacaccggcgtggaatcggctacgccgcgcgggtcaaagccgatgatgtcgtagttgtccttgagataatcggcggcggtgcactcgatgaaatcctgatgatataccgcagcaccctctgacgaaatagctgtccgccaaagacggactgaggggagagaaatacgagtagcccgctaccacccgaggcctctcccccagtcagcttcgctgacaccccctcatcagagggagcttgagataggacggtcaggtatcgatcttggagcggtcgaaatcgtcggcgttgtcgacgatgaactgcttgcgcggcggcacgtcgtcgcccatcagcaggctgaagatctcggatgcctgggcggcgtcctccatgcggatgcggcgcagcatacgcgtgcgcggatccatggtggtgtccgccaactggtcggcgtccatctcgcccagacccttgtatcgctggatgtcgtcgttgtatccgatgtgcttcttgtcgaggtcggccagtttgccggccagctcgtcatcggaatacgtgtagatatattcgcccttgtgcgagccggtcaacgcgatgcggtgcagcggcggcactgcggcatacacgtagccgtgttcgataagcggccgcatgtaccggtagaacagcgtcagcagcaggatacggatgtgcgcgccatccacatcggcatcggtcatcatgatgatcttgtggtagcgcgactgttcgatgtcgaagctctggccggagccggcgcccaccacctggatgatggccgcgcactccttgttggagagcatctgcgtgatcgacgccttctgcacgttcagaatcttgcctcgaatcggcagcagcgcttggaaaccggcgttgcgggcggccttggcggtaccgagtgcggaatcaccctcgacgatgaacagttcggccacgtcgtcattgcccggctggcagtcggagagtttggccggcatcgaggcggattcgagcgcgttcttgcggcgcgtgacctccttggccttgcgcgactggatgcgtgcgtgcatttcgccgacgatcttctccagcacgcggccggattgttccttgtacccgcgcttggagccggtgatcatctcgccgaattgcttgtcggtgagccgggtgacgatcggcttgacctgcgcggtgccgagcacatccttggtctggccttggaactgaggttcggccacgcgtgcggtgaccacggccacgagtccggcttggatatcgtcgcgctccaccttcatggcggagtccttcatgttcaccttgagcttgcgggcgttgtcttccaccgccttgcgaatctgcttggtgatggcgttcatgaaaccgtccacgtgagtaccgccgccgggcgtctccacgatgttcacgaagctcatgattgtggtgtcatagccgttgacccatcgcagggcgatgtccacgccgcaggtgcgttcgatttcctgggcgtgcagttcgccgccctcacccacggcctgggtctcctccttataggtgccctcgccttggatgcgccagatgtcggagatcggctcgcctttggacaggaagtcgacgaagtccttgacgccgcctgtgtgcaggaattccacgacgcgcgggtgcgcgggctgttcgccgaacgcgccatcgacgacctggtcgccggccgtcagcgagaagtcctcctcggccgggctctcggcatcgctggacgagacatccaaggccggtgcctggtcttgcgcaggttcgactgttgtgtcatcagtggcctcgacggtgtcagtcgccgccgtttccggtacgttttcgtcgatgatggtgattttgaggccgggcaccaggaagctggtctgacgcacgcggtcgatgagctgttcgtatgagaactcggcggttttgttgaagatctccggatcataccagtaacgaatacgggtaccagtggttttgggagataccttgccgatgatttccagctcggtgggtcggttcttgcgagtgcgcttgaacggggaatcgggagacggattggccgggtcggcatccgtgtatacgccagggtgaccttggtggaaggtcatgtggtgcgtcttgccgtcacgatccacttcgacgtccagtcgggagctcagggcattgaccacggaggagcccacgccgtgcaggccaccgacggcgttataagacgagttgccgaacttggcaccggcatgcagtttggtcagcacgacctccacgccggacaggccggttttcggttccttgtccaccgggatgcctcggccattgtccgcgacttccacggaaccatcggtgtgcagggtgaccacaatgtcgttgcagaagccggccaaggcctcgtccacggagttgtcgatgatctcccacaggcagtgcataagcccctgcgagtcggtggtgccgatgtacatgcccggacgcttgcgtaccgcatccaagccctcaagaacagctaggtccttggcaccgtattcttctttgggcatacagtcctatttttctcttcaaatgcttggctcccctcacagaggggagccagatgatcattgatccaggaagtcgcgcagggtctgcgaacgggacgggtggcgcagcttggacatggtcttggactcgatctgacggatgcgttcacgggtcacgccatacacacggccgatgtcgtccagcgtcttcggctggccgtcttccaggccatagcgcatcttgatgacgccggcctcacgcggagacagggtttccagcacctgcttgaactgttcctgcaacagggagaaggccacggcgtcggacggagcgatggcgtcggtatcctcaatgaggtcaccgaactcggaatcgccatcctcgccaagcggggtgtgcagggaaatcggctcgcggccgtacttctgcacttcctgcaccttctcaaccggcatatccagctcgcgggccagctcgtccggcgtaggttcacgccccagatcctgcagcatctggcgctgtacacgggacagcttgttaatcacttcgaccatgtgcacaggcacgcgaatggtgcgggcctgatcggccatggcacgggtgatggcctgacgaatccaccacgtggcgtaggtggagaacttgaagcccttcttccagtcgaacttctcgacggcacgaatcagaccaaggttgccttcctggatcaaatcaaggaagagcatgccgcgacccgtgtagcgcttggcgagcgagaccacaagtcgtaggttggcttccagcagatggtccttagccttcttgccgtcggcggcggcccacttgagttcacgcttgcgcttgaactccatgccttcgctttcggtgtcgagcaggtgctgggcgtacaggccggcctcgatgcgctcggacaggtcgacttcctgctcggcattcagcaggctcacacggccgatctgcttcaggtagtccttgaccgggtcggcggttgcgccggccgcaatcacacgacgcttcggattgcccgaggggatgatgttctcttcctcatcatccgtgtcggagaccacgtaggcacccttttccttgggctgctcgggtgccttggacttggcttcttcctcgtcctcgtcgtcttccacatcatcgtcgtcggcatcgtcctcatcgaggtcttcgtcgtcggcatcgtcttcgtcaacgtcgtcaagatcctcgtcgaggtcgtcaacgtccaaatcgtcgtcgttgacctcggcatcgtcatcaagctcgtcatcgacctgagtgtcctcgtctttgacgagctcatcgtccttggccttcttcgcggttttcttcgcagcggacttgcgcgtggtctttttcgagggctctgcggacttggacttcttggcggaagtcttgcgtgcggtggtcgtagagctggccttcttcttggtctcggtctcctcgctggactcggctgtctgcttggttgccgtcgtttccttcgtggccaaaactgctcctcctgatctctcgccgtgaagtgcatataccacatgggcccacttctggcaagggcaaatcgtcaactatgtgagtaaaccaccctccacggacgattattcccacatcgttgcccgacgtgttgccgatcaccacacgctttccttccgcgcatcgcgcgtaaaacctcggaaatccgccgtttctgttcactcagcccgagcaccatgccggtgccacgcctcgatcggcggctgagaatatcatcgccgccagcgaacaatcctcatcgagcagcaggcatcgcaaggcgaacaccattgctcgcggatcgcccagccaccataaggtgtaggcgattacggccaatggctgtatgcagtacggcaccggtgaggcttcggcgatatcgagcaacataccgatgccggcatggcaacgctccttatccggcatcatgccttcatcctcgaatgcgcaagtcagcagctcgcccattcgtgttctcgtacgcgccagatgcggtcgcgccgcgaattccataagccatgacttggggcaacggctttcatcaataaccaacgagagaatcagcgcatcacgaatcgataaggtctcacgcatgcccaccgcaaacgcggccatcgtctctcggcctaggtcggtgttcccggcatcaagacaagacagccattcgtccaatggttcggccacccagtcggcattagcctgttgcgcgcctcgaagtcgtcgatcattgcgaaattcctgtgatctcgtctccaactcgtcaaagccaaagggctccgtctgctcggcggcgtgccgtttggcgtgtcggctcttacgcggcttgtgcggcgtgttgttgttcatcatgtcctccttgactaatggtgtgcaatctattggtgttgtggtgcgcgccgagccggatagctcatgcgccgagggggtgtgtgcccactatggctgaaaacgccgtatgacgcaggaaaaaacgaccattgtggttctagcttcaaaacccttgattcccaacgttcttgtgttcttcaaaccctgtggataagttattaggcatgtgcacaactgctaacaaccgcgaaatcatcgagccacgcatcattcagttggtgcgggaactgactgccgcccccgccaccgacgaggttgccgacgccctgaaaccggtgatggaacaggttgtggaccaagccgcctcctccagccaaggaggcaaacgactgcgtgcgctgctcgcgttggacgccttcgatattcttgccggcgacgtgacgcctgatcggcgtgacgccatgatcgacctggcctgcgccattgaagtgtttcagacggccgcactggtgcatgacgacatcatcgacgaatccgatctgcgccggggcaggccttccgcacatcgtgccttggaacaggccgtacacagcggtgccataggccgtggcttgggcctgatgctcggcgacattctggccaccgcctgcattgaaatcacacgccggtccgccagccgtcttcccaacaccgatgccctgaacgaggcgtttcttaccatgcaacgcgaggtggaaatcggccaggtactggacttggccgtcgagatgaccccactgtccaatcccgaagctctggcgaacgcctcattgaacgtattccgctggaagacagccagttacaccaccatcgctccactgctgcttgcactgctggccgcaggagagagcccggatcaggccaggcattgcgcgttggccgtcggccggccgctcggactggcgttccaactggcggatgacctgttggatgtcgtcggatcaagccgcaataccggaaaaccagttggcggagacatccgagaaggcaaacgcacagtgctgttggctgatgctctgtctgcggcagatacggcggataaggccgatctgattgccatcttcgaagaagattgtcgcaatgacaaccaggtggcccgcaccattgaactgttcacgtcgaccggtgctcttgatcgatcccgcgagcgcatcgctgccctatggggtgagtcccgtaaggcgattgccggtcttgagctgaattccgaagcgcaacgccgtctgaccgaggcttgtgcgcgattcgtccccgaatccttgcgatagtccacaatgcgagccgccggaccatgagaccatgaacaccggtgaaaacccgtgaaagctatgcgctgatgctccggccgcgtaaccggggccatgtacactgaacatgtttagtcgtgattaaaggaaccgtacgatacaacatgagtgagaacgagcccgcacagatgattgagggacgctaccgcatcgtgcgcaatatcgccgagggtggtatggccaccgtgtatgaggccatcgatgagcgtctggggcgcaccgtggcgattaaggtcatgcacacacaactcgccaaaggcccgcatcgggagcagttcgtcgaacggttccgccgcgaggccaattcggccgcgtccatcgccaacccgcacatcgttcaggtgtatgacaccggcgagttcaatggacttgattttctggtcatggaatatgtgcatggcgtcaatctgcggcatgagatgaacgcccaaggcacattctccgtacgtgagacgctgcgcgtggtcgcggagacgctggatggtctggcttccgcacatcgcgccggcgtggttcaccgtgacatcaagcccgagaacattttgatcaatgatcgcggccatgtgcagatcactgatttcggtctggccaaggccgccagccaggccacattgagctccaccggcatgctattgggcaccgccgcttatctggctcccgaaatgatcgagaacaatcaggccaccgcgcaaggcgacctgtattcggtgggcatcatggcatgggagatgctgaccggcaaggtgccgttcgattcggataatccggtgacgcttgttttcaagcatgttcatgaggacgtgccgtccgtggccacggtctgtcagggcattgatccgtccgtggcggcgttcatcgcccatctgaccgcgcgtcaggtggatgcccgccccaccgatggcgcggcagcagctgaggaattgagccagttggccgccaaattgccgctggaggcgtggcaataccgtttgcatgccgaacccatcggaggtgatcataccgatgccaccgctgcagcgctggtaggcaatatcgccgagcaggccccgctgaccggcgtacctgccggtgcagcaacgttcaagccgtccgtaccagcgtttttggccgatgatgtcgcaagcaataccgtcgataccggtggcgccgcagacgtcaatcctccggctcctccggtcgcccccaccacggcacttgattcgtcgacgccagccgatgcttcggctccccataagacgcaaatcatggcacagtccggcagcgagacacaagtgctgcctcaggccggcgatgccttcacccgagcgcttgccttttccgatgagccggacgtcgcttccaacggcaccgggccaaagaagcagcgcagcaaaaaaccgctcatcatcgtactggtgatcgtgctggtactggctgcaatcggcggaaccgccggctggtggtggtttgccggaccgggcagctattggagtgtgcccaagccggatgacgtgacctgcgatgcgaatgcaagcaccgaatgctcgttggccggcgcggattgggccacgtatgagagcacgttgaaggctctcggcatcccctacaagacgcacaaggaatacagcgacgacgtggcggaaggcaagatcatctcttcttccgtgaacaagaccaaggccgttgtgaacagccgcataagcaagcgagccaatcaggagcttacggtggtggtgtccaagggcgtgcggatgaccaccatcccgaaggatattctcgacgcgaattcggccaatggcaaggacccgttgaacgcgctcaagaaggccggcttcgataatgtcaagcacgacgagtcgaaggatgagtattcgatggacacgccgcagggtgtggcattgacgatctcccctgatcccggtaccacggccaagcacaacgatgaggtgacggttactttgagcaagggaccgatgccggtgaccatgcctaacatcgtcggtaagacccaggatgagatgcaagccgcgctcggcgagttgaagctcacggccaatgtcaccgaacagtacgatgacaaggtcgaggccggccaagtcatttccgcgtctcaggaagccggagcccagctgaagtggggcgatagcgtggacgtggtgatttccaagggtccggagatggcgacgataccgtccggccttgtcggcaaacaggaaagcgccgtaaccaagacacttgaaggtctcgggttcgaggtgaaaaccgacaaggtgctcggtggcctgttcggcacggtacgtaccgtgaaaagcggcgatacggacctctccaacggcggcaagattcgcctgcgcgacgccaacggcaaccccaccgtcatcaccctcaccatcgtgtgagatttgaatgaggctccctctgtcttcagacgagggagcctcatttgttaattacttttcggcttcttcagcggcctgctgggccttgagctcggccttgaccttctgggcgtattcgttcacgaattcctgaccgctcattttctggattgcggcggaaacacgatcggtcagcgaacgcaaatcatcatgtgtaatctcatcggccggcttcttggcaacttcaatcggcttgccatacaacaccttggtcttgcccttcttgggaatcgacgtgccaatcggctgcagcttgtccgagccgatgatggcggtcggaacaatcgggcaaccggtctcgagcgcaagtcgtgcggcaccggtgtgtcccttgtacagtcgaccgtccgggctgcgcgtgccttcaatgtggataccgaacaggtgcccatcctcgataatctcgcgtgcgtgcttgagtgcgccaagcgacttgctgccaccggaacgatcaaccgggaacacgcccacggacgtgaaccaccacttcttgaacttgcccttcaatcccttgccctcgaagtattcggctttgcccatgaagtgcaccatgcgcgggcaggtaatcggaatcaaagcatcgtcgatcaccgccagatggttggctgcgataatcgcgccgccctctcgcggcacgttattcagtccgctgacagcagggctcaaacgatgatgagcaatagggccgagacctttgacgaagaaccagtagagcacttggcattcctcccgcagacgaactagccattggccggtcgcctgattagagtgacagttatgactgagaaccagaatagcaatgccgacggagagcggccaacccccacgccgggcaacggacaggattccggtacttcatccaagtcgtcgactcccggtgccgccggacaagccacgaatggtgccgatacaccgcaatcgcatgacgcgaacgatttggatgcggcgtgggccgcgttcgaagccgagcatcaggccgacttgcatgacgtggcttcctccaggcaggccaaaaagttcgagaagcaggccaagaaacgcgagaaggaggcgctgctttccgtagatgacttggatatcggctcgttcaccgatgatgctcgcccgagccgtggcggcaaaaaaggcaagcagtcaggtccccgtgatttcaccggctccagctggctggataccgataatgtgatggacgcctatgatgatggcggcttcactcccccgaaccctgatcttggtccggtcaaagcgtctacggtactgctgacggcgttgcttatcattggtctcgtaggcgaagcggtgatgatattcgtccccggcttgaacgcgattcctctcttgggcgcgctgctcaatattctcttcgggctgggcgtcattttgggcttgggtggattggtggccataattctcaaccgcaaagaccgccccggtgatcagggcggctattacgacgacggcgcgagggtgtagctcgcgtaggctgtgtggtccttggctcccctctctgaggctgagccgttaagcgaacagcccagcgggctgtttgtaggcgaggtgtgagagatagcgaaccaatgtatcacaggcgtggctcgtccgtaattgcggccgagccaagataggtcacgaattgaagtcgatcccgttgtctaaatgaaagtgcaacacccgttagattggaaattgcctagaaaacgttttctaggcaatttccaatctaacgggtgttgcactttcatttagacaacgggactcgggttgcaaaggcctgaccctgatagtatggggtcaggcctttcccatcccaagacgccgctaagaattcacctgagagtcgccttcctaggcatggccgttcaatcgacgattctagcgtgactggtgtgagcaggaatatgaagaaccggcggtgggccggcaagcgatcggggatcgcttttggtgcagtagcgcttatccttacggctctggtggttccttatgcttgtgcgggaaccacgggagccgttcctttttccggcgataatccatcttccggcacccgtacggtgaccatcgccgacatcactgattttcacgggcatatcgaacgtggtgcagacaacgccaccgccttcaccgtggccgacagccataatcccggcaatatgattccggtatcgaccggcgatttggtgggaggctccccgtatgagtcggcggtggagaaggaccaacccacgctggatatggccaaagcgtggggattgacgatttcggcggtaggcaaccatgagttcgaccgcggtgtcgccgatttcaacaatcgtatcgctgatcccagcaacggcatcgactggctgtgcgccaacgcgtctgccgccaataagtcgcctgacggactgctgagccacgtacgtgactctacgattcgaacggtgaacggcaagcggatcggtttcgtgggcgcccttactgatgcgctcggctcggtggccactccgcagatcactcgtgatgccgatcttgacgaacgggcggtggacgcgatcaatcgtgtggcccgtgaactcaagcgctccggaaaggtggatgcggtggtggccttgctgcatgccgatgcttcagccgccgccgatattgggcgagatgttgatgtggtatacaccggtcacagtcacgcgatcaagcgtggtacaaccgcgggtggcgcgcctatttacgaggcgggcagcttcgggcggaacatggccgtgcaggatttgatcatcaccggtgccgggcgtcgcgccacggtgcgagtggccgatgtggacctcggcaatggcaccagccatacggcggttgacggcgtgctgggcgtggatgggcttaatgcgcatccggcgcaagccgcttggatgtctgccggtgctgaggagaacgatgaggtatcgcgcgcgcagcatatttaccaggcgtcggcaacatatgcgaaccataccggcagcgcggtgattggcaccttggcctccggcgtgaatttcgacaaacaaggttcggacaagcacgggaatacggtcggtgtgctggtggcggacgcgaaccgagagtcaatcatgaagcatgtgtatgccgggaatcgcttgccggtaatcggattttcgaataatggcagtctgcggactccacggcttgatatgaatggcgatggcaaagtcaccgtgcgcgaggtggatagtctcatggccttgcagttcaaggccgcgcatgagacgctcaccgggcgcgatgtgaagagagtgctcgccgagcaatttcgccgtgacgatgggcgactggagcggcgctggctcggcatctcctcgaacgtgacgtatcggtatgccgaatgcggtacggctggtgagagcggcaatgccgatgccggcgttgatactgattccggcgctgataccaacgctgacgctgacgagtgtgctgccgacgaacatgcggcggttcgtatcgcgaacctcgccgttgacggccgaccgattgcggacgatgacctggtgattatcgcgtccaattcatatctgcttcagggtggcgacagttaccccgccttccgtgccggaaccaattacggcgagctggatatgccatacagccagccgttgcatgaatatctggccgcacatcaagggctcacggcagttgttgcagtaccggtagggactcaggcgtaagacaccaattgctgggtgactgaggaactatggggtgaagttatgagtatagggcaggagaaaacggcataaatatgacgacgctcccctcgctgaggggagctgtcgccgtaggcgactgaggggagcttgcggtataaccgtaaactcccctcagtcagccttgctgccagctcccctctctgaggggcacctggcgagacccttacttgatggcgttcagccactgctccttggtggccttctcggcttcgagcttggccttcttcttcgggtcggattcggccgcgatcttggcgtcgagctcggcgagctgggcgttgagctgctcctcgaagctggacttgcgggcgtcggcctccggatcggtctgcttccaagcggcatcctcgatggccttgatctgcttgtcaacggcgtcgagacggttctcgatgcggcgcatatcgtcacgcggcacgtaaccgatctgatcccactcttcctgaatcttggccagctcctggcgggccttcttggcctcggcgtcggtcttcaccggcaccagagcctcggccttgaccagcagagcctccttggcagccagattctccttctcggaggagttgatctgatcgcgatcggcctgacgagcgttgaagaaggtgtcggcggcttcgcggaacttggcccacagctcgtcgtcctcgttacggccagcgcggccggccttcttccaacggtccatcagatcgttgaacttgcgggaagtctcaccccaagcggtggaatccttgagctcattggcctcggcgataatcgcttccttggcttccttggcggccgtgcgctcgttgtcgcgagcctgagcccacttgcggcgagcctggttgaaggtggtacgggcgacggagaagcgcttccacagcgcctcggcctccggcttgtcgatgcgcacggtggtgcgctggtggttctgccactcgtcgaacaggttacggaacttgtcggcggtggagcgccagttggtgttgtcgcccagagaagcggccagtgcttcagccttctcgacaatggcggtgcgctcggcaacggccttggcctgggcggccttgcgtgcctcggcgatttcggtcttcttggcctcgccggcagccttcagctcctcgtactgggtcttgagtgcggcaagatcgcccacgacggctggctcggaggtttcttcacccaagagcttcacggattcgtcgatttcacgggccttgatgttcggggaagccaggcgggtggccagcagatcgagcttggccttgagatccaggaaacgacgggcgtacagtgccaacgcctcttccttggagacatccgggaactggcctacctcgcgctcggcgtcgccatccttgacgaagacggtgccgttgtcatccacgcggccgaaggcctcggcggccttgacatcagcctcggaataggcggcggtggcggcggccggggcggcagcgcgcggcttggccgccggagtcttcttggcgaaggcggcgggggagggcgcgtgcggtttcggcatggaagcgggggacggagtcggcgccggcgtggccgcgctggcctcgggtgcgggtgtcgttgcctgctcttcgggcgcagcggtgtttacgggttcggtgacagtttcgtcggccatggccagctccttaaagcgtagaatgcataagcgggagcgtctcccatcccgggcgaaccaggaagttttgacgcaaccctcacctattatattgatttcgtggctaaaggtgcatcaatatcaggattcccggagtggctcccctccgaacgtgttgtggagcagcgtgttatcgatacgcttcgtaaggtttttgagctcaacggcttcatcggcattgagacgcgagcggtggaaaccggcgcttctttgctgaaaaaaggcgagaccagcaaggagatttacctgctgagccgtttgcaggaggtcggtcatgaatccgacactccgattgaagagcgtttgggcctgcatttcgatctgaccgtgccgctgagccggtatgtggtcgagcactcgggtgcgttggcgttcccgttcaagcgctggcagattcagaaggtgtggcgtggcgagcgtccgcaggaaggccgcttccgcgagttcgtgcaggccgacatcgacgtgatcggcgccggcgacctgcccgaccactatgaagtggaactgccgctggtcatggtctccgcactggaagagctgcgcgcgtatggcctccccaaggccaccgtgcacgccaataatcgcaagttgtctgaggggttctaccgtggccttggcctgacggacgtcgaaggcgtgctgcgcgagatcgacaagctcgacaagatcggtgccgatgaggtggcccgactgctcaccgagacctgcggcgccaccgaggcacaggcgcgcgcctgcctcgaattggccgagctcaccgcctccgacggtgccgagcttgccgctaagttcgatgcgctgtgcgaggctcacggcatcgtcaaggattccgaggcctacacgctggctcgtcagggactcgataccctggccatgatcgtcgacgaagccgccgccatccgccccggttccgtcatcgccgacctgaagatcgcccgcggtctcgactactacaccggttccgtctacgagaccttcctcgacggtgccgcatcactcggctccatctgctccggtggccgttacgacaatctcgcctcccagggcaaccgcaagtatccgggcgtgggcctgtccatcggcctgagccgactggtcagctacatgctgcacaccgccggcgctcacgccaaccgtgtcagcccggccgccgtgctggtcgctgtgtggaatgaagaggatcgcccggccgccaatcgtattgcgaaccaactgcgtgcgcgcggcatcgctactgacgtggcacccaccgcggccaagctcggcaagcagatcaagtacgcggacaaactcggcattccgtacgtgtggttcccggccaccgctgccgaaggtgcggaaggcgcagagcccgctggcgacgaggtcaagaacatcgtcacgggcgagcaggttgccgccgattgcacgtcgtgggagccggatactgtggttgcccagcaaaccgtcgaaatctgacgtattcgcgcgaaaaatcgaggagaaacaagacaatgagccagacggcttacagaacacatcatgccactgaagtgaccgaggccctggtcggccagaaggtcaccctcgccggttgggttgaccgacgccgtgatcacggtggcgtggccttcatcgaccttcgtgattcgaccggcctcgtgcaggtcgtcatttacgacgaggatatggcccgcccgctgcgcagcgaattcgtgattcagattaccggcgaagtgcgcctgcgcccggatggcaacgagaacacccatctggcaaccggcaagatcgaggttgtggccgagaccatcgagatcctcgccaagtccgacgccctgccgttccaggtttccaccgctcttgagaatgagtccgagaacaagctgcctggcgaggacgtgcgtctgaagtaccgttaccttgacctgcgccgcccgtccatgcagcacaatctgaagctgcgttccgacatggctaaggccgcccgccacgcgctggaagacatggacttcaccgaggtcgagaccccgaccttcattaagtccaccccggaaggcgcccgcgacttcgtggtgccggcccgtctggtgcccggttcctggtacgccctgccgcagtccccgcagctcctcaagcagctgctcatggtctccggtgtcgagcgttactaccagctcgcccgctgctaccgtgatgaggacttccgcgccgaccgtcagcccgagttcactcagctcgatatggagatggcctacgtggaccaggaagatgtgatggccatgactgagaaggtcatcgccgccatctggaagtccgccggctatgaggtccagctgccgctgccgcgcatcacctggaaggatgcgatggacaagtacggctccgacaagccggacctgcgcttcggcaacccgctggtggagctgaccgaatacttcaagaacacgccgttccgcgtgttccaggccccgtacgtgggtgccgtggtcttcaagggcggtgccgccacgccgcgtcgtcagttcgacgcttggcaggattgggctcgtcagcgtggagccaagggccttgcttacgtggtcttcggcgaaaacggcgagctcaagggccccgtcgccaagaacctatccgatgaggagcgcaacggcctacgcgaggccgtcggtgccgaggaaggcgacgccgtgttcttcgccgccggttcccgcgagtcagcccagctgctgctgggtgccgtgcgtgtggagctcgcctcccgcgaaggcctgctggatccgaagaagttcgctttcacttgggttgtggacttcccgctgttcaagcccaccgacgatccggatgatgacgatgtggctgtcggccactccaagtggacctccatgcaccacccgttcaccatgccttccaaggattggatcgacaagttcgacaaggatcccgagcacgccatgtccgactcctacgacatcgtctgcaacggtgaggagatgggcggcggttccgtacgtatccaccgcgacgacatccaagcccgtgtgctcgatgtgctgggcatcaccaaggaagaggccgacgagaagttcggcttcctgcttgaggcattcaagtacggcgctccgcctcacgcgggtctggccctcggttgggaccgcaccgtgtccatcctggccggtgcagactccatccgcgacgtcatcgccttcccgaaggccggcggcggccgcgacccgctgaccggtgctccggccccgatttccgacgagcagcgcgccgagactggcgtcgactacgacccggacgctgacgaaaactaatctacggagcgtataccgcttttcctcagcactcgacgtacttcagtgcgccttcggcttcggacggcggtctccgcacgcgtagattaattttcgaggagtaatgctccggtgctattagccgcaaatggcccttggaataattccaagggccatttgctttttgcgggtggggcccaatgtgccaaatacctgccaaggggtgccaaatactccgcccgatggcacctccgccatgcggcaaacctcgcaccatgcggtgtcccccttggcgtttgccgattatccttccatggggcggtaacttcctcatggggcggtaaacaacccatggggcggtgaaaaccccatggggcggtaggtcaaaatggcttaattccgcggtttcacaatttcttcaaaccgccccatgggcaaattaccgccccatgaggagcgatcgcaactccgtatttgatcaatgttgtgatgctttgttgtgttttgcttgtttccgcctcctgtattcccctttgcgcgcattgatggtaaggctgccgtctattaatacccggcatgaaggttgaggacggccaggaagcggtatttgcatcgcggtggcaacctcttgtgcgaaggcacgttgtttggcggtgttccacaggtcatcggcgaacacctcgatgacggtccagcccaattgccgcagacgtcgacgtttttgctggtcccgcacatattgtttgcggaagcgacggtgatgatcgccatcatattcaatagcgactttgtattgtggataagccatgtcaacggtgtaggtgtatccgttctctgaatcggtaatgccatattgtgtttgcggtatgggcaggccgaaaagcataagcgccaagcgtgtacgagtttcctgaacggaatccgatggttttacgagcttcagcgccgcctcacaacgcgcacggccaataacgcggtgaaaggccgttagtcgttgagtgaattgttcaatggcatatccataacgtctgatgagcgcttcagccagcaccactaattcagtgaggttgagatattgggcaaactgtatccacgcatccatgggatgcatgcaggttacgccgtttgagaaagcgatactgttgaactttgcattccatatgcgatagtcgacattgtccaatgaagagcgggtccccttgctcctcaccgtcacataaaaatccttctgcggcaacgtgctgtgcctcggcaactccacgccgcataattccaatgcggtatacagcgagaaacacaacgtgcgtttcgtgcgcactttgcccagcagattccaacaggccgtgttcttggccgtggctttggcgtcaagatctttgcgcagatagttgttgatttcgccattgtgcggcacttcgctgtatccgttcatgcgccgagcgtagcgcattccacggtggcacaggggcaaaaccgaaaaatggggataacttaagcggcgcgaaccggttatccaccggcatatcgtgtgccgcgcccggttatccaccgcgcttcgggagtgtcgtccaccgtataacagcactcatcgtgtgcgaacagctagccacgctcaaaatgcctagcgcatttatacgaatacgacatgggaaacggcgagaccagccccacacaatacaaagtgaccgccagccatgcgcccgactgcggcatacacggcagcaacgccaacgacaccaaggccaaacatggaatcagcagataggacaacacgtgcccgctttgccgtcgcagcaacgtctcagccaccacgcagcaggcaatcagcgcacagcagacgccgagcgatgcgcgactcagcgagaatgtatgccgatgcccaatgccgccttcacgatgtctgatgcggaaatgagacatcgactgagcaactgtgtggacatactgtgaacacgttggaaacgtcggtgtgctatcctcccactcatgtctgaaacgaacaatgaaacagcagtgcgttcgcgcgcgacaagcacaacatcaccgagcaaggccaaattgaccccgctggttcccggcaaagaggacccgaaccgtccgctagtcgaactgacccacgtcgaaaagcacttcggtgctttgcacgtcctcaaggacatcaacctgaccgtcgccaagggtgaggtgctggtggtcgtgggcccgtccggctcaggcaagtccacgatgtgccgcaccatcaatcgcctcgagaccatcgattccggcgacatccgcatcgacggcaagcccctgccacaggaaggcaaggagctcgcgaacctcagggccgaagttggcatggtattccagtcgttcaacctgttcgccaacaaaaccattcttgaaaacgtgacgttggccctcatcaaggtgcgtcacatggacaagaaggaagccgagcaactggccatggacctgctcgcccgcgtgggcgtcgactcccaagccagcaagatgccctcccagctctccggcggccagcagcagcgtgtggccatcgcccgcgcgctcgccatgcgccccaaggtcatgctgttcgacgagcccacttccgcactcgacccggaaatggtcaacgaagtgctcgacgtgatggtcgaactcgcgcatgaaggcatgacgatgatctgcgtgacccacgagatgggtttcgcgcgcaaggccgccgaccgcatcgtcttcatgtcggacggccagattctcgaagagaacacgcccgacgagttcttcgagcatccgcagaccgaccgtgccaaggacttcctctcgaagatcctcacccactgacgaacccactgaaagacgggtacgcaatccaatgacattcaccaatacgttcaaacggaaggcttgccgcgtgatcgccgcgctcgccgccgtggcctgcacaatgtcgctggcagcctgcggcgcggacgaaaccggcaagatccgcatcggcatcaaattcgaccagcctggcctgggcttcaagaagtccggcacctacgtgggcttcgacgtggacgtggccaaatacgtcgccaagaaactcggctattccgaagaccagatcatctggaaggaagccccctccaagcagcgtgaggccatgattcagaacggcgacgtggacatgatcctcgccacctactccatcaccgacgagcgcaagaaggccgtctccttcgctggcccgtacttcgtggccggacaggatctgctcgtgcgcaaggacgacaactccatcaacggccccgaagacctgaacggcaagcgcctatgctccgtcaccggttcgacctcggccgccaccgtcaaggagaagttcgcctccgaagtccagctcatggaacagcccggttacgccgaatgcgccaccgccctgttctccggcatcgtggacgcggtaaccaccgacgacatcatcctggccggcctggcctccgcctcgcgcggcaagctcaaggtggtcggcaaaccgttcacgcaggaatactacggcgtgggcatcaagaagggcgacacgcagctggccaccaaaatcaacaacgccatcgtggacatgattcaggacggctcgtgggagaacgccatcagcgataacaccaagggcaccaactacacgcccgacgtacgctacaacccgcccaccccggacgaaggagaggaggcctgatgagcggattcctggaactcttcagccagtatgacgtgctcggcgcgtttctggtcaatatcgaactgaccctatggtccgccctgttctccctgatcctcggcgtgatccttgtggtgatgcgcatctcgccgatttcctcgctcagggccgtggccggtgcgtatgtggaactgttcaagaacctgccgctgaccatcatcatggtgttcatggtgctgggtgcctacgcgcagctgaagctcagcttctccgacaccttcaccacgaacttcttctggctcgcggtcaccggcctgagcctgtacacggcggcgttcgtgtgcgaatctctgcgttcgggcatcaacaccgtgccgattggccaggccgaggccgcacgagcgctgggcttgggcttcatgcagtccgccaccgagatcattctgccgcaggccttccgaggctccgtggcaccgctcggcaacacgctgatcgccctgctcaagaactccaccgtggccgccgccgcatccgtggctaccgaaacatcctcgctgatgagcgagatgatcgaattccgtcccgacgtgatcatccagatcttcctgatcttcgcgctcggctacgtgatcctgatcatccccatcggcatgctcaccacgtacctgtccaacaaactcgccgtaaggaggtgacggatatggccgatacttcgaattccgtgctgttcgacgcgcccggtcccaagggccggcgcaccattcgcatcgtcaactggatcgcgggcattctgttcgcggtggtgctcgtgcttatcctcatgcgcctgcacaacccgccggacggcgagaaccagctcagctgggagctgtggaagcccgccgtcgaacgagaggcgtggaccgacttctacctgcccggactgtggatgaccatcaaggccaccatcgtggccgtggtgggtgccgtggtgttcggcttggtgttcggcgtgggccgactgctgccgaacccgttggtacgtggcgtctccgccgtgatcgtcgagttctgccgtgcggttcccgtgctgctgctcatgatcttcttctggcgatggttcgcgttcgcgggcctgcccagcccgtcctattgggccgtggtgctggccttggtgctgtacaacggttcggtggtcgccgaactggtgcgctccggcgtcggcaatctgccgggcggccagcgtgaggcctcgctcgctttgggcctgaccgaaacgcagtcgctgatggagatcgaggtgccgcaggccgtctacgccatgctgccggccgccgtcacccagctggtcgtggtgttgaaggataccgccctaggctcgatcatcatgtataccgacctgctgcaggaatcgcgccgactcggctcgatgtacttcaacatcctgcagacgctggtcatggccgcggtgatttacttcatcgcctgctggctgttgtcgaggctcgccgaatggctgccctcgcgcatgcagcagcgtacggccgcacccgccgaacccgagccgctggcgccgatcgccgccggcgacccgtccaatgtcaaccagatcgctgtggccaaggaggtcgaagagctgccgctgggcggtacgccgcgcaaataccatgtgcatcaccgtggcaccaacgcctcgattcgcaactggcggcgcacccgctacgaacagggatatgacgccacccagcccgagtcacaggttgacccggaaaccggcgaattccaggagtctcaaaagcctgaggacaagccagaggcctgacagtcagctcaatcgccgctaagccggcacgaagaatttactgagtgtttgactgggctccggctacgtagccttcacggaggataggttggaacatatgaagatgttccggcacctatcctccgtttttgctattgcgaccattgcgccgctggcgttggcggccacgctagccgtgacgcctgcaatcgcacaggccgaccagctgcccaacccggattgggtggcattgctctccgactacgaaaagaactattggcaggcccccaccgatgccgaacacggtggcaaggtgctcgacgccgatacaatgaaactcgacgaagatttggccgtggcaattaaccacaaagccgccgaaaatctcgataaggatggcctgaacgcccaacgcaagcgtgcgctcgtcgactccgatctgcaagccgaggaagccatgccggacgcgctcggtccggtgcttggcaaatatatgagcgaagggctcaaatccgggaaactcaacgccgtcgccgatatcttctcctttaacgtggcctccacctacgcctcaaaacgtgcggccatgcatccgcgcccctatctgaaccgtgcggaaagcagctacggcggcactaacgatctcgccggactgcccgccacgcttgacatcaagcaatcaccctcatggctcgaacacgtgcccggctactcgaacttgcagaaaaacagttcctacccctccggccacactaccggcgcctattcgtggggtatcgcgctggccggcatgattcccgaactcgcgccgcaaatcatggcccgcacttcggaggccggcaacaaccgcatcgtgctcggcgtgcattatccgcttgacatcatgggcgggcgcattggcgcatccgcccagaacgggcagtactggcataacgaattcgcttcgtccatcgtgcccgcgtcccggcagctgcgcgactatctggtgtcccgctgcgccgcggacggccacggcactaccctcgccgcctgcatcgccaacaccaaggcctccggttcgggcggctacaccaacgattttctggacccagtggccaccgagccggtcgcggaccaggcctcggccgtgcgcgtctacaccgcacgcctgacctacaccttcccgcaagacaccgcccagtccggcgctgatttcgtggcaccgcgcggggcggcggacgtgctgcgactggcctatcccgaactgcacgccgatcagcgcaacgcgattttgaaagccactgccttggattccggataccccctatggcaatcgagcgacggctggcagcgtatcaactgggccaaagccctgtgcgcccgcgtcaccttggataagcacggcgatgtggccaaggtcgagaccgccgaccaagtggcgcttaccggcccgagtgtggtcaatgcccagtacaccgacgcgggcaatcacccggcgtcggatagctcggcgggtgaaaacagtgccattgcggccggaccggatctcgccaccctccatgccgcgcaacgaccggcgttgatcagcgtagctatcggtaccgctgtaatcgcgattgtcggcggaatacggacggttcgacgcaaatccaagaaccagcttcagcagtaattcagccaaagttcagtcgcgctgctcaccgctgcggtgacactgagcagcatcgccctgatcggcgtgcccgctgcgactgcggacgagcagcagaccactgccgaacagaacacggctgccaaaccatccgtaatcatcaacgaggtctatgccggcaatacgaaagctgccggagacccggatagcaagcgttgcgattgggtcgagctcaagaacaccggctccacagacgttgacgtgaaggtctgggcatctacggcagtgacaagaaagccaagaagcactacaccatcggcaccagcgaagtaacgaatacggacaccgtcatcaaagccggcggatatctggtggcatacatcgaccccgacaaggcaaagcctgccaaaacctgcgatgccgctgccgatatgaaagtctcctcgatcaagagcgacaatctgatagtcacgattctggccacttcgaattgtgatgataagaacgcatccacgaaattcaatgattcggccacccgactcacgttgcaggacagcgacgataatgtcgtggccgatgccgtgttcgatttttcgggtctattccacgtataccgcgcagctgtccagcaagcgcaagggtatggaggctgaaggcaagacctggaactaccgcgatattcttgcgcaattcatcacgatgcacaacaagaattcaaacgtactgcttatctggtcgggtgactggcccgcctacagcagcaattccgacaaatactatgtgattcttgccggtgagggcttcgactcgacagatgaggcttggaattggtgcaaagccaacaattacggtccgaacgactgcatgcctatagatttgcagtaacaggcgaaatgtgaatgtcgctacgttgctaggtctcctgagttacaagacgtacaatcgggagcatggccaaggacgacgacagaaccaacgagcctgaagaggccggcaagtggggtacggccggaaaatcctcaggaaagaacaacaagaacggcaagggaaaggaatacaaaaccgatcgacggatcgacaaggtattacagctcgcggcggatcgcatagacaccatcgactccagtgccagcgtgcctgaacgactggcacgtgcggcgaaatccagtgaactgctcagcgccgtatggtcgttgccgcccgctcaacgtcttatgttccaccacggcatgcaggtcactgatgtcgaaggcgattccactcccggattcgacggcaataaagaggacgccgaggagttcatttcgatcagctcctccgaaatcgcccgataccagcggctcatgtacgcgaatggcgtcaaaggctcgacacggcggctgctcatcgtgctgcaaggcatggatgcctccggcaagggcggcatcgtgcgtcacgtgttcagccaaggtgacccgatgggcatccattaccatggcttcggcaagcctgcggccgaggagctcgaccacgacttcctctggcgcgtgaagcgtgaagtgcccaaggcggggtggattgccgtattcgaccgttcccattatgaagatgtggtcatgccgcacgtctatggcacctatcccgaagacgtatggcgtgcccgctacgaccagatcaacgatttcgaacgtgaactggccgccagcggatgcgccatcctcaagatcttcctcgtggtaagccaggaagaacagaaaaaacacttcctcgggagactggacgatcccaccaagttctggaaattcgacatctccgatctcgaggcccgcgaccgctgggatgagtatatggccgcatggcaggaggtgttcgagaaaaccagcacggccgccgcaccttggtacctcgtaccggccgataaccgctggtattcgcgagcagtggtctccgaactgctgcgcaccaccttgaagaacatgaacatgacctggccgcccctcgaacccgaggtggaccccgacgaggtgcgccgccggttggcgtgagcgatcctcccactggcggagccaagcgcatggcacggctcttcgcacggctccgcccgctggcgggaggcgtcgcatagcgacggagggtggctcgtgccgccggaataggccactgggtagactgagcattatgactgacgagaaggaatacggatccctggggcggctggcccccgaatgggacggtgacgagcgtgaacggaatcttacggccgatgacatctacgaacgattcttcggctgggtggaagacgtcaagggcatcgagccgtggccgcatcaggaagaggccattatggacctcttggccggcgaccatgtgattttgaataccccgaccggttcgggcaaatcgctggtggcgctcggcatgcacttcgccgccctgtgcactggccgccgctcctattacaccgctccgatcaaggcgctggtgtcggagaaattcttcgacttggtcgaagtgttcggccgcgacaacgtcggcatgatcaccggcgacagccacatcaacgcggacgcgccgatcatctgctgcaccgccgaaatcctcgccaatcaggctttgcgcgaaggcacccatgccgacgtgggcctcgtggcgatggacgaattccattattacggtgatccggagcgcggttgggcgtggcaggtgccactgctcacgctgccgcagacccagttcctgctgatgagcgccacgctcggcaatgtggacgccattgccgacaagctctccgatctgaacgacaccccggacgtggatgtaatcgccgacgcgccgcgaccggtgccgttaagctacgaatacacgctcgatccgatggaaaaaaccgtggaactcgccttccgcaacggcgaaaccccgatttacgtggtccacttttcgcaggacgccgcattggagaccgcgcaagcgctcgcctccaccggtgtatccagcaaggaacagcgccaagccatcgcagaagccatcaaaggcgtcaagttcaccacagccttcggcaagattctgcagcgactgctgcgcaccggtgtcggcatccatcatgccggcatgctgcctcgctaccgccgcctggtcgaacagctcgcccagcagggtctgctgccggtgatttgcggcaccgatacattgggcgtcggcatcaatgtgccgattcactccgtggtgctcacggccctgaccaagttcgacggcaccaagatgcgccgcctgcgcgcccgcgaattccaccagattgccggacgagctggccgtatgggattcgataccgagggactggtgatcgccgaggctcccgaatacgaaatcgaaaaccagaaagccatcgccaaggccgggggagacccgaagaagctcaagaaggtcaagcgcaagaaggcgccggaaggttttgtgacctggaaccagagcacgtttgacaagctcatcgacgccgaaccggaaaccctggtcccgcacctgaaaatcacgcattcgatggtgctcaacgaagtggcgcagggcggcgacgcccgtgcccgtatcgacgatctcatcgacgattccgcgcagacccccgaccaaaaggagcatctgcaccagcgggccgacgagatcttccaaaccctgttcgataccgaagtcatcgaaaccgaggaccgcaaggacggcggcaaggactactacatgacccttgatatgccggacgacttcgccctcgaccagccgctctccccgttcctgctggccgcgctcgaactgctcgaccccgagtccgacacctatgcgctggacgtgatttccatggccgaggccacgctcgaagaccccaagcaggtgctgcgtgcccaggagcgtcaggcccgagacaaggcgatggccgatatgaaggctgacggactcgactatgacgagcgtatggataagctgcaggagattacgtatccgaagccgctggaagacatgctcgaatccgcgttcgaccagtaccgccacgatgtgccgtgggccaacgactactggctatcgccgaaatccgtggtgcgcgacatggtggaaaccgcctccgacttcaccggatacatcacccgatacaacatcgcccgctccgaaggtaccctgttgcgctacctctcggacgcctaccgcacgctggcgcgtaccgtgccgcccgaaaagcgtgacgagcaactcgaagacatcatctcctggctgcgcgtgctcgtgcgctccatcgactcctcgctggtggatgaatgggagaacgccggcgattccgccgaccagtccgaggcggcggcctccttggcggcgccgggcaagaagaacgcggtggtcgaggaccgacgaggccttatcgtgctgatcagaaacgccatgttccgccgtgtgcagcttatggacctcgaccagccggacaagctcggcgcgctcgacaaagactggggctacggtgtgcacgaatgggaagatgtgctcgacgactactacgacgagcacgagtacgtgggcatcggcgccgaagcgcgctcgcccgaactgttcatgttggatgacaagcacgagaacgacgagcatacgtggaaggtgcgtcagattatcgatgattccgatggcgatcacgattgggccatcgaaggcatcgtggacctcgacgccacccaagacaccggcgaagtagtcttccacgactacaaggtgagtaactgattcctttcttggctcccctctctgagggaagccagggtgcagctcgaacgtctgttcgaacactggggtactataggacgttatgagtgagaacgatttgtttggggcggctgatgcgccggagtcgatgacacggccgttggcggtgcgcatgcgtccacgcactttggacgaggtgattggccaaacgcaggtgttgggccagggctcgccgctgcgccgcctcgccaatccggccagcaaaggcagtctcaccgcgccgagctccgtaatcctgttcggccctccaggcgtcggcaaaaccacgctcgccaccatcgtggccggccaatccggccgcgtgtttgaggaactctccgccgtgacatccggcgtcaaagacgtgcgcgacgtactcacccgcgctcacgaacggctcgtgtcacgcggccaggaaaccgtactgttcatcgacgaggtgcatcgcttctccaaatcccagcaggatgcgctgcttcccgccgtcgaaaaccgcgacgtgacctttatcggcgccaccaccgagaacccgagcttttccatcatcaaaccgttgctctcccgttcggtggtcgtcaagcttgagtcattggagcctgatcagctcaccgaactggtgcagcgcgcgctgactgatgaccgcggtctcaagggcgaggtcaaagccacggacgaagccatcgccgatatcgtgcgcatggccggtggcgacgcacgcaagagtctcacgattctggaggccgcggctggcgcggtcaccggcgacgaagcccgcaaaaagggcgcacgccgacccatcatcacccccgaaatcgtggctacggtaatggacaccgccaccgtgcgctacgacaaagacggcgatgaccattacgacgtgatttccgcattcatcaaatccatgcggggctccgatccggatgccgccatccattatctggcgcgcatgctgaaagcgggtgaagatccgcgcttcatcgcccgtcgcatcatgatcgccgccagcgaggaagtcggcatggccgccccgcagattttgcaggtcaccgtggccgcggcgcaggccgtggcgctggtcggcatgcccgaggcacgtattattttggccgaagccacgattgccgtggccaccgcgcccaaatcaaacgccagctataacgccatcaaccaggcgctcgcggacgtggatgccggcaagatcggcgctgttccgctgtatttgaggaacgcccccaccaagcttatgaaagagtggggcaaccacgagggctacaagtatgcgcacgattggcccggtgccgtggcgccacaggaatatatgcccgaagagctgcgtggcaccgagtactaccatcccaacgatcgcggctacgaacacgaagtcagccagcgtcttgccaagattcgcccgatactgcatggtggggaacccgaacagaaatgaacataggggagtaaagtgtaacgcaacaataacagtggaaaaaggggaggcaaacaccatggcgaccatcttcatcgtggacgatgatcaggccatcggcgaaatgcttagtcttgttttggaaaacgagggattccagaccgtgacctgcctggacgggctgagggctgtggaaatgttccccatcgtcaagcccgatttgattctgcttgacgttatgctccccgggctggacggcacggaggtggcccgccgcatcagagctacctctaatgtgccgattatcatgctcaccgccaaatcagacacacttgacgtcgtggccggcttggaagccggtgccgacgactacgtgcccaagcccttcaaagtagccgaactgctggcgcgtatccgtgcacgcttccgcatcgccaagccggccgccgaagacggtgccaccggtggcgcaagcggtggcaatgcaaacgtcaaccatctggaacgcggatccatcgtcatcgaccgtttggaacacaccgccaccaaggatggcaaggacctgaatcttactccgatggaattcgagctgctgttcatgcttgcggccgccgccggcgaggccatcagtcgttccagcctgctcaagaatgtctggggatacgagaattccggcgatacgcgcctggtcaatgtgcatgttcaacgccttagggccaaagtggaggacgaccccgagaacccgcaaatcgtgcagaccgtacgcggtatcggctacaagttcgtcactcctgaacaatgaacctgcgccctcgattcagcctcaaacgcttgctgcgccacggacgcgctgaagttcgtcgctcactgcaggcccgcaccgtggccctcaccgtgattcttacgctggccgtggccatcgtcttctctggcgtatcgatggtatcagtgcgcgcctcgctgcttacccaaatcacttcgcagtcgcgtgccgactattcaaacatggtgcagcaggcccaaaccagtctggacgcggccgatgtctccgccgcagtgcagatccaacagctggtcaatgacttggcgtcctcgttgcaatccgaggggccctccaacctgataggtgtgtatttgtggagtcgtgataccaactcgcgtgccatcatccccgtatccaccgaacccagctatcaaagtctgatttctgatgacatccgttcgtccgtggcctccgacttggatgacagcgtgttctatcagccggtcgaaattcccggtgattccggcatgtcgggcagcgggacgcccgcagcggtgctcggcaccgtattggactttggcgtggccggcaacctcgaattcttcgccatttattcgtacacgttccagcagcagtccttgacgcagattcagctcagtctggtggtcatctgtgcgttgctgtccatcgtggtgggcgtagtaatctggctggtgattcgtggcatcgtgcgcccgattgaacgagtggcagcggcctcggaaacactggcctccggcaatctcgatatgcgcgttaccgtgaatcgtaaggatgagcttggtgtgctgcagcaatccttcaatacgatggctgatgcgctcaaccagaagattgatgagctggaggaagcaagcgttttccagaaacgatttgtgtccgacgtcagtcatgaattgcgcaccccggtgaccaccatgcgtatggcttccgacctgctcgaaatgaaaaaagacggcttcgacccctccaccaagcgtacggtcgaactgttggccggccagatcagtcgattccaagacatgctcgtcgatctgttggaaatctcccgctacgatgccggttatgcggcacttgaccttgtggaaaccgatttatgcgaaccaattgaaacggcagtggaccaagttgccggcatcgcccaagccaaacgggtgccgattcacacgtatctgcccaatgtgcaggttttgactcgtatcgattcgcgtcgagtgattcgcatcgtcagaaatctgttggccaatgccgtcgatttcgctgaggaccggccgatcgaagtgcgtgtcgcggccaaccgcaaagccgtggccatcagcgttcgcgactatggcgttggtatcgacgaagacaaagtcgctcatgtattcgatcgattctggagaagcgacccttcacgttcgcgcgttaccggcggcaccggattgggcttggccatcgccatgactgatgccttgctgcaccacggtactatccgtgtacgttcggcagtgggggagggcacctggttcttggtattgctgccgcgtgaccccgaccaaggtgaggtggcggacgctgaactgccggtgaattttgcttctgaaacgcccgatgacctgcgtattaccggtgggtttggtgtggccaccagccaagtcacacatgattatcatgaggttcgccgcgacacgatgatggggaggccgctatgagacgagtgaccagaacgattgccgccgcaggcgcggccatagtctgttgcgtcacgatgacggcatgctcaagtccgttcggtttgccgattagcggctcggtgcagactctggcaccggtggaacagcagactcagcgtgtttacaccaatcctcagggacctgcggacgatgcgcagccggaaaccatcgtcaaagggttctatgatgccatgcctgccggcgtacagtccgatggctaccgtgtggcccgtgagtttctgaccggttcggcgtcggccggatggaatggcgattcctcggcactggtctacagcggtacgccggatttccgccgccgtgccaatacgatgagtaccccgcaaggggcggagagctcgctgattgtagaagtacagctccaagtggtcggctctctggactcgcatggcgtgtatacgccgacagatagcagcacgatcagcaaagttccttatatcttgattaaaagaagcggccagtggcgcatctcctcgttggagaacggcgtggtgatatccaccgccgattttgaacaagtcttccgccaagtatccgtgtatcaggtgagcacatccggcaaacagctcataccggatgttcgatggctgagctggcgcaactggcgcacccaggcagtcggtgaagtactctcggatgcaccctcctggttggaaggagtgctgcgaggcaccggcttgcctaccatcaaactcgcggtcgacagcgtgccggtgaagaacaatgtggtggagatacaccttaacagcggtatcaatgcgttgaatgaggaagaacgaggcctgctggtacatcgcatccgtctgactatgggcgacggcaatgccgaatacgcgctgaagattaccggcgacggagtggactattctgatgccgacgcaaatgtgaaacttactaccgagcagccgacagcgggcgtatacacgttgaccggtgggcatatcgtttccctggccagctccagtccgttgcgtgtaggggaggcccccggatatgacgatgctcggggcttcgttttttcctcatccggcggtgcggtgttgcgtgcggacggtgtcgtcgaatgcctgaaatctgatggtgcgtcctgtggggtgatgttctccggcgagtcgatgcgatcgattaccgaaggtctggatggcgaagtatgggctgtatccgagaacgggcgcgaattgcatgtgtcagatgggggtaaggaaaccgatctgaagcttgattggcttggcgctgccgacagcattgtggcattggcggtttctccggaagggtgccgattggcgttggcagtcgagggcgaggacacgaacggcgtgatgatgaccggtgtggcgcgcaacggtgataaaacactgagcggtctgagcaaagcggccacccaagtgagtgtgctcagacacgtcaccatgctcacgttctacaacgatctgaatctggtgtacgccaccacacctcctgagggaaacagcgaacaacaagaggcatggcgtcaaatggcaccaggcccggccaatgcgcagcgtctgcctaatggaaccataacgtcgatggcatcggggcagattagcctgtcccgtcgcctggccattgtggacgatttgggtattgttcgctccgtttctggctcactcgacggttcctggaccatcgccgatagccaggtcactgccctcggtgcgcagtagatggtataagaaaaacggtgttcataataacctttcttgttgtatgaggcaacggctttgtcgctcggctggcgagcggcattgccgctgcgcaaccaatcactattattggtctgttatcaaggcaaaacagtgttgcgacgccatttttgaaccactgttattaatttgttataaacctgttatcaaactgttatcgcatgcgattgaacatttggcctgtgagcgtcacactagagattgtcgatgacgaacagtcaccaaacaggatgaaagatcatccaaaaaataaacactgctcgaggaggagtatttatgaagaattggaagaaggccattgccctcgttgcttctgctgctgcgcttgtcagcgttgccgcatgcggttccagcaacgcaggtggcagctcggactccggcaagaagacggttggcttcgttgctgtgggccctgagggcggcttccgtaccgccaacgagaaggacattcagcaggcattcgaggatgccggctttgacctgacctactctccgacccagaacaacgatcagcagaagcagattcaggcgttcaacaagttcgttaacgacgaagtcgacgccatcatcctgtcctccaccgaggattccggttgggatgactccctgaagaaggccgctgaggctgagattccggtcttcaccgttgaccgtaacgtggacgtcaaggacgccgaggccaagaaggccatcgttgctcacatcggaccgtccaacgtctggtgcggcgagcaggctgccgagttcgtgaacaagaacttcccggatggcgccaacggcttcatcctcgaaggccctgccggcctgtccgtggtgaaggatcgtggcactggttggggcaacaaggttgcctccaacgtcaaggttcttgagtcccagtccgctaactggtccactgatgaggccaagaccgtgaccgctggtctgctcgacaagtacaagtccgacaacccgcagttcatcttcgctcagaacgacgagatgggcctcggtgccgctcaggctgttgacgccgccggcctcaagggcaaggtcaagatcatcaccatcgacggtaccaagaacgctctgcaggctcttgttgatggtgacctctcctacgtgatcgagtacaacccgattttcggcaaggaaaccgctcaggccgtcaaggactacctggatggcaagaccgttgagaaggacatcgagatcgagtccaagaccttcgacgccgcctccgccaaggaagctctggacaacaacacccgcgcctactgataagtctgctgcgactcattgataactgaaccaaataattgatgtgatggtgtgagaaggatgttccttccacaccatcactcatgtgtggctcaaatatcacaaaacgataacacttcattctcgtttaaggcaaagacatgacagataaaaaccccatcgtcgtaatgaaaggcattacgattgaattcccgggcgtcaaggccttggatggtgttgatttgactctctacccgggcgaagttcacgccctgatgggtgagaacggtgcaggcaagtccaccatgattaaggctctgaccggtgtgtacaagatcaacgccggctccattatggtggacggcaagcctcagcagttcaacggcaccctcgacgcacaaaacgccggtatcgccaccgtgtatcaggaagtgaacctgtgcaccaacctttccgtcggtgagaacgtgatgctgggccacgaaaagcgcggccccttcggcatcgactggaagaagacccacgaggccgccaagaagtatttggcacagatgggcctcgaatccattgacccgcacactccgctgagctccatctccatcgctatgcagcagctggtcgccatcgcccgcgctatggttatcaacgccaaggtgctgattctcgatgagccgacctcttcgctggatgccaacgaggtcagggacctgttcgcgatcatgcgcaaggtgcgtgactcgggcgtggccatcctcttcgtctcccacttcctcgatcagatttatgagattaccgatcgtctgaccattctgcgtaacggccagttcatcaaggaggtcatgaccaaggacaccccgcgcgacgaactcatcggcatgatgattggtaagtccgccgccgagctgtcccagattggtgccaagaaggctcgccgtgaaatcacccccggcgagaagccgatcgtcgatgtcaagggcctcggcaagaagggcaccatcaacccggttgatgttgacatctacaagggtgaggtcgttggcttcgctggcctgctgggctccggtcgtaccgagcttggtcgactcctgtatggtgccgacaagccggattcgggtacctacacgctcaacggcaagaaggtcaacatctccgatccgtacacggctttgaagaacaagatcgcgtactccaccgaaaaccgtcgtgatgagggcatcatcggcgacctgaccgtccgccagaacatccttatcgccctgcaggcaacgcgcggtatgttcaagccgattcccaagaaggaagcggacgccatcgttgacaagtacatgaaggaactcaacgttcgtcccgccgacccggatcgcccggtcaagaatctctccggcggcaaccagcagaaggtgctcattggccgttggctggccacgcaccccgagctgctgattctggacgagccgacccgtggtatcgatatcggtgccaaggctgaaattcagcaggtcgtgcttgacctggcttctcagggcatgggcgttgtcttcatctcctccgagcttgaagaggtcgtgcgtctgtccgacgacatcgaggttctcaaggaccgccacaagatcgcagaaatcgaaaacgacgacaccgtctctcaggcgaccatcgtcgaaaccatcgctaacaccaacgtaaacaccggaaaggaggcatgagatggctgaaaaggcaaaagccgagggcaacaactttgtcaagaagctgctgagcagcaacctgacctggtcgatcgtcgcattcattcttctggtcatcatctgcaccatcttccagcatgacttcctggctctgagctggaacagcaacaccggtggtctggccggcccgctgatcaccatgctccaggaatctgcccgatacctgatgattgcaaccggtatgaccttggttatctccaccgccggtatcgacctttcggttggttccgttatggcagtggcaggtgccgccgccatgcagaccctgtccaatggcatgaacgtgtggctctccatcctcatcgccttggctgttggtctggccattggctgcgtcaacggcgctctggtttccttcctgggcctacagccgttcatcaccaccctgattatgatgctcgccggccgtggtatggccaaggtcatcacctccggtgagaacaccgacgcctccgcagttgctggcaacgaaccgctgaagtggttcgccaacggcttcattctgggcattcccgccaacttcgtcatcgccgttatcattgtgattctcgttggcctgctgtgccgcaagaccgctatgggcatgatgattgaggccgtgggcatcaaccaggaagcctcccgtatgaccggtatcaagccgaagaagatcctcttcctcgtctacgcgatttccggcttcctcgcggccatcgctggtctgttcgccaccgcatccgtgatgcgtgtcgacgtggttaagaccggtcaggacctcgaaatgtacgccattctggcagtcgtcatcggtggtacttcactgctgggtggtaagttctccctcgccggctctgctgtcggtgctgtaattatcgccatgatccgcaagaccatcatcaccctgggcgtcaacgccgaggcaactccggccttcttcgccgttgttgtgattgtgatctgcgtgatgcaggctccgaagattcacaacctgagcgcgaatatgaaacgcaagcgcgcgctcaaggctcaagctaaggcggtggcagcatgacaacagctacggcaaacaaagtgaaggctcccaagaagggcttcaagctcgatcgtcagatgatcccgaccctcgcggccgtggtgatcttcatcctgatgatcatcatgggtcaggcgttgttcggcacctacattcgactgggcttcatctcctccctgttcattgaccacgcctacctgattattctggctgtggccatgaccctgccgattctgaccggtggtatcgatttgtctgtcggtgctatcgtggccatcaccgcagtcgtcggcctgaagctggcgaacgccggcgtgcccgccttcctggtcatgatcatcatgctgctcatcggcgctgtgttcggcctgctggccggtaccttgatcgaggaattcaacatgcagccgttcatcgcgaccctgtcgacgatgttcctggcccgtggtcttgcctccatcatctccaccgactcgctgaccttcccgcagggcaatgacttctcgttcatctccaacgtgatcaagatcatcgacaatccgaagatctccaacgatctgtccttcaacgtcggcgtgatcatcgcactggtggttgtggtcttcggctacgtcttcctgcaccatacccgcaccggacgcaccatctacgccatcggcggctcccgttcctccgcggaactcatgggtctgccggtcaagcgcacgcagtacatcatctacttgacctctgcgactctcgccgccctggcctcgatcgtgtacaccgcaaacatcggctctgccaagaacaccgtgggtgttggctgggagctcgacgccgttgcctccgtggtcatcggcggtacgatcatcaccggtggcttcggctacgtgctcggctccgtgctcggctctctggtccgctccatcctcgatccgctcacctctgacttcggtgtgccggccgaatggaccaccatcgttatcggtctcatgatcctcgtcttcgttgtgcttcagcgcgcggtgatggcggtcggcggagataaaaaatagcgggcttgcccgctcggtctccgcaccgaatacgacacacaccataactgaataggcgggattagcccggctgctgtgatggcaaggtcacagcagccggcactgcccgccaaagctttctttctccttttcttcctttcattagcgtgtggggcgtgccccggggttctcccggggcacgccccacacgtgtttggaaagctgggactctattgatgatcggatttatgcacgcttacgtgccgcgcgaatgcggaacgcggtggccagacagcaccagccaatcaggcagataaccgtcatcgtggcaaacgtccatgtgccgccgacggcagtggcgtgagcaaactcagcggtgccttcttctcctgcgccggcctgagccacggaaagaatcgtggagaacagtgcggtaccggcagcgccgccaaactgaagacacgtgttgaaaatggcgttgccgtccggcttgaactcgggagagacctccgacaggccactggtcatcacattcgcattgccgatggaatagaacagaccgaaaatgaaatagaatccggcgagcagcaagggcgtaagctgcatcgagaacaccagcataagcactgggcccaaaatagcgatgccgatcggaatcagaatcggcttgaccgcgccgaacttatcgtagaaccagccgccaagcggggcacagacagcgccgaccagtgctccgggcagtaccagagagccggccacaaatgccgtggtaccgagcgagagctgtgccacattggtgatgacatagccgtagccgatggcgaccaatggcagcagcagatatgcgcaggcgtgtaacagtacggcgggatccttgagaatgccaaggcgcagcagcggggagaaggcacgcttggaactcatggcgaacacgatcaacaaggcgaggcccgcaatcagactgacaatggcgataatgccggagcgtgtggctgacttgccggacaccgccgcactgatggccacgccaccttggttgagcgccagcaccagaccgaccaacgcgacaacaatggacccaagctgaatcgggtcaagataggcagcctcggtcggtgtcttctgctcaatgcacttcatgccgatgcatgctgcgattagcaccagcggaatggcgatgacgaaaatcgcgcgccacggcagcactgtggtcaccgcgccgccgacggtcgggccgatggccggagccacggtaatgaccagcgatcctacgcccatcaatcggccgattttcgaacgaggagactgctccaggatgatgttgatcatcaacggcgtggccacgcctgagccaatgccctgaataatgcgggcgacaatcagcagcgggaaggcttgggcgacgatcatgatcagcgagccaacgatggccagaatcacagccgcaagaaaaatggttttcagcgcgaatcggcgcttcaaaaacgagctgatgggcatggtagcggccaccgccaacagataaatcgtggtaatccattgcacagtggccgtgtcgacatggaattcgcgcatcagtgcggggaaaagcacggtcatcacggtttcggtcagaatgccaatgaaggcaagtgagccgacagccacaatcgcgccgataagacgtgtgggaatcttctcgttatcaatatgctgctcaggcatacatgctcctaaacgttcggttgcaaggtatggaatgtaaggtttaccaaccggcgtaggtacctgtgcgtgcggataaaccggcaaccgtactgccttggctgcacgctatggaatcacaaaaccacctgtgagtgtacggttcggggcggacgctacggtcgatgcgcaatgggttgtcccttggtttggtggggtttgatggggcggattcggcattggtccggtagcagttcggcattggttcagcatgaggaaaccgcgataatatctgccctgccgcctagtttggtgaaccatgggtattgagaacacgcataagctgattgtcaactgcctgccactcaacgaaggagaacggcgggctttcgccaaggcggctcgcgatgtgccgcaggaattcgtgggcgacgaagcgcaccgcggcgacatggtctggtcggccgctgttcccgaggagcttcgctcccgagctaccgcagtcatcggcaactttccggtctcgcaggcttcccaatacacccgtcttgaatggttgcagaccttcagcgccggtgtggatgcgtacatctgcccgggtgtgctgcctcgcggcaccatggtcaccaatgcgagcggcgcgtatggccaaagcgtgtcggaacacatgttcgccaccatgtgggcattgatgaagaacctcaaccggtatgcctccaatcagcgtgatcatcagtggcaggatgaaggaccggtattgagcccggaaggtggcatcgcgctgattatcggcgtcggtgacatcgggtcgcatttcgctcagcttgcccaatccgtaggtatgcgtactttcggcgtgcgccgtcatgcggacgtgccggccaagggcattgaaaagatgtatggcttcgagcggctggagacgctgttgccattggcagacgtggtggcgatggcggtgccgcgctcgccgcagacccatcatctgctgaatgcggatcgtctgggtcgtctgaaatccacagccatcgtgattaatgccgggcgtggcgacgccatcgatcccgaggccttggctgacgccttgcacaatggacggctccacggtgccggattggacgtcaccgagcctgagccgttgccggcggaaagtccgttgtgggatgagccgcattgcctgatcaccccgcatgtggccggcggcaatcatttggaaaagacttccgaacacatcatccgcatcgccctgaccaacgtttcccgctatgccaaacagcaggaactgttgaatctcgtgcgatactgattcgcctgtgtcgggcggcgggcggccatcgcctgacactgaatacagataaggggcgtataacaccgttgttatacgccccttatcgggcaatccgaaaaagatggttgatagtcagtaccaatcagtactggttcgcgccgataccctcgaacttcacgttgaagccacgctggtaatgcaggaacatgctggcgccatagcggtcgaccggacggtgcgtgaacagcatacgaatggcgaatgcggtctgcacgtccttaggcagcgccaggaatgcttggtgggcgtcccagtacgggtcgtacaccacggcggcaccgggcacgtaggcgtaaccgtagccatcctcgttgacgtatcccatgaacggcagatcccaggcgttgtgtttggtgagttgtgccttgaagtcctcgacctcggccaacgccgcgtcgctcaggccgaagctcttggccacttcattggccttggttgttttcgaatccgggtccttgccgaacatatccgggttgacgatgatgacttttccctccgccataatgtgttcctttcagcatggcgttccccaagcaagcgcctagggaagtactggcattgttcgattcacatatgaattgaacaacatgttaccttctctgtagaaaaggattgtgcactttgttgatgtgctggtttcaaagcctagcatgaaaaatggcggatataagccgttttgccggttattaatctattggtaatgcaattgggaagttatggtagtctgtgatgtctgatgttcatatcttgcaaaagtgaacatgataaatgtttgttttgagggtgaaagcaacaaagaaaacggccgtgtacatgaactcatgtacacggccggcgtgtcgcatcccgctgcgactgcggcatcgagatgatacctgcagaggcgtggttgatcaggggcccaatgaacgtggcccgaggttagtttcagtctgatagttcgtagccgttggcgtctttatgccacggtgagccgggcttgctgcacagaatgatgatgccttcaacaaagccccagatggcggctgcgattgggccaagtccgagcagaatccagccgacaagcgtcagcagcagctgggccacggccttgccggtgttgccgagatagaagttgtgcacaccaagtccgccgaggaagatgcccaacaggccggcagccagcttggacttggacgattgccccaccggggcggcggcatacggagcggcggtgtattgcggctgcgcgtaggcgttcggctgctggtaagcctgtccatagccgggctgctggccgtagcccgctgcgggctgtgcgggctggccgtactgcggctggccgtactgaggctgagcgtatgcgccggcgggctggccgtattgcggttgctgctggccgtagcttccggcggcgggttgagcgtatgcggcgggctgtggggcgccatagccctgcggctgctgtgcggcatcttggccgtaagacggttgtgccggctgtgcgggctgtgccggctgcggaacactgtccgaaccgtacggttgttgttgattatcagtcatgcgggtcagtcccctctcaatcgggaacggcaataccttcttaccgtttctgcacaacatcatctcatgttttgcccaatagtaaaacctgccgcgctacgattgggccatgagaagtttcctgaccagctggttgattatgactatcgccgccgccgtcatggtcgcggtgactcccggcatgaccccggtgggggagcctccgattctcggcatcgccgcgttcgctttgttcatggcgctgattaatgcgtcaatcaagccgattgtgcatctgatcgcactgccgtttgcgattctgtctctcgggctggtcaccttgattatcaattggctgttcatgcgactcgccagctggctggcggtcagtctgttcggcgtgggcgtcttcgtacacggtttctggtggtcggtactggggtccttggtcctgaccattgttgcgggaatcgtcgggtccatcttggatcagtgacggtgctcgctgggcgaatatgagtaatggcggttggaatcagtccgattccaaccgccattactcatatcaagctacgggatcgagcggggcgaacattactcgcgcaccaagcggatatgctccacatcgtcgcgccgggagcgacggaacagcacgaaacgattgccgatggactgcaccacttcggcgttcagctgctcggcaagctcggcggcggcttccttggcggtcaggccagaaccgtcctgcacggcgcacttgatgagctcgtgcttctcaatggtctcatcggcctgattgacggccgactcggtcaaatcgttcttgcccacatagaacaggggcttcagcgagttcgccatcgcgcgcagctgcttgatttgcttcttggtcaatgccatgggaatttccttacatctttcgtataaccacaccagcatagcaaccggtgctgtctgcgctgtttgccgccctacagcgcgatgatggccgcgatgtagatgatgacggcagcggcgaatatgagatctcgcgcggcgatggtcagggcacgccagtgagtgcggcggatgccctcctcgtagcagcgggcgtcaagtgcgaggctcaggttgtccgcgtgacgcaacgtgccggcgaaaatcggcacgataatcgcgctcatcgccttgatgcgctgggccagtgaaccggtttcgatggaaccgccacgcgcggattgggcgtcgacgatggcgcgggtttcgtcggtcagcgttggaatgaatcgcaatgccagactcatgaccagcgcgatttcttgggcatggataccgagccggttgagcggactgatcaaggtggcgaaggcgtcggtcatggcggtaggcgtggtggtagtgaggaacaccgcgcccagaatgattaccaatgcgaaacggcaggcgtacagcacggctatggtcacgccctgatcggtgatgcttagcgggccaagcgccaccaccggcgtgccggtgcgtaccacaaacagattgaccacgcccatcagcaccagcaggatcagaatcggatgaatggattcaagcacccgtaacgggttcaggcgtgccgccgcgataacggccagggtgatggcgatgcccagcgcgagctgggttggcgtgttcaccgcgaacatcgtgaacatggcggccaggaagcccaccatcttcacgcgcgggtcaagtcggtgtatcactgagtgcgcagggccgttggaggatacggccggctcggtgacggtggccgtgacggggccgccggatgcgggggcggcaatcggcatacggaccacgcggtcggcgatttgctcggcctcctcccggtcatgggtgatgatgagcacggtcacgccacgcgatttgagcgtgcgcaacagctcatggatacgcttcttggcttgggcgtccagactcgcggtcggctcgtccatgatgagcacgtcaggattgcaagccagcacgccggcaatggctgccaatcgttgttgcccgccggacaggtcgaagggggagcggtcggcaagatgcccgatatgcagcagttccagtgattcgcgcacgcggtcggctacctcggtctcgccaagcccttggttgcgtgggccgtacgccacgtcctcggctaccgtgtcagcgaacagctgatgctctggatgctgcatcacgtaacccacatgccggcgcaattgcgctaattgcttgcgattcgccgacttcgggcgcacgttgcgaccgcgcttgccggtcgaggccaccggaacaccggccacttcgatgctgccggcggtcggcgcagtcagtgcgcacaacatgcgcaccagcgtcgacttgcccgaaccattcacgcccatcagtgccacggtttcaccgcgcgcgatggtgaacgacaggtcatcgataaccgcccgtttggccgaaggatagcgataggtcagatgcgagacgcgaataatggggttcgtcatatcaccgatgccatcggagagcagcggcagttcggagccgtcttcgcgctcccgctggcgggggctgtcgttcgtagggcgactgggggcggcttctgtgccgatactaccctcagtctcgctttgcgagacagcctccgctagcggggatcgattatcgacggctgcagtgataccaatgattcgcccggcctccatgtgcacgatgcgatcggcatgaacggtttcatctggatgatgcgtgacatgcacaatagtggtgccgcgcgcctgcaaatcatccaaaatgcgcataacttcggcgcgtgcggattcgtccagcatggcggtcggctcatccaataccagcattgccgggttcatggccagcatgccggcgatggaggcgcgttgctgctgcccgccgctcatacgggtcgggtcggactggcgtaagttcgccaaccccacggcctgcaatgaatcaacgatacgctcgccgatgagctcgcgctccagcccgagattctccgggccaaaggccacgtcatcctccaacacggtggtgaccagctgatcctcgggattctggaacaccataccgatgccgtggcgggcagcacgataggcatcggcattcgggccggctgcgtacacgcgttgccccagtaacgtcacttcaccaccgtccggcgcggtcaatcccgcaatcagacgggctaacgtggatttgcccgacccgttcggaccgaccaagcataggcgctcgccggcatggaccgtgagtgaaacgccatccaaagcccatgaggtgccgcggtcatagctgaaacgaatgtccttgagcacggcggcgggggaggcaggctcggcggaagcgtgaggttcggcagaatcgtggaactcgtcggcgtcgaaggaatggggtgcaacggtcatgaaacagcaatccgtaactgataggcgaaaacgcagaatcccggcccgtgccgggattctgcgttctggttctttgagtggtctttgagtggtcgttagtcgtggcgggcatcggcccgtctcaggccagtcactgctgcttggacagcaggttggagatcggcttgtagatcaggaaggtgatcacggcgtgaatcgccatcttagccacgttgaacggcagcagaatcggcagaatcatcgcggccacagcttggtaggtcatgtgcgcgtaaatcggcgtgacaatcaggttgctcaccagcgccaccacgatggccagcaccgcacccaccagaatgccgatggcggcacccttgcgcgtacggatcttacggtagatgaacgcggccggcacagacaggaacagcgccaccagcacagccatcagcgaaccccacggattggcgaacatgtgcggcacaaagccgagcacagacacgattgcggcggcggccgggccatacgcaaagccggcaatcaggcagacgatgccggacgggtcgtacttcagccaagtgaccggcgtaatcgggaattcaatgaagctggtgaccatcgccagcgccacgaacagtgcatacatggcgatacggcgcgtggaccagcggccagaatcggccacaccagtggtgtgtgagccaagtttggcgctggtactggcggtggacgtgctggccgaaccctcggcctcgggtgccacagaacgaacaacttgcatgcgaatacgcgaagatacactcataatgagccctcgtttcttccatccggactataccgttggctccggaatctcaccggatcagccgcttgcgcgggtcgcgggcttcctgccatccccgttatgaaacccggggtgcaggttaccgccagtaaggaattgcaccttccctgaaactgacaggcttattcatacgccatgcgccggacgtatgcaacccgcgtttcactgtgcagaaattcgtcttgtgccggtcaagtgcaacaatgggagccatggctgaagtgaagaaacccaacaacaccatcgacaagcttgccctgatcgtcaccacctacaaacgtcagcagttgcttgagacactgttcgattcgattctggcgcttgaacaggcaccgtggcgcattgtcatcgtggacaatgagcagtccgatcagacggcggacatggtcgctgcgtttgccggcaaggtgaccggccaatggggcaccaccgtggccgaccagtccggtaacgaagaacgtgtggtctatgcgccgcagaccgagaacctgggtggtgcgggcggtttctccgccggcgtggccaaagcctacgagctgggtgccgcatggttctgggtgatggatgacgatgtggccgtgctgccggacgccattgccaagctgtccaagtggaccgacaagcacgaggtgattcagggctcccgattcgactacgatggcggcccgttctactggcagtacgacttcattgtgccgctgggcatcccgaacccgattgcgcccgccgcattcggcccggccggataccgagtgatggacacgctgtgcttcgaaggcggcctgttcaaccgccgtgtggttacggaaatcggtctgccggacccgcgcttcttcatctactgggatgacacgatgtatggctaccgcgccagcaaggtcaccaacccgattgtggtgcccgacgtgatcctgcgccgtacgcgcgaaatcggcaattgggatatcgccggcgtgcgccagctcaactccacatccgacatgaaccggtatcacatcatgcgcaaccgcggatacatggcccggtacttcatgacctatggtgacttccgtccgctggtgtttggactgggtaccgtgctcaccgcggccaaggaagtcattcgcctggtgatggtggatcgcgagcacctcaagaccggtttggtacagattgccaagggctggtgggactcgcgcaagctgatgcacgaccccacctggaagctcatgccgtcgctgaagtagccgtagtagtggctcccctctatgagggggggtcactacaggttacttatggatgaacaggccaccgtcgccccaagcccactggccttggccggcaccgatctggaagtgcagcttggcgatgcccatgtcattgaacgcgtgatgctcatcttccgcactctgatcgatatgcgcggcggcggtatcgtcggccggattatacgagaaggtgattggctgacggttcatcgcgctcggcgccttcatcgcagcctcgacgccggacttgaaccaatccggagcggcctcgcgcccctcatcgctcattgtggcggtgaactgctcataggtcttggtggcgcggtgcgtgcgttgcgcttcgcatagctcctcataggatttcgcctgataatccagatgattcttcggatgcccgatcaccacaccgagatacagctcctggccagaggtgacgtggcaatgcttggccgcctccgccttgtcccatgagccggcgacccataaggtgccgaggccgcgcaacgtggccgtgagcaccatgcgttcggcatagaagccggcacgctctttggcttcctcatcgttcgcggggccgacgatggccagataattcgccgcattggtcagatgacctgaagcattggcttcggcgaacaccttgggctggtcgcgcaccagctgaatgttgagatcgccgagtaagttgatcggctgaagcgccatctcgagctggcgggccgtatcgtcgtcgatcggctcatcatcgtaggcgcgtacggcggtgcggatgttaattgcatcaataagttgggtatgttctgccatacctcccattatcgcgcgcgacacagagtcaggccaccatagacgccgatttttcctagtatgcgaaatcgcatgcattgcccattgtcaggcttgaaaaacgatacgaatagggtacgtagtgaccggcgacgatgcacacgtttgcacaattggtgtgtaatggtttcgtgttgagcgtaattcgcgttaaactgggcgcaaccttacgaactgatgaaaacgtatggaaaggaaggtcaacgatgattgaaactgcacaagctttcggtgttgacattggcggttccggcatcaaggccgcacctgtcgatctgaccaagggcgatttcgccgagccacgattgaagattctcactcccgaggtctccactcctcaggccgtggccaaaatcgtcaagcagcagctcgaccacttcgaagtgcctgaatccgcacccgttggcatcgctttccccgcgccgatcaagcccggccagaagctcgacttcatggccaaccttgaccagtcttggattggcgtggacgttactgaagtgttctccgaagcctgcggccgcccggtcgtcgtggtaaacgacgccgacgccgccggcctggccgaagtccagttcggtgccgccaagggccaggatggtctggtcatcgccaccacactgggcaccggcatcggcaccgccttgatttacaacggcgtgctcatcccgaacaccgaacttggacacatcatcctgagcgccaagcatctggacgccgagaagtatgcctcctccgcgattcgcgagaatgaggaactgggctacaagaagtgggccaagcgtctgaccaagtactacggcctcatggagaagtacttcaacccggacctgttcaccgtcggcggcggcgtgagccgtcagagcgaaaagttcctgccgtacgtggatatcaagaccccgatcgtgcccgccaagctgcgtaaccaggccggcatcgtcggtgccgcctactatgccagcaccaagcagcagtgagccagtgagcgtgggtgtgcagcgctgacccgcgaatatgcttcaggccgtccgactagtcgggcggcctttcgcattgcataggaaaggtatgcgacgcattcccgggaatgttgcgcaaagtgggcgtgtgtatggaggtctgtggcgacgcgttcccgggaatgtgtcgcgtttgagggtgtgattcgggtccagagcgacgcatttccgggaatgttgcgcgtttgagagcggggcagggggcaccacgctctatcgtgggagggtatgagcgtgcatttctcttctcgtgtggatatttctgcgccgaatcccattgcggcggccgaggcggcagccaaggcaaacggcatcgcactcagcaaactcaacgattccaatccgacccgccacgggctggcacctgaattggtgccgagcgtgtatacggccgacccgcgtggaccgcgtgcggcgcgagaagcattggccgcattcctcaatacggcaaaggcggtagacgcaagcagccctcagtcgacttcgcccgccgccagcgagggcgggaacgagcgccatgccgctttcaacaatgcgaataccgccatcgagggcgttgacccggacgccctgtacttgctgagctccacgtccgaggcgtattcgtggctgattaagttactttgcgatgccggcgacgcggtgctggcacccaaacccggctatccgctgattgagtcgattgcacggcttgaatgcgttgacacggtcgaataccagttgcaattcgacggctcctggttcatcgacatcgccgaactcgagcggctgctcagcgagcccggtggcgaacgcatcagagcattggtgctcatcaacccgaacaatccgaccggttcgtacgtaaaaccaaccgagcgtgcacgtatcgtgacattgtgccgtgagcatggcatcgcccttatcgccgatgaagtgttcttcgattactctctcgaacctttccccggcaacgcacggctcgcaggggagcgcggcgtgctcaccttcgccctagacggattctccaaaatgctggccgcgccgcacgccaaagtcgggtggattcaggtgtccggacctgccgaggacgttgccgaggcacagcgtcgactggacgtcatcgccgatgattatctgccgatgagtgacatcatcgccgaacggattcccgcattattgaacgccgcgcccgcacagaccagacgggtgggggagcgcgtgcgcaataacctggccaagttgcacgagttgcttgacgccgatcccaacgggctggtcagcgtgctacgggccgaaggcggctggaacgtgctgctacgagtgccttcagtcatcgatgagaacgagctggtgctgcggttgattgacgagcacaaactgaccggacagcccggctacttcttcgacatgacttccaatggacacctggccgtttccctgctacccgaaccggacgaattcgagcgtggcatccgcgccgtgctcaataccgtcgccgctttgctgcgataggccggtgtttgccggcaccacgcctgtactccacgtacaatagcggcatgggattcttgtttagaccgaaagaactgccacgcccggcgtcgctgacgttcactttggatcaggccgggcatacgtatgatgatgggcacgtgggacttgctcccacggacatcaccatcagcgagctgcgggtggctgtgatcggactgaacggcgcaggcaaatccacattgctgggtctgctggacggttcgttgaaggccaacgccggcacggtgaccattgcgggcggtgaggaacgtcttgacccggctgtgaagaaggacgcgaagcgcatcgataatctggtcggcaaagttcgccgcgaggagattccgaacagcttttaccaagcggcgaatatttccgaggctgtttccgaagcgctgaaaaagcacaaggtgcccgagtcagaacgtcatgcgcgcatcggcaatctgttcgcgcattttgatttggcgcaggtctccaaggccaaggccagcgaactggactccgagaaacggcacctgctggctattgcggccgcgctgagctttgagccgagtgcgattgtggcggatgagccgagcaagggattggatgagattggcgccgcgcatgtggccaaggcgttgttcagctacaacaagcaggtgattttcgccacgcatgacacggatatgatccgccggcccgaatacgccatcgaccgcgtactggtgctggacgagcacgcggtcgcgtttgacggagcgccggctgaggctgtggcgttttatgaggatctgattcgccgcaagtatgaggctgcgaagcggtagcagataggaatcggccgttggaggattggcatcggccgtgaggtcgatgccaatcctcacgcgaagtagaagccgcggaagccgtactggtagacgcggtagatgtatcccgaactgagcaccatcttgtactgtgccttgaggttgccgtcgtcatcgtagacgccgaacaggccctgcatgccgatgtccaccaggttcaggtcatcggacagttcctgtgcggaggagacatacggcgaatacggcacatcgaagtcctgcacttcggtgtaggttccggcgttctcgtcgaccaggtacttgcggaactgggagttcgagttctcatccttggagctctgcgcggtcgaaatgccatcgatcatggtccaatcgaaatcaggacgggtcatggcataaccgaagtcgttatcgaacatgtagatgtagtactggccgtcctccagcgaggaatcgtactgcacagtgattgagtgctggccgccggtgtcgccggaatcacccaccttggtcaggaaggagggctgcgcatccatgccattccatacgctcggctcgccgatcatgtagtcgagcgacggcgtgccttcgatgtcattgatcttgatcatcgtggaggtctcacgtgcggacagcaacgcggagccatcatccatgagctggatggtgttgaagtggatccagtcccaacggttcgtggcggtcggatcggattcgtcgatgccggaatgatcggtggattgcttgtaatcggggaacaggtcgccgaaatccaccagcaggctcacctcgccggagtcggtgtccaccttgatgacctgatcctgcacggcatggtccgaatgtttcagatcggtggccagagagacgatattgccgtcggaatccagcgcgtaatcatggtgcaggatgtactggtcgcccagattgatgatcttgaccagcttgcctaggcggttcatgccgacgaaatgcttggtggaggcggagaaccacatgatgccgtcattgtcgaacagcagacggtgcgagcggtagtagagcaccgggatttcgccgcgaatcacaccgttcgcgtcatagtagtacatgaaatcctgctcgttggaatcattgccgagaatcgcgtacaggccattgccgagcgtggtgaccgtggattcgtcgggggcgacggcctgttcgagccgtacttcctcctcgcgagcagtttcgggccggtctgctcgatggtgcgcgtggtggcgttgccgtcggtgtcggtgatggtcagggtaatggtgttcttgaccttggggatcagtcccaacaccagaaactcgtgctcggtggaggcgatgtcattgctcgataccgtggtcgtctgactcgccgtgctggtaccgccgacattgccggaaccgtcggcgtcgccggcggcggcctcacggtatgcggcggccgcctcatcgctggtgatggcgttggccgtgtaatccgggtacccctcagcggaaacggtgtagctgacggtggaggcctgatcggtggtgaagtacacgtacatggacgtggtgttggtgccgtacgggttcaccttggtgtagatgctgtcgactgtgcgttctttggcgtcgcgctcgtcggcgatctcggtgtccatcatctgctggtattcgtcggtatagacgttctcgatctgggcgttgagccgctccacgcggcgttccttgatggaggcgctgacgtcgtcctgtgagaacaggcacagaccaatggcgatggctgcggtgacggctgctgcggatattttgaagacgcgactacggacggcagtggacacggggaaaccctcacgacagtatgggtaaacgattagtgaattacgtcacatacattatgccgcaggtcttggaaaacaccggccggaatgctgggagaatactgaagcttggcgggtcgccgagcggtccggtcctatagcagggtgaaccaagactgaacctgatgccagagcgtcggattgttggcgatcatcgaatcgctgcgcgactgcacgaagcaacttagtatggctatgcccagcgcccacaatacggccagcatcacgacccagcgcatcagccaacgccacggagtgacgcgggcgatgccatcgcctgaagcggcgtcgttggcccccgccaatgagcggctcggttcgcgcccattgaccagccacagtagccccggtatggacgccagcgagatcagccagccgaaatcggcggaataccgccatcccaaaccgccgacgcggctgtcgaatacgaccagcaccgccgccacggccaagcaagacatcagccatggccgcatgccgtgtgtttccaatctgcgcagcaggggcagcgccaaagccatcaaggtcagtggcgtggccgtgaaaatcgcgccgaccatcacctcgtaataaccccattgcggcatcggggcgggagagcccgccagccacgggaaacgatccatgaagcgcagcggcaggaacaggtaataccagatgttggcgggcatatccgcggacggggtggtataccgggtcatatcggatatggagaactgatacgcattgccgaaattgaacggggaatcgaaccgaaccatgttccacgccatcagaggcgtcacgacgagaatggcgggaatgattaccgccagcggcgcgcgcaacgcctgcaacggcttgatgcggcgtgtgcgcagaccggtgcccagcgcgcgaatctgcggccagaacagggggaacgcaagcaatgcggccaaggtgaacgtcggtcggcatccgaaattcgccgcaatgcacaaggcgcccaaggccagtcgtggcagggagagaggcttggcatcgcccgcctgccatcggtccgatggtctcagcggacggcgggacgtgtccgcgccgagccatagccatagtcccagcgacgtcaacgtcagcgatgcggcgaacggtatctgatagaagttcgtgcgatacagcaaataccccatttgcgcgctcaccaacgatgagaccactactaacgacgcggccgccaccgaagtcttcggcatcacacgatggatgacgcgcagcaccagcaaggagaagaagatgatgaacagcagcacgagaatatactcggcggcggatgtcggcagattatgaccggccagcagacgataggggacgaacagcagcactgcgggcaacacgccaaaataggaataccagtgaccgtcataatacgcgtaatcccagtagagcggactggctccattggcgagtagctgggcacgtgtggctacgtcataggggtgctcggtggcggccagctgttcgggaaccggcaagtcgagccagggccggccggcgaccagcgcatcggccacatgcccatactggtcgaaatcataggtgtaatcgccggaaacgtggaagacgagcgaagacgtgtaccacagttcgtggatgatggatacgccgataagcagggtaggaatcgccagaagccccacgaaagcaagtcgttgccgagtgctggacgggtcaagcgtgatacgccacaggcgcgatcccggcctccagacggcaatcatcagcaacaccaaggccatggcgagcacgcgcatccaattgatgacgaacggtacgcgcacgttggcgcgggcgtcggtgaccggtacgatcgcgccgcgctcttcctgaatccaaatacgcacgatgccggcacccggcgccttgacataatggctgcgaatagcgtcgggattcatcgactgggccttgccggtgatgccatcgacatccgcgcgcacatgaatggtcgccagcggtttgaagacttccttatcgtcgttcgctttggattcggcctcggcctgctcgcgggccttatcgatgaccttgctgctctcggtatcgatgcgtaggtaatccgacgtgccgtccgcggtcagttcaagataggccttggtcggatcggtgacggtcaacatgccatcattccggcgcgtgagacccgaacccagcgtgttatgcacggcgttcgtatccgtgctcgctccgagcgtacgccagaacggcaggttgaacacgatgcactccatggcggcgatggcggcgacggcggccagcaaggcgatcagcaggcgcaccaaacgcagccggtgccgggtatccgggcggctgggcaggtgccgttcatgattcgacggcatcggacggtctgcgcgagtgtggtctatggaatgcacgcatttattctataggctttattcgggcttgatgtcgggcaaacaagagacaatgtgaatcatgccaaaacgtacatcggaccatgggaagcacaaccgcacgccactgctgggcgggctgaaggattcgatgaacgcgctcgcggccgatctgggactgtccaagccgaagaagcacgatacgaatccgttcggcgatgccttgcgggagatcagtgagcgtaaaggcggcattatcgacgaactgactcgccatgcagtggcgctgagtcctgtaatcaagcggcgcaccttccccgaattggagaacgtgccggaagggctggtgcttggatgggcgcagctgccctccaccagaggccgtggcttttcgcttggcattttccccgaccgcgatcattttgcgcaggtggcgttcgccgatacgcatggccgcgtattcgtgggcaccgaccccaacatggacgtgcaggatatgcaggcgcgattcatgttcggcaaggaaaaggaagtgactctgccggacggtgagcggctgggcgaaagcgacgagccgcgttcacgttccggtttctcccgtgcaggccatggcctgggaagtgcgctgcatcatgggcgtggtttggggcgtggccttggtcatggtgctgacggcgtgaaggccattaccggtggcgtggtggggcgtgacgacaccggacgcatgacgtggctcgcctcatggctcaaggccggcaaccggtacacgcttgagcagatgcgtgccaatctgccgcctgtgatgcgtcatgatttggaataccgcgatgccattaccatcgcgttcttcgccacgtatatgttgccgcagatcaatggtctgctcatcggattcggttccggcaatatcttccgccgtctcaaccgtgaggcgccaatcggtgcgattcgccgttcggtgcgtgacactttggcggcacgagcccacggcatgcgggcctccggtctggaggatcacttcgccgatctgatgcgcgaagccggcgccctcgacaccacgccgggactggaagcggtgcatggcgccgaaccgttgcatctgtacacctcgacgtattcgagcggctatttctttacgtgggataagtccttggcattcgggcaggcgctgaaatccttgaagatcgaaggcaacctcaaccgattcgctgcggtgagcgcttggctggagcgcaacgcttccttggggcgcaaccctacggaagatacggtgacccgtgccgaggccgcgcaaatcgacatgaaactcattgagaaccctgcgattatggcgcttgacccgtatgatggcgagcaggagcgtcgggccgtgctgagcctggtcgatatcgccgcacgcacggctgggcagattcgcagtgaattccctgatcctcgagatgtgctgacccagcagaacgtgccggattcgggtgtgacgaatgctgcgggcgctgaaagtactgagagtgttgagggcgctgtagagcggaccaataagagcgacaccaacactcaagccgctcggccttcgtgctcgccggcgaggagcgacgaatgggtgtatcgtcagaccctctcctcactgttgcgccggttacggttgccgtatcggtttgatgtggagttccggtcgcgcttggattcgggtgaagtggccattggcttcaccactgccggcacctcgatgatgcccgatagccggtatgacaccactcgccgtacgtggcgtgcgctgagcagcgccgaacgcgcgtcgatgagcgccgcctacaacctgcgtgtcggcctgatgatggcagcgctgagtttcggcaccagcgaatccgtgcgccaggtgtcgttgcacatcgattccattggtcttgaagaggcgattgccgaacaggattccgccatcgaggcgatgatgagcgaggccctaagcgccttcgaacatctacgcagtggcgatttggggcgtgtgggttccaaagccgaccccaaagatggtgatttccatggcgacccgacccgccccatcacccatgaggagacgttcgggcagacggcgtccggtgacgaacgcggcacggccgggggagcaggcaacggtaccggaccgtctgcggatgctacggatcaggccgcggccgaatctgctgacgccgatggcgctgcgtccatcgattcgcagttcgaagacctgatgaagggcatcgatatcgacgaaatggcgttcggcatgccggacgatactggcgcaggcgacgacctgggcggtatcggcggcgagggcgtcggcactgacggtgctgatggggccgccggcatggacgatgatccgatgagtgtgctgcgccgcaatcccaccgtgcgcaatatggtcaccgtcaccttcacccgtgatgccttcctcaagcgactggacaccgctgggcttgacaatcccgaggaaacctaccgcatgttcggtgccgtgatggacgtggacggcgaaggtggtctgaaacccatcagcgccgacttcgacttggcggacagccggttctctcccaccggatcccaggaggagcccgaactggccgaccgtcaattcagtccggcgaccgctcacgtgctgggcgcacagaatagtgccggactggctatccagcgagtggacctgctgcagcatggcgtcaacgaattccacgatatcgccaggaacacgtcgctcggctccgtggaaaaggcccagcgagccatgcaggtcatcgaatcgatatgcgatcccgaactgaccggtttggcctctcaggtcaccagtgcgttgatcgatggcaaggacacgccggacttcacgttcacgcttgccgacgatcttgacaaggagcgtctgcgcgcccgagatatgctgttctcgggccaagccgatcaggccatcgaagcggccgaagcggccgtggcccatttggaccaggtgtatgcggcaggccatggcgtacctcgatacttcaactcctatgccgagcgcgtggtctacaaccggctgttcgccacattggacgagcgtacggtgcttatcccggacaatctgttctacgcgcacatggagctggctgacgtgttgagtcagatcaagggtgccgaggcggccatcccgcatctcaaccgtatggtggcgtacgcgcccgcctacccgctctcacatctgaagctcgccattcaactggcccgcaatgaggattgggattcggcacgcgccgcctgcctgaatgctctgcgcgtggccttggaccgcgacgatgccgcgttcgcctattaccggttcgcgtacgccgaatggatgcttgaccggttcgacacagccgccgcagcctacattatgagcgatcacatcgctcccggggccattggttcgctggaaagcgaactgcaggaactggtttcccgtgcggactcgcagtgcataccggtgcctgaatcggtggaggccgccgcccatgtgcttgccacgcatgatctgccggtctggccgcatatcgaagtggctgacatcgtgcgtgacgccgctcgcgtgtgcgtggatgaggacatgttcgtgccggcccgcacgctctcggtggctgtggcccgcatgaatgacggcgaaggcgataacatcgacatcatccaagcccagttcctgcgctcgctatccgcgtagccgcctgaggggagttgacggtatagccggccgaggggagccgagcccgctaggatagacaaccatgagcacgaacgaacaactggcatgggatttcgacgatggggatgtggccgaggtccggcctgataccggtattgcacgttttgcccctggctccgaacaatggatagccgcactgcagcccactgacgacgacgcgatacgcctcgaccgtttcgacgtgaacacgatgaccgctgaggccgccgcccgcctgtgggctcgcgtggccgcatgggtggaatccgatcagatcgcctactacatcgacgactcacccgtcagctccgacgccgcttacgacgcgcgcatgcgttgcctcgaacgactcgaagcggcgttcccctcactggacaatccgcagtcgcccacccatcgcgtcggcggctccttctccaacgacttcgcctccgtgcgccaccccagccgcatgatgagccttgacgacgtcttctccatcgaagaactcaaggattggtacgactcggtgattcgcgacctcgattggcctgaatccaagcccctgcccatgagttgcgaggtcaaaatcgacggcctcgccctgaacctcatctatcgcaacggcgtgcttgaacagggactgacgcgcggcgacggcgttacaggcgaagacatcaccctgaatgtgcgaaccatcggctccattcccgcaaacctcggcggccccaaggaagacgttccggacttcgtggaaatccgaggcgaagtgttcatgcgttgggatgatttccacaccctgaacaacgagcaggaggacgccggacgagcgcccttcgccaacccacgcaacgccgccgccggctcgctgcgtcaaaaagaccctcgcatcaccgccacccgtcgcctgagcttctatgcgcatggtctggggcagctcacttgggggccggaccatccgcgcggcacccatgatgtggtcgccgaccagtcgcaggcctacgatctatacaccaagtggggcgtgccggtctccccgcacaatcgtgcggtgacctcattccaggagatcctggacatgatcgagtactacggcgagcatcgtggcgacatcgagcatgcacttgacggcatcgtcgtcaaggtcgatgacctgggcctgcagcgtaccctcggcgccacttcgcgcgcgccgcgctgggccatcgcctacaaatacccgcccgaagaggtcaacaccgaactgctcaacatcaccgtgcaggtggggcgtaccggccgtgtgacgccggtcgccgtgctcaaacctgtctacgtggccggctccaccgtggctcgtaccacgctgcacaatggatttgaagtcaaacgcaagggcattctgatcggcgacaccgtggtggtgcgcaaggccggcgatgtgattcccgaactggtcggcccggtgcttgaacggcgcaaagggcgtgaggaccagctgcgcgaattcgtcatgcccgagttctgcccttcatgcggcgcgaaactgtcacccgccaaggagggtgacaaggacattcgctgcccgaatgtggagagctgcccggcccagttgaccgagcgcgtgatttcgctggcctcacgcaaggcgttcgacatcgagcacttgggcgaacaatcggccatcgctctgaccaacccggaggagaaccggcctgattcggtggcgacctacgcgccgaacatcaccgaggttctggtcgcccccggcgaagagcctgacccgtacgagccggtggaagggctggaattgccggccgcgcagaagccggtgttgtctaacgaatccgggttgttcaacctgaccgccgccgatctgcgcgacgtgcgcgtgtggcgtgaggccgcaatcgtcgaggtgcatgagacggtcggtgcgaacggtaagaagaaaaaggtgcgtaagcgtgtcggcggctctggcctgtggcatcaggtgcctgctttctggaccgcgcccacgccggccaaaaagctcacggccaagcagctggccgaacgcgcgcaaggggagaccgcaatcgaatctgccgaaacacagggaggtaccgccagcgagacgaccggcgcacctaccggggctgaggcgccacttggtactatgccgggctttgccgcagcctcctatcctgagtatgacgtgccggccgacgcggttatcgtgcgcgtggatcacaagaccacgcgcactggcgtcacggatgtaccggtgatcattcggcccggcgaaaacacgcgcaagatgttcgacgaaatggacaaggcccgtcacgccgacctgtggcgtgtgctggtcgcgttgtcgattcgccggctcggtccgcctaccgcacgcctgattgcctcggcgatgggctcgctggcagccatcgaaaacgccacgattgaagatctgacggccatcgacggggtgggcccggaaatcgccgaatcggtggtgaactggttcgccgccacccgcgaacccggcgactggcgcggcgcgactttgcgtgcttggcaggccgccggcgtgggcgtcgacgaggccgagaccagttcgttgccgcagacgctggccggcaaaaccgtggtggtcaccggttcattggagggctattcgcgtgattccgccaaagaggcgattatcgagcgcggcggcaaggcggccggttcggtgagcaagaagaccgattacgtggtgattggcgcaaacgccggctccaaggccgccaaggccgaggaactcggcatccccatgctgagcgaaacccaattcgcccagctcctagccaccggcaccatctaaaatagccccctcagacgcttcattaaccccctctgatgagggggctgtcagcctttaggctgactgggggagagaaaaagcgaatcccgccccagtgtgacttactccactccctctggcatgccgccgcatcacacgctagggtagaacaggccctaaaggaggatacggatttatgagcgacgcacgtcagatcgaagccgacatctacgaacgcctgagcaaggtcatcgaccccgagctcggtcgttcggtcaccgacctcggcatgattgccgccatcgaagccgcgcccgcatcgtcggacgccggcacttacgacgtcaccgtgcacgttgagctgacggttcccggatgcccactgagcgagaccatcaccagccagatcaatggcgcggtcagctcctatccgggcgcacagctgctgcctcatatcgaagtcggttcgatgagccgtgacaagctggccgatctggtcgccgacctcaaggccgaacgcaagcagaaccccttcagcaaaccgggtgtcaagacccgcatcttcgccatcgcctccggtaagggcggcgtcggcaagtcctcggttaccgcgaacctggccgccacgtttgcggccctcggcttcgacacggccgccatcgacgcggacatttatggcttctcactgccgcgcctgttcggcgtgcatacacagcccaccaatctgaatggcatgctcatgccggtcaccgcgtggggcgtgaaactgatctccatcggcatgttcgccggtgctgaccgggcgattctgtggcgtgggccgcgactgcagcgctccttggaacagttcctgtctgacgtatggtggggcgagccggacgtcctcttgctcgacttggctcccggcaccggcgacatggcgatttccgtggcccaggcgctgcccaacgccgaactcgtggtggtcaccaccccgcagccctccgcttctgacatcgccgtgcgctccggactcgtggccctgcaggtgccgatgaaggtgcgtggcgtggtggagaacatgagctactacgagcacaagggcgagaagctggagattttcggtgccggcggcggtcagcgcgtgtctgaacagctcactcaggcgctgggctatgacgtgccgctgatggcccagctgccgctggaacccgaagtgcgcgagaccggcgaggccggccggccggcggtgctggacgccgacggcgctttgcgtacggatggcattggccagaccttccgagggttggctgaacggctgttggcagtgtgagcctgcgcagcctcacacttttgtaggcggcgttggcgtttaagtccggttcgctgctggtgggcgaatcgcttgaccacagcacccgcgacctggtggtcgaggcaatggagcgcactgtcggcgtggataggctcattaacctgcaggccattcacatggacgaggacgccgtgccgcgctgccttggtatgaatgggagatctacgttgagcccgatatctggcgggtgcctcgcagtaaataacggcatagcgcattgtcggtgcgatgctaagaggtaatggcccatgagcggttccaatcggcgagattgcgttgccgggacaccacgacatgggccatctcgataaaacgatgccgcgtgtcggctgttctcaggtcatccgcagtgacgagaatgacgatccagccgagcagttgcaatgcgtttcgctttgccgcgtcgattcgcatttgtgccggatcggcgtgataggctccctgatattcgaacgcgacgcggcagtccggatatgccatatccaatatgacgtatgagttgccgatattcacgcgatagttggcggtggggcatcccaagcctgaatccttcagcatcccaaacagcgtgttttccggcggagaatccgtgttctctgtcatgtagggcagtgcctcgtggcatttgttacgacctatgaaccgcggactgatttccaagtaagtatcgaaatccttgcgagtggccattctgcgccgtttatcgcggctcatcaaagaggctccaatggccgcaagttcctccaatgtagagtattgggccatctgagcccacatcatgaccggcgaggcaatccagaactgttcataatcctttttgcggatatccagttttcccttaaacacatggaagaccacgcctttgattcgtctgcgtttgttggcactggaaacacaggcgtgcacggcatcaacagatagcgtgcaatgtcgggggatgggcgcgccgtagtagttggccgcattgatgtatcccaccagcaatggacctttcgaacggcgcgcagcatcattgcagcgttcacgttctgctcggcgtcggccgacaatatcctcatgcataaaagagctcatggtgcgaccgtaaagctgatttggacttgaatgcaagccaggcagggcaatgtggttccagcttatggagttatccacattgtctatttgcgcagagaacggttctcagtagtatctgtgcgctcaaatgaacaagaacataacaatctcacatcatcgcaaatggcgacatggcagtgattagggcatattccatgtgtgcttcgggcgtagagaagtgtgcacagacattattgagaaccgttctctgcgcgcctatctggctacgacctcggtgggcaggagccccgtgcgctggaacggccggtcctcgatctggtcaagcactagggtagccaagctgacgccgaatgcgtccattggctggcgcacggtggtcagctgcgggcacgctggcgtcggcgtcgacgtcggcaagtacgacggtccgatgatataggcgattcgtcgatacccgcgccccaacatatgctcggtgagcttgcgtgaagcgagtcggttgtcgatgtcgacggtggggaaggggtggcgctgccatagccgacgccggaaatggcgactggcacgctgatattggcgaatccctgaaatagcgggtcgtccttatgaaatgtgttgagaatccacgggccgtatcgcatggcgcagcgcagtctgcaccgccccgccgccgaaccaaccccggcaagatcgcgcgccgcgccggcaccactatcctcgccctgctgttctgcgtcgtatggttcttcccggtctactggatgattatcaccgccgtaaagccgcgcgatgagatcatgaccacgacccccgtgttctggcccatgcacctctcgatcgtcctgtcgattattgtcgcgttcttcgcgtgcacggccctgaccctgtaccgcttccgcgggcgcaagccgatcatggtgttcgtgctggccatccagatgacctctggcggcatcatcccgcagatcatcatctacaaccagctcggcctgctcaacaaatacagcggcctgatcctggcgtacatcgccatggtgctgccgttcgcgatctggaacatgcgcgggttcttcctgaacatcccgaaggacatcttcgaatccgcggccgtggaaggcgcgaacgactggcagatcctgtggaagatcaccttcccgctggccgcgcccggcatcgtctcgacctcggtgttcgcgttcatcaacgcctggaacgactacatgatcgcctatacgttcatgaaggaccagtcgaagtacacgctgccggtatggctgtcgtccttctcgacacccaccatgggcaccgatttcggcgggcagatggccgcttcggtgaccttctcgttgccggtggtggtgttcttcatgctcatccagcgcaacatcatgaagggtgtgacgaccggtgccgtgaaatagcgtatgccgccgtacctcaccaaacgattcgtccgctgatggcggcgtgaccgcgtgtcgcctgccgtcagcggatgaacgataataaaaacagtatgaaaggaacagctgtgcccacattcgaatataaggctgatgccgcaacgccgtgtctcaccctgattcccgctccggtgacattggaatacacgcatggcacggctatgatcgggtccttggtgacgatcgagaaacgaattcccgaatatgccgtcaccgaagatgccgatgagacctgggaaacgctgccaatcgagcagctgtccagcgaactcgagcgttactgcggcgtcgccgtccgtacgcgccgagtcctcacagccacagatgaagccgacgccggtgccaatgccgccgaaaaagcgcgagatgcgggcgtgggtgcgggtgcgggcgcgggtgcgccggcagcgatgaacggcaccgtcatatcgctgtgtgtggatgcgcgattggcgcatgacgaatacacgctggatgtgttcgcctcagataccatcgccgtgcgtggtggcagcgaaagcggattgcggtacggcatgcagacactgcggcagatgatcaggcaaacctcgcggaccttgccctgcctgcatatccaagacaagcctgcgttcgcggtgcgcgcctacagtcttgacgtgacgcgcgggcgtgtgccgacgatggcgttcctcacctggttcatcgaccagctggcgttgtataagtacaaccaattccagctgtacgtggaacatgccttcgctttcggcgagctcagcgaggcgtggcgcggcactgacccgctcacggccgacgacatcatgttcctggacgaatactgcgcacaccacggcatcgaactggtgccgtccttggccactttcgggcacatgtatatgaacctgcgcacccgtgaacatcgtggactgggagagttccccgaagacgccgaccgtccgttcagtttcatcgaacgaatggaacaccacacactgaacgcagccaaccccaagtcgcacgatttcgcctcgcgcctaatcgaggaatacgcgccgctgttccgctcgcggtccttcaatattggtggcgatgagactttcgacttgggccgtggccggtccgtacaggactcgccgggcgccagtcgcgatgagctgtatgccgatttcgtcaaagacctatgcagcacgcttgcccatcgtggtctacaaccgatgctgtgggcggatatcgcgctcgagaatccgcacaccatggacttgctgccaggcgacatcacgatgctcaactggatgtatgagccggatatcgacgaaagcaagatccagaccatcgcatcacaaggccgccgccaattcgtgtgccctgccgtgcgtgcgtggagccggttcttccccgactatgacggtgcctggctgaacacgtaccgcatggcggtggccgggctcaaatatggtgcggaaggcatggtggtcaccgattggggtgactatgggcatgtcaatgatccgcggttgagcgtgccgggactgtgctacggtgcgcaaaacgcgtggaacccggttgcaattgacgcatgcgaaatgaaccatcggatttctaatctggcgtatggcgacgaatccggttggcttatggattcactcgctcgcatcgactccgatggagtgtcgttcccctgggacctcgccgtgcaagtgctggaactggaatacggttccggcaccggcatgctgaatacggatgtggcatcatatgtggaacggtcgtgcgggggagagctcatgtttgaccgtgcgctgggatgcgccgacgcgcgccgccgattgctcctgcggaaccatgcccgtctcgaacgacgccgggattgcgaccgggcgttgattgattgcggcagtgcggttgtcgcggtgctcgatggctcggcacgaggaggattgaacccggagctgctgtgggtgatgctggatgggcagcggttgttcaatagactgggtgaggaactgctggtattggctggcggcgaggacgcctgtggcaccaaggatgtgaccggccgtgcgctggatacctcgcgccgcgcccgtcttgccgccgatttggagttgtggttcgaacggtaccgtgtgcagtggctgtccatcggccgttacgccgaattggcgcgtatcgcccatgtggtgtggtcgtttgcggacatattgcgtaggggagcgctataggggggctcgcagaaattcggtcctgctgagaacaatgtgaggcttacgcgccgtcaaacgcacatggtgatttcaaaaatggcgaattgctgccattcttgcacctgtgcgtttgatgggaaatgtgcgtatgcctcacattttttgcataaagcatgaaaatgtgtgagaccggcgtcaaggtcgaattcgagaagaaggccttcgaacagattcgccagaacgcctcccaggtcctcaactccgacgacgctccggacgttacggaatacaacaagggcaacgccacgtccggcctgctcgccagccaaggcctgctcaccaacctcaacgattacgtgtccgaatatggctgggacaagattatcaccggttccttggccgacaccggcaagtacggtgagcaaggcgtgatgggctccggcgactggtgcggtatcaccaccggcgcggtgaagtaaggtcattcgcacaacaggcaattcaatcaacaagcagtacatattggttttggtttcggccgccttgttccctggcggtcgaaaccacctctccaccaaggagcagcagcaatgaagttcaccaacggctactggatgattcgtgacggcgtcgacgccctctacgctcgtaagcctacgaactggcggcggatgccaccaccgaaagcctcaacgtcctcgccccgacctccgtggtgcgcggccgatacgataccctgaacctgcccacattcaatgtggacatcaccacgccggcagaaggcgtgattcgtgtgcgtgccgaacactggcaaggcgccaccgaataccccggattcccgctcaatgccgacgaacccggcaaccgtgattacgtgaccgttcaggcgaacggcaatggcgacggcgaagtcggcgtcaatggcgcggacgtcacgctgaccactggcggacttaccgcgaaggtcgtcaagggcaccccctggaacctgaccttcatcggcgaggacggcaaggtgctcactgagtccgcaggcaagtcgctgggccgattcaagctcggtgccgaatcgaacgtcaccgcccagccggtcggcgaattcggtgtgaccatggacggttccgcccgtgatgaatccgacgtgttcattgccatccagctgcatctgtcggttggtgaagacgtgtatggcttgggcgaacgcttcggcgcgtacgtcaagaacggccagagcgtcgacatctggaatgaggatggcggcactgcttccgaacagggctacaaggacatcccgttctacatgacctccaatgggtatggcgtactggtcaacaaccgcggccatgtctcctttgagatcggttccgagaacaccgaggccgtgcagttctccgtgcccggtgaggccatcgacttctgcgtgatctatggccccacccccaagcaaattctcgaccgctacaccaagctcgtcggacgtccggcgaatgtgcccgcatggagttacggtctgtggttgaccacctcgttcaccaccaaatacgacgaggccaccatcaactccttcatcgacgatatggccgagcgtgatattccgctggccgccttccactacgactgctactggatgcgcgagttccattggtgcgatttcgagtgggacaagcgtttcttcggcgacatcgaatccacgctgaagcgcctgcacgaagacaagggcctgcacatctgcgcttggatcaacccgtatatcggccagcgcggcgaaatgttcaaggagggccgagacaagggctatctggtgcgcaagcccaatggcgaagtctggcagaccgacttctggcaggccggcatgggcttggtggacttcaccaacccggccgcccgtgaatggttcaaggacaaggtcaaggcgttgctgaatcagggcgtggacgccatcaagaccgatttcggcgagcgtatcccgcgcgacgtcgtctggtatgacggctctccgaagctctccatgcacaactggtacacccagctgtacaaccaggccgtgttcgaagccatcgaagaaaccttcggcaagggcaacgcctgcctgtatgcgcgctccgcgacggtcggcggccagcagcagcccgtgcattggggcggtgactgcgagtccaccttcaatggcatggcccagtccttgcgtgccggcctgtcgctgacctcctccggcttcggcttctggagtcacgacatcggtggcttcgagggcgcgttcccggatccggccgtctacaagcgttgggtggcgttcggcatgctcggctcccactcgcgactgcacggttccaccgtgtaccgtgtgccgtggctgttcgacgaggaggacgagaagaacggcgtcgcattggtgcccggccagaccgccgtggatgtggtgcgcgagttcaccaagctcaagcttgaactcatgccgtatgtctaccagcttggcctgcagcctcatgtgaacggtactccggtcatgcgttccatgttcgtggagttccccgatgacccggcatgccgcacgctggaccgtcagtatatgttcggtccgtccatgctggtcgcccccgtgttcacctactccggtgaggtttcctatcgattccgctgtgggtgcgcgatagcagcgtaacgacatgaacatttcagcgtggtgctgtaacacttcggtgttgcggcaccacgtttttgtgctgatatggggatttgtactagtcgaatccgcgaaatgttcagtaaatgttcacgtagcgaaatcggcatagaatgcgagcaaacgcataacggcacggtgctgttcatgtgtacaccaacgccagacgaaccgccggaaagaaggggtctccgtgattgagacagtggacgatatcaagacgattgcgaacgtcggcacgggaaccatgggccacgcgatcacgttgcagttcgcgttggccggatatccggtgcatctggtcggccgcggcgaggcctcgctggagaaggcgatgaaggcgattcgttcggatgccgaggacttcgccgaagccggactgctcaaggatggcgacaccgtggacgcggtgctggcccgcatcaccggttacgccgactatgcgagcggcgtggcggacgtggacttcgtcatcgaatccgtggccgagaaccttgacatcaagaagtccgtctggaccgaagtggagcacgccgcccccaaggacgcgattctgtccacgaacacctccggcctgagccccaccgcgctgcagtcggtgctgaagaagcccgaacgcttcgtggtggcgcacttctggaaccccgcgcagttgatgccgctggtcgaagtggtgccgggtgagaagaccgatccgaaggtggtggacatcaccttcgacctcatggccaagatcggcaagaagccggcgaagatcaagaaggaatcgctgggctttgtgggcaaccgcctgcaactggccgtgctgcgcgaggcgttctacatcgtccagcagggcatcgcggacgcggccaccgtggacgacgtgatgaagtacagtctcggccgtcgctggaatctggtcggccccctcgccagcatcgacctcggcggcctcgatgtgttctataacatcagcacttacctgttcgacgatatggacaacggcaccggcccgagcccgctgctcgccgagaaggtcaaggaaggcaatctcggcgccaagaccggtcagggcttcttctcctggcaaggcgaggacggcaagcgcatcatcgaaacccgcaacaaggccctgctgcgtgccctgaaggacgacgccgcggatgccgccgctgcgcaggcgtgaggcacgaatgacgaatgttcgtgcgtgacgtatatcacgatggaaggctcccctcaggggagccttcgttgtacttacgtcgttctctgatttggctcatcggcatgcgtatgcgtcgccgatagcgacaattgcggaaacgcttacagtgtgatgtgcacacggacaacaaaccgatacacgcaaggatcggtgacgacgatgacatccacagaacacagcacgcgagccgacatgctggcccatttccagtgtgccgtcatgcatgcactgcttcaatatgaggtctcgctgggcgatgaggtcgtcttcgatctggtcacgcacgtcacgcacggacgagaaatacaggtagaacgtggcgtggttgtagccggcgagttcggtgatctgacgcaccgagatcttctcgatcggcttggtctcgtacagcttccagaacgcctccttgaggctcttgaccgtctgctgcgtaagttgcgggttcttcttgattgcgattcgcggtatggttattgcgcacaaaacgcacaatcccatcgactcgtcggtcaagttcgtgaccttcatcgacgcgatgctctcgctggtggtcacgcaggacgtgcttttggaatcccagggaaccgcgcacgcggcgcaatcctcgggactgttcggcatcgggcttggtgcggtgaccatgatcatcggcctgtggatgctgctgcggcggcgctggacggtgccggcgtcgggcgaagattccccggacgatgccgttcctgcagtcgagatcacggctgaaaccgaggcgtagggcgtcgcaatgcctgtttacaatcgacccgaatggtctttgtggtgagaagaggcatatggtgaggctgccgacgttgaacgtgaattggagtcgcgatcgggtctacgcgattcggcgcggagtggtcgcctgctgtatcctgttctgcctgatcggcgccggagtcgagaccgcggcggcgcagcgcagctggccgcgagccgacaccgcatccgccgccgcaaccgcagcggcgaacgagcccacggccgttacccgcaagcaggttcccgatagcggcaaacagggcgggtcgcggaagacgcagaacacgcagaacggcgatgacaaagccgcgcaaagcgtggactggaaggggccgaccggcaaacagcccgacctatcccagtactccgacctgagcgtggaggtcagtctcgccaaacaacgggtgtacgtcaagtccggtggccagaccatttatacgatgatcgccagtaccggcgtcgacgacgccaccccgcacggctcgtacaccatcgatacgcgcggcgaacacttctacaatgccgaagaaggcatgggcgccgactattgggtgcagttctacggttcgtacctgttccactcggtgccgaccggcgaggccttcggcgactatctgccggaggagggtgccaaactcggccagcccgcctcgcacggctgcgtgcgcctgactgtggccgacgcgcaatggttctatgaccaggtgccggacggcacgctggtcaccatcgcgtagggtggtctctcgctcagtctcgttgcgttcgacagctccctcgtcagagggagcttatcagagggagcttagctgattagcgcgcttcgggcgggcggtattggtcgtcggtggtgaagcaggtgcgatagaccatggccatgatcagaccgtcggccagcaaggtcagcgcggcgatggcgccgaagaccacgaactggtatttggcggcgttcagtggatctccgccggctatcacctggcccgccatcatgcccgggatggtcacgatgccgctggaggccagcgaagcggtggtgggcaacagtcccagccgaatcgacgagatgacggatggacgggcggactcccatgccgtcgcccccaaggccagcatcatatccacctcgtcgcggcgttcctccatgctttcatagaatcggctcagcccgacagcaagcgcggaaacggtgttgcccagcagcatgccggtcagcggcaccaccagctggggcgcgtaccacgggtgcgggcgcacgatgagctcggtgaccagcgccagcatcagcagcatggtgatgaccaggctcaggaagatcggcccggcaaggcccttggggatgccgcgtgcgcgggacatcacgatctgcacggccgccaccagcatgaccgccatcagggcgaacaccatccacacgctgttcgaacgaatcacatagctgatgatgaagcccatggcgcacagctgcaccaatgcgcggcacgacgaccacatcagggtcttgccgatgcccatatgcatgagttcgctgatgatggccgccacggccaccatgcccagcgcgatgagcagaccccagatatcgatgttgtaggaattgcccagatcgccgctcatgcctgcgtctcctcattttcatcggcgccggcaggcaccgcgttcgcgtcctgcgccgccgaatccgtcatctcgcgttcggtcagccgccccttgtccagcgtcagcgtgcgggtggcccgtccgtccggcgggcggtggcggatgcggatgatcgccatgccgcgtgtggcggcatccgccatgatcgtagccaccttggccgcgttgtcgtcgtcgagaccggcatctacctcgtcggccagcagcaccttcgggtcggtgagcagtgtgcgggccagggccacgcgggccgtctgcccgccggacaggtcgtgcggggcgcgctccagatcgatgtcctcgcagcccatcgcgtccaacgtcgtgcggatgcgctcgtcgggcagcagctgctcggccttgccgcccttgccgcgaatcgcgagcgtccagggcaggcggatcgcctcggccacgttcttgcccgtcagaatcggcttctgcggcaggtaggcgacatcccgccgccactgctgcggcgtgaactcgccgctgcccttgccttcaagggcgaacgtgccgtgcgcatgcgggttgagccgggcgcacgcggtcaacagactcgacttgccggagccggacggtcccaccagatcgacgatctcgccgcgctccacagcaaaggacaggttctcgaacaccgtgcgttcgtcgtccgccggcgattgcgcggggatgacgcaggacacggatatggcttcgaagaaggatcgcatattcatccagtctagccgggggcacatgggaaaccccagcgttcacttcctgtatacccggtgtggcataatagccgaggcaatttttgggctttgcctaagctagtttgaatttgaaataggtgaataacgtggcacagactactaacgacatcaagaacggatccgtcctgaacctcgacgggcagctgtggaccgtcatgaagttccagcacgtcaagccgggcaagggccccgccttcgtgcgcaccaccatcaagaacgtgctctccggcaagatcgtcgacaagaccttcaacgcgggcatgaagatggaattcgagaccgtggacaaccgcaccctccagtactcctacgaggacggcgacaacttcgtgttcatggacatgaccacctacgaccagatcatggttccgaagaccctcgtgggcgacaaggccaagttcctgctcgaaggcaccgactgcctggtctccttccacgacggcaccccgctgagcatcgatctgccgggctccgtggtcctgaccatcacccacaccgagccgggcctgcagggcaaccgctccaacgccggcaccaagccggccaccgttgagaccggagccgagattcaggtcccgctgttcgtcaatgagggcgaccgcgtcaagatcaacaccgaggacggttcctacaccggccgcgagaacaactgatctccgcatcctcaacagacgaccgaccgtataaaggactaggacagcagcagtatggcacgttccaccgcgcgcaaaagggctctgaacaccctgtacgaagccgacgaaaaaagccaggatattctctccctgcttgacgagcgcatcgcacatcccggtgcccagaccccgcttcccgactatgccattgaaatcgtcaagggcgtggccgaacaccgtcgtcagatcgacatgaccctggacgaacactccacgggttggaaggtccgccgtatgggcgtggtcgatcgcaacattctgcgtatcgccgcttgggagattctgttcaccgatgatgtgccggacaaggtcgccatcgacgaggctctggcattggccaagaccctgtgcgatgacgattcgcccgctttcatccatggcctgctgtctgcggtgtgcaccgccaagaacgcagcaccggcaccggagtccgtggcagaagaggccgatgaggaatcgtccgattccgctgccgccgcatccgagccgaccgatgagggcgatgtttccgattcgcccgattcgtccggtgcatccgacgagcctgctgccccgtccgctgagattcagccgacggtcgattagtcatttgttgttcagcctccccattcgggaggctttttcatgggcggacacttgtgccgccgtacattctcaagtcggcaccttgccgacagccccgccagcgggggtgagactttgcgcccaacggcgtgtgagtctgcgctggccgttaaccttggtacgaatacccgaaaagcataagggggttttggtgagccagaacgagtccgggaccatcgcaattccgatgtatgacaaggacgatgcagtcctcgttttggaagacggacaggtatatgtgggggagccatacggcgccctcggcgagacgaccggtgagatcgtcttcgccaccggtatgaccggataccaggagacgctcaccgatccgagctacgatcgccagatcgttgtgcagacgttcccgcacatcggcgataccggcgtcaacagcgaagaccctgagtcctcccgcatctgggtcgccggatacattgtgcgtgatccctctccgaacgtgagcaactggcgtgccgaaggcagcctggacgacgacctcgccaagaacggcatcgtcggcctgagccacatcgacacccgcaagctggtgcgccacctgcgttccgcaggcgtgatgcgcgccggcatcttctccggcgacgccctgaccgatcaggccaccggcgcgctcaagaccatcgagcagctgctcgaagacgtcaagaacaccccgcagatgcagggtctgagcctgtacgacgaggtgtccaccaaggagacctacaccatcgaaccgtgcggcgagtacgaaggcaaggagccgctgtacaccgtggccgctgtggacctcggcatcaagggcatgaccccgcaccgcatggccgaacgcggctgccgcgtgcacgtggtgccctccaccatcaccttcgccgaaatcgagaacctgaacccgggcggcgtcttcttctccaacggcccgggcgacccggaacaggccggtcccgaaatcgagctgctgcgccaggtacttgacgccggctacccgttcttcggcatctgctttggcaaccagctgctcggccgcgcactcggcttcggcacctacaagctcaagttcggccaccgcggcatcaaccagccggtcaaggatctgaccaccggcaaggtcgaggtcaccgcccacaaccacggcttcgcggtcgacgccccgatcggcaagcaggtcgacgcgccgtttgaaaacggcaagtacggcaaggtgttcgtctcccacatcgatctgaacgacgacgtggtcgaaggcctgcagtgcgtggacatccccgcattctccgtgcagtaccacccggaggccgcagcaggcccgcacgatgcggcctacctgttcgaccgtttctgcgaacttatgaagaacaactccaaggaaggtaagtgatatgccgaagcgcaccgacatcaaatccgtgatggtcatcggctccggcccgatcgtgatcggtcaggctgcggagttcgattactcgggcacccaggcatgccgcgtccttcgtgaggaaggcatccgcgtcatcctcgtcaactccaacccggccaccatcatgaccgacccggagatggctgacgccacctacatcgagccgatcgccaccccgatcctcgagcagatcatcgccaaggaacgccccgacgcgctcctgcccaccttgggcggccagaccgcactcaacgccgccatggcgctgggcgaggccggcgtcctggagaagtacaacgtcgaactgatcggtgcttccctggaagccatcgaccgtggcgaggaccgtgaactgttcaagaaggtcgttgacgaggccggcgccgaatccgcccgctccgacatcgcccacagcatcgaggaagtcgacaagatcgccgagaagttcggctacccgctggtcgtgcgcccgagcttcaccatgggcggcctgggctccggcatcgcccacaacgaggaggagctgcaccgcatcgccggcgccggcatccattactcgcccaccgacgaagtcctgatcgaagagggcatcgagggttggaaggaattcgagctcgagctcatgcgcgaccgcaacgacaacgtcgtggtcgtctgcccgatcgagaacgtcgacccggtcggcgtgcacaccggtgactccatcaccgtggccccctgcttcaccctgaccgaccgcgaataccagaagctgcgtgacatcggcatcgccatcatccgtggcgtgggcgtggacaccggcggctgcaacatccagttcgctgttcatccggacaccggccgcatcatcgtcatcgagatgaacccgcgcgtctcccgttcctccgcactggcctccaaggccaccggcttcccgatcgccaagatcgccaccaagctggccctcggctacacgctcgacgagattcgcaacgacatcacccagtccacgccggcctccttcgagccgaccatcgactacgtggtcaccaaggtgccgcgcttcgctttcgagaagttcccgggcgccgaccccaccctgaccacctccatgaagtccgtgggcgaggccatggccctggccggcaacttccaggagtccctcggcaaggccatgcgctccatcgacaagcgccacatgggcttcaattgggatggcgagaagccgtccgccgaagaagtggccgaactgcttgagaccatccacaccccgaccgaacaccgttacctgcagctcatgcgcgccatctggggcggcgccacgctggagcaggtgttcgcggccaccaagatcgacccgtggttcctgaagcagatcttcctcatcaatgagaccgccatgacggtgcgcgaggctgaaaccctcaccccgaagctgctcaagaaggccaagctcgccggtctgtccgacgtgcaggtggcccacctgcgtggtttgggcgatgaaggcgagaacaccatccgcgaactgcgctggacctacggtctgcgcccggtctacaagaccgtcgacacctgcgccgccgagttcgacgccgccacgccgtactactacagctgctacgccgacgaaaccgagctgcgcccgcgcgaacgcgaggctgtgatcatcctcggctccggcccgaaccgcatcggtcagggcatcgagttcgactacacgtgcgtgcacgccgtgcaggagcttggcaaggactatgacaccatcatggtcaactgcaacccggagaccgtgtccaccgattacgacatgtccgaccgcctctacttcgagccgctcaccttcgaggacgtgctcgagatctacgaggccgagaagaagatgggcccggtcaagggcgtcatcgtccagctcggcggccagaccccgctgtccctggccgcgcgtctgaaggctgccggcgtgccgattctcggcaccaccccggaatccatcgacttggccgagaaccgtgagctgttcggcgaagtgctcaagaaggcggagatgaacgccccgcgttacggcaccgccctgagcctcgaagaggccaaggaagccgtccaccgcatcggttacccggtgctcgtgcgcccgagctacgtgctcggcggccgtggcatggaaatcgtctacgacgacaagcagctcaacaagtacgtggaccgcgcacttaccgaggccaaggccgataccgtggtctccggtcgcctgccctccccgctgctcatcgacaagttcctgcaagacgccatcgaaatcgatgtcgacgcactgttcgacggcgaggaactatacatcggcggcattatggagcacgtcgaggaggccggtgtccactccggtgacgccgcctgcaccctgcctccgtccaccctgtccgacgaccagattcgtcgcctgcgtgaaggcacctacgccatcgccaagggctgccatgtgcagggcctgatcaacgtgcagtacgccttcatggccaacacactgtacgtgatcgaagccaacccgcgcgcctcccgtaccgtgccgttcgcctccaaggccaccggcgtggcactggccaaggccgccgcccgcatcatggccggcgaaaccatcgccgatcagcgtgccaacggtctgctgctgcccaagggcgacggcggcgacatccaccccggccagcaggtcgcggtcaaggaatccgtgctgccgttcaagcgcttccgcaccccggtgggcaagaccgtcgacatcctgctcggacctgagatgcgttccaccggtgaggtcatgggcttcgaccgtgacttcccgcacgccttcgccaagagccagctcgccgcctacgacggtggcctgccgacccacggcaacgtgttcatctccgtgaacgacaccgacaagcgtcagctgccgttgatcgccgttcgtctcgaggagcttggattcaagctctgggccaccgagggcaccgcctccgtgcttcgccgttacggcatcgagtcgaacatcgtggacaagatcagcacccgcgtggacaccgatccggaagccccggtcgaggtgcatcacgctgccggatccgtgggcaagaacgtggttcagctcatcgaggaaggcaagatcgacatgatcctcaacacgccgaactcgcgcggctcccgttccgacggctactccatccgtgccgccgccattgccgccgatctgccgcagttcaccaccatcaccgagttccaggccgcactgctcgctatcgaggccgtgaagcataatgattatcagatcatgagcattcaggagcattcgaagcagctgttcgaattggagcgacgggagttctgatgactacactcagcagtgaggaattgcaggcacaacgttcggatttcggtctgcgattaagcaattcaatggccaaatacgggccgctgtgtgtgggcattgacccgcatcgcaagctcctcaccgactggggatacaacgtcgacgccgaaggcgccgaactcttctccatgcgtatgctgcaggccgccaacgggcgcgccgcagcagtcaaattccagacgccgatgttcgagcgctacggagccaaaggtttcgaagcgctcgagcgcgtgctctacgcggcacgacaaatgggcgtcatcaccatcgtcgattgcctgcgcggcggcctgtccaccacgatttccgccatcgcagacgcctatttcaagcccggtgcaccgttgctggccgacgccatcacgctgctgccgtactatggcgcgcgttcgttgaacggcctgattaccgaagcgctggaaaacggacgcggcgtgttcatcgcctccctgacctccaacccggaaggcatgagtctgcagaccgcgttgcgccagagcggcgattacaagggacgtaccgtggcctacggcatcgcctccaccgcgcagaagcataacgtggatatcgaaggcatgggctcggtgggtctgatcatcggtgccaccatcggccaatggatgcaggattccggcgtggacccctccaagttcaccggtccgattctttcccccggttacggttggcagggtgccgaggccaaggatctgaaaaccgtgttccgcggtacgcgcggcaacgtgctggtcaccgtgtcccgctttatcgcctcgcatgggccggatatcgccgcactgagccaagccaccgagtcgattgcgcttgacgtacgtcaggcgctgatggaagccactgtcgaaggctcggaaaaccagtaatcagaacggaatcagatgtcgcggcatgcgtacgtgtctatctcatcgcgtacgtcgcatcacgattcatattcttccctgttcgtcggggctgtagcagttaccggtcatctcgccggtgagccgttaccacattggattcataatcgctgcacaccacatcatctccggaggaacccatgactgaaaacacccatgctggccgtctaatcgtcctgactggccccaccgcagtaggtaagggcaccgtggaagccaagctgcgcgccgaccaccccgaagtgtgggtgtccgtctccgccaccacgcgtgccccgcgccccggcgaggttgatggcgtcaactattggttccttactgaagacgagttcctggcccgcgaagcggccggtgagttcttggaaaccgccgtggtgcacggcatggcccactacggtacattgctcaagcctgtggaggaacatctggccgccggtgtgcccacgattctggaaatcgacctgcagggtgcccgccgcgtcaagcagcgcgccgccgagctcgacctcgaagtggtgtacgtgttcatcgcgccgccaagcttcgaagagctcgagcgccgcctgatcggccgcggcaccgaaaccgccgaacagcaggcccgtcgcttggagaccgccaaggtggagctcgccgccgaaagcgaattcgacgtcaccatcgtcaacgaaaccgttgatcaggccgctgccgacctctggtccgtcatcgccaaggaatacgggctgtaaactaccgctttaccaccaactgctggtggaggatttcggcgctgtttttggccggcgcctgcttccagcggatcgcttcggattcgtgatgctcggtgacataatgccgcatccattcgaagcactgctgggtttggatggcatcgcttaatgcgcggtgctcctcattgtccgcgatgccgaagcgtacgatcaggtcggccagacggtgatgccgctgcgcggggaacagggcgcggctgatctgcatcgtgtcataatccgcgcaggcaaagccgcagccggcgatatgccgggtgttgtaatccaggaatcgcagatcgaagctgacgttatggccgacaatcggctcgacggcgggaccggcagccggggtagcgagccatgcgatgaatcggggaagcacctcgtcaatcggatcgaggtcggccaccatcgcatcggtgatgccggtcagcgtggtgatctgacgcggaatcggccgcaagggattcaccagctgctggaattgatcgacgatatgcccctcccgcacgcgcacggcaccgatttccgtgatggcgcaactgttcgggtaaaagccggtggtctccaaatccagcgccacataatcggtggggaagacggcatcgtccatggcgattcgcccgccggcaccatgattgggctgggatggttggccgaaaacggtaatgccggaagtggtcacggaggctcctcatatcagtcggtgttcggtgacttattgtaccggcatcccggtctgacggtaaaattattccctcccggtttttctcggatatattggttaggcggccggcaattgcgcggcgcatcgggaagggagcacagctgatgaaacagatagtggcaggcatcgtggcgcatgtggacgcgggcaagaccacgctgtccgaggcgctgctctaccgtaccggtgagatccgcaaattggggcgagtagatcacggcgatgcgtttctggacaccaattccttggagaaggcgcgaggcatcacgatctttgcgcaccaagcgttggttgaacacggcgacctgcgactgaccctgctggatacgccggggcacgtggacttcgcagccgaaaccgaacgggtgctgcgtgtgcttgattacgcgattcttgtggtctccggcacggatggcgtgcaaggccataccgagacactgtggcgtctgctggccagatacggtgtgccgacgttcatcttcgtcaacaagtgcgacgccgccggattcgaccgcgaggccattctggcacagttgcgcaaacgcctgagcgatgcgatatatccgctgccggcaatggagcagtccactgagggcagcgcggtaccgttggacgcgcttgccgaggatatcgccaccctggacgaggaggcgatgaacgactatctggaacatggcgcgctgtccgtggacagattgcgatcgatgatcgccgtgcgcgagctgttccccgtatatttcggctcggcattgaaactcgaaggagtcgaggaattcctggacgggctggagacgttcacccgcgaacgtgaatggccggccgccttcgccgcacgcgtgttcaaaatcgcccacgacggccagcacaaccgtatgacgtggctgcgcgtcaccggcggtgcgctcaaagccaaggagatcgtctcttcatcctcgtgcgccgcggcgtcatcagcaccgtcgccggtacagggggatgatggcacggtatggtccgagaaagtcgatcaggtgcgcgtctacaatggcgccaaattcgagacggtcaccgaggtgcctgccggatcggtgtgtgcggtgaccggactgacgcggaccttccccggcgaagggctgggagcggaaccggacgccgaatcaccgtcgctgcaacccgtgttgacctacacggtgttgcccgccggagcggaatccgatacggccggcacctcgggagcggccaaacgcggtgacgccggccataacaacgtgaatcaggacgatgccgagcatgatgccgccaagtcgggaaccggccgcaatgaggagaacgacaccgccggccagaccgcggcggacaatagctcgccggcccgtccccagttcgatgatctgaccttgcataaggtcatcaccgcattgcgtgagctggaagacgaagacccgttgttgcatgtggtctgggtggagcggttggccgagattcatgtgcaattgatgggcgcggtccagctggagatcatccagcagaccctgcacgaccggttcggtctggatgtgtcgtttggccccggctccatcctgtaccgtgagaccgtcactgcgccgatcgaaggcgcaggtcatttcgagccgctccgtcattatgccgaagcacatatcctgctggaaccaggggagccgggcagcggagtcactgtggcctcggccctgtccgaaaacgatttggaccgcaattggcaacggctgattctgacccatctgaccgagcgtgagcatctcggtgtgctcgttggcgcgccgctcaccgatatcaagatgactttggtggctggccgcgcgcatctgaagcataccgaaggcggcgacttccgccaagccacctatcgtgcgattcgtcaggggcttatggaagccagagctggagtcagtggccggcccgagacgccggtcgagagccgtccggacaccgcaggggagggcaactgccgactgctggaaccgtggtatcggttccggctcgaagtgccagcagacatgatcggccgtgccatgagcgacatccagcgcatggccggcaccttcgaatccccggtcaccgatggcgaatacgccgtgatcgaaggcgaggcgccggtgtccgagatgcgcgactatgcgatggatgtgaaccagtacacgcacggccatggccgtttctccgccactttcggcggctacaagccatgccatgacgccgaacaggtcatcgcagccgccgcttacgatcccgaagcagatctggacaacacccccgactcggtcttctgcgcccacggtgccggctaccccgtcaaatggtataaagtccccgaattcgcccacgtcgactacgccatgtgaggtggtgactaccaaatctgcggccgaatgaatccgttggtctccaagaaccgttgaatatcgcgcatttccggcatattaatggaatgggccatgcccggatacacttgttcggtcaacgtgccgtgctcgtgccagaactcacccatcgccgtcacatcggctttcgggaagatgtcgtctgcagcaccatgcccatagaacaccggcggcttcaacgaagccaattcggcatcgcccgcaacggaccccggtgccagccatccagagcaggagacggctgcggcatatcgcttcggattgaaacgcagcagatgcgcggccaagaggccgccctgcgagaatcccatggcaaccaccggccgagtggcgggaatatgctccgcaacccatgcatcaatggcttgggcggcttcagtcgcctgcttgtctaatgattcgccctccggcacaccttcatgcgcccacgcaccgaaccatgtatatcccatgccataggcgatgggtgcctgcaaactggcataatcagccgaaccggcaccgcaatagttcagcagatcgggcaaatcgtattcattggaaccccagccgtgcaacagcacgaacaccggagcggtttcgggaccggtcaaacgggtcagagctttggtgatcttcatagcctcagtgtatccaccgtttgggcgacaataatgccctgatgttcgcccatcgagtaacgtcccataagtaatgcgtatagcgcagcggccgtgccacgtgttctgatactctacgatgacacggcagggggacaggtatgttcggcccccgaaatcgtacatgggtggctaagaccgtttatgcgcaggagaagaaacgagaagcaaaggaaggagcgcgcccaatgacattcgattggtcgttcgtgcagcgttacgcgcctttcttcgtcaacggcacattgatgaccttattcatatccgtgtttggcatattgcttgccatcgcggtgggtctggtctgcgctggcgtggaaatcgcgcgtatcccggtcgcccggcaaatcgtgagaatctacatcgaactcagccgcaatacgccattgctggtacagctgtactttctgtacttcggcctgcccaaactcggcgtagtatggtccgccgaaacctgcgcgatagtcggccttggattcttgggcggttcctacatggccgaggcaatgcgcggcggattggaagcggtgcccaacgtgcagcgcgaaaccgcgtacgtgctgggactgacttccacgcaaaccatcacccgagtcattctgccgcaagcagtgtccaccgccattcccggcgtagtggccaatgtgatcttcctgtttaaggaatcgagcgtcgtctccgccattgcgctcgccgacgtgatgtacatggccaaggatctgatcggcatgtattacagcacctatgagtcgttgttcatgctggtcgtggcctatctggtgattctgctgccgatttccatcttcggcacatggttggagcggaggttcgattatgagcggcgctgaaatactgctccagccgggcgtattcccacgtctgttgcaaggcctgtgggtcaccgtgtggatagccggcgtatccgtaggcgcgtccatcccggtcggcctgttggtgggctggttgatgacgctgaagaatcccgtgatccgggccgcgatgcgcatctacctcgacttcatccgcattatgcctcagctggcgttgctgttccttgcctactacggttttgctcgatggttcgattggaatctcgatgccaccggtgcctgcgtgctggtgttcatcctgtggggaggcgccgagctgggcgatctggtgcgtggcgcattgcagtcgattcccaaagtgcagtacgaatcgagctacgtactggggttgagcccgtggcagaccttctcccgggtgattctgccgcaggctgttcgccgtatgctgccggcatccgtaaacttggcgacacgtatcgtcaaaacgacatcattggccgtgctgctcggtgtggtcgaggtcatcaaggtcggccagcagattatcgacgcgaaccgattccagttcccgactggaaccttgtggatttatggcgtgattttctttatgtacttcatcgtgtgctggccgctgtccattgtggcccgccgactggaaaagaggtggtcgaatgactgaacccgaaacgacctgcaagggtttcgaggtgaatcatctggtcaaacagtatgcgaatgccgacaagccggtgctggatgacatctccttcaaggtggagcatggttcggtgctcgtggtgctgggtccttccggctcgggcaagtcgacgctgctgcgcaccatcgccggtctggaaccgattcagggcggcacgatttccatcaacgatcaggtgatcgatgccggcaagcctggcacggaacgagccggacgatccgaccggtccagtgaactgcgcacgcgtatcggcatggtgttccaaagctacgatttgttcccgaacaaaacggtgctcggcaacatcaccatggcgccggtgctcgtgcagaaacgcgataagtccgaggtggaggctgaagcgatccggttgcttggccgcgtgggacttgccgatcgcaaggactcttggccgcacgaattgtccggcggtcagcgccagcgtgtggccatttgccgtgcgctgattctgcacccggaagtactgctgctcgatgagattacggcggctctcgaccccgaaatggtgcgtgaagtgctcgacgtggtgctcgaactggccaagtccgggcagacgatgcttatcgtcacccacgaaatgcagttcgcgcgagccatcgccgaccacatcatcttgctggacggcgggcgcatcgtcgaggaatcgtatgatgcgcaggcgttcttcgaacacccgcaaaccgaacgtgcgcagcagttcctgcacaccttcgaattcgagtgattcgattgtgccatatcgacgtatttgagaagaaatatcaataacaacaagagaaggagaacccaatgagtatcaaggttgggaaatcattcaaagcactgattgccgcaggcgcggcattggtaatggcggcgtccatggccgcatgcggtccgtcggcaggcaccccgagcgaagcgaagtcctctgacacgggcaccagctccagcgccaatgccaaggcccgcagcctcgacgagatcaagaagagcggcaagatcaagattgccgtcttctccgacaaggcgccattcggctacgtggacaaggacggcaagtaccagggctatgacgtctacttcgccgaacagctggccaaggatctgggtgtggagccggaatacacgtcggttgacccggctgcccgtgtggacgtgctcacctccaacaaggtcgatctggtgctcgctaacttcaccgtcaccgatgagcgcaaggagaaggtcgacttcgccaagccgtacatgaaggtggcgcttggtgtggtctccccggagagcgcccagatcaccgatgtcagtcagctcgacggcaagaccctgatcatcgctaagggcaccaccgccgaaacctggttcgagaagaacgcgccgaacgtcaagctgcagaagtacgaccagtacgccgatgcctacaacgcgctgctggacggtcgtggtgacgccttctccaccgacaacaccgaggtgctcgcctgggccaagtccaacaagggcttcaaggttggcatcacccaccttggtgacgacgacaccatcgcgcccgccgtgcagaagggcgacaccgaactgctgaacttcgtgaacgacgagatcgtcaagctcggcaaagacaacttcttccacaaggattaccaggagactctggagccggtctacggcaacgaagtcaaccccgatgacatcgtggtagaaggcggagccgtctgacggacagtccggtggactgtccgtaggcgacgccgagccgcggcagcggcgaggtgtgttgggccggtcgtcaggccgtccattcttgcaggacggagaggtctgattatacccgtccataaccaacacatatagcaacgccggccttcgggccggcgttttgcgttaaggtcgtaatcgtgccgcgcggggaacggcttcgcgcagatgacgcaacactttaagggggtgcgcaatgaccaggttcaacactcagctcgtccacggactgccggttggagacaacaacaccggagccgtgaacccgccgatctacaactcaacgacatatgccttcgagaaggttgacgcgatgccccgctatgactacgcacgaagcggcaatcccacacgtgacttcctggaacagcagatcgcccagctcgagcagggaacgcgtggttttgcgttcgcctccggtctcgcggcgatccacgcggtgctgagcattttcaagcccggcgaccgcatcgtggtcggtgacaatatttatggcggatcgtattcccagctcaatgagttcttcactcgctggggaatcatcgttgaggccgtcgacactcaggacatcgcagcattggaggccgtcgtcaagggcgaccgcgcgaacggcatcgtgcctgcccaagccgtctactttgaaaccctgaccaatcctctactcaaggtgaacgacgtgcgcgccatctccacggtggcccaccgtttcggggcgctttcgattgtggataacacgttcgtgaccccgtatctgcagaagccgcttgctttgggtgccgatgtggtgattcactccgccaccaagtatctggccggtcattctgatgtgaacgccggtctggtggtcgtttccggtgaggatctggcgagccgcgtgtacttcgcgcagaaccgtttgggtggtgtgttggctcctgctgagtgcgacgcggcattcagacgctggcccttcgcatggatcgtcagcaggagaatgccaatgccatcgcccgctacctgctggtgcatccgctggttaaggcggtgcattacccgggtctgcccggcgcaggcgaccagcgtctggctgccaaaggtctcaagggggtcggtggcgtgttgagcttcgaggtcgtgcctggcgttgatccggctgacgtgctcaacaacctgcacctgttccgtcttgctgtgtcgttgggtgcggtggagtctcttgccgagctgccgtgtcgtatgacgcatttcgaactgcctcgcgaggagcgtctgaagatcggcatcaccgatgaattggtgcgtctcgccgttggcatcgaggacgccaacgatctgatcgaagatctcggccaggcgttcgatatcgcttacgcccgttacatcgatcggcatgccgacttcgacgtgttccaacagctgacttcgggggtgtttgcctgatctaatacttttctgcctatttttctactcctggggagcggcgtcggttgtgccacaccggcgccgctttttttatgctctggttccgcctccgctggcagagggctgtcggcgtagccgactggggtggttaagcggaccgcccgcattatgccaaccgcgatatcacagcatccccgttacgatgaatacggtttgatagtgcaccgcgtaaaagtcaagcgcggcggaacaaagaaaggacctgatatgaccatcgacgtctacggtgccacatggtgcggcgactgccgccaggcaaagaacactctcgacaaactgggcgcggcatacacttggcacaacatcgaggaagaggaaggtgccgccgaccgtgccgtggcgatcagcggccagatgcacattccggtggtgcggtacgatgacggctcgttccaagtggaaccctctgcagtggatatcaggaacaagctgcaggagctggggctgctggctgactaggaatccgtggtctgagctgcataaggcgtgcgtcatcgatcggtcttgatggcgcacgtcttatctgtttatgcggatcagagagtagggggcttacgcttcggtgcccactactgttccagttgccgggctttgaccccaatgcgatttcggtagtcggcaagcatattggcaagcgtaacttccctcatggaatccgacatggctttggccactggagcatacgcatctttgagaacgtcgtggatattccgagccacggggcatgtgtgatttcctctctcgtggatgccgatcacatcatcgaggttcgtggattccactgcctgatagatatcgagcagagtgatttccttggggggtgcgggcaagttcggcaccgccggttccgcgtgccactgtgatgagccccgcgcgtttgagcgctcccaaggcgttacgaatgctgacggcgttcgtcccggtgctttcggagagcagcgcgctgggcgccgatcgttatttcgactatcgcatcgagaactatgctgaagctctttctgacgcaccggttgaccatgtcatcgacaccttaggcgaaacggcaaagttgttatccggatggagtgaccgagcgtctttgcgctgattgctgatttgatatgcgttatcgccagatatgaaaagagaaccatgactcccttttgatgagattgtctgaaggtcaacgattggtccggatgcaatatgtgtccaaggaagtttctgaagcgttggtgtcgcaaattactaaagggttcggcatcgatgtcaacataatctttggagatatcgacatcgtcgcggataccccgatagggggcatcgtggccattttcgatggtgaaccggtacggattgacgcggctttgaattatttgaggcagcgtaatattgcggccgaggtgctgaaagagggctgggcagcttggtgtgttccggcattcggcggatattctatagccattgcttataagcgcgcattgacaattgcgataccgatgtgccggtgtcgcgtaccatgacttgctaagttcgggaatagagtcgagcccgccacaatagagcggcatgaggaagaaggattaatggacgttgatttccgaacgcaagccatccacgccggctacgagccgctggataacggccgtgccgctgtgccgccaatctatgcctcggccgcattcgacctgggtgacgcggcgcgcggcgatgcgctcgcgggcggtgacatcgacggcttcgagtactcccgtgtggccaatcccactgtcgatgcactggaaaagcggcttgccgcgctggagggcggtatcggcgccgtggctgtcggctcaggcatggccgcagcatactgattggatgccgcacttttttataagaagccagcatgcacacatagtgaacagttgtacacatatgcgtacgatgtctaccgctttgttttgaacgctgatacgatggaaatcacgagtcgaggccgagggcggtttcgacgtgggtgaagggaaaacatcatggccgtattctttgctggtccgctgattatcatcgtgctactcattgttctgctgtctgccgcattatttgtcgtgccgcagcagcaggcctacatcattgagcgattcggcaagttccttaaggtccagttcgccggcatccatatccgcatcccgttcgtggaccgcatcgccatgaaaaccaacatgcgtgtcaaccagcttaacgtgcagctggaaaccaagactcttgacaatgtgttcgtcaccgtggtggcctccacccagttccgcgtgaacccgaacgatgtggccaccgcctactacgagctgcgtgacccggccggtcagctgcgctcctacatggaggacgcgctgcgttccgctatccccgcactgtctttggatgatgcctttgctcgcaaggacgatgtggcgttcgacgtgcagaagaccgtgggcgccgaaatgagccgtttcggcttcaccgtggtcaagacgctgatcaccgccatcgacccgagcccacaggtcaagaacgcgatggactccatcaatgccgcccagcgtgaaaaggaagccacccgtcagcgtgccgaggcccagcgtatccagatcgagacccaagccgccgccgatgcggagaagactcgcttgcagggtgagggccaggccaattaccgccgcgagatcgccaacggtatcgtcgaccagatcaagagtctgcaggctgtgggcatgaacatcaacgacgtgaacaacgtggtgctgttcaaccagtacctcgacgtgatgcgctcgctgtccgaatcgaacaacaccaagaccgtggtgctgcccgcctccacgcccggcggttatcaggatctctacgagcaggtcaccaaggccatgctcaccgcttccgagacgaagtaatcaccccgtttgcgaatccccatccatcgatagtgaagtccctccaagcgagggacttcactatcgctatgcctgaaggaatgccggaatggcctcggccgccgcgtatcccttgcgatacatcatttccagaccctcgaagttcttttttagggtgttgaggccatagaggtcttccggggcgagaatcagcacgcggccttctgcctcgtaatgcttggcgagttcgagttcgtcgttgtaggtcttgtagcgcatgcgcagcttctcggccgcggcggggtgggagcgttcgaggatgcgggccggagccaaatccttctgctgcttgcgcacttcgtcacgcaagcgagacagaatcagaatcacgcgatcgtagccgtcctccagcgccttctgcaccggcaccggatcggcgatgccgccatcgaaatacggcacaccatccaccacatacggctcgcaggccaccggcacggcggacgaagccttgatgatgtcgaaatcatcaaaacgcacgcgcgatttgtcgaagtacttggtcgagccgtcctcggcattgcaggccaccacggtgaacccggtctcattggcctcgaacgccgcgaaatccaacggattctcgccatcgtgattgctcagcgtgccgtagatgtagtcgaggttggcaaagttgtggttcttgaagaagctttccgcactcgcgtactccttgcggaaggcgtacttggtgtagaaggtgtggttgcggccgtgctggcgtgcgatgaatgaggtcatattggccgcgccggcggaaacgccgtagcacatatccacgtcgatgccgtcctccagcatgcggtccataacaccacagccgaaaatcgcgcggaacccgccgccgacatcaatcatcgccgtctttgtcataccaaccccctgttcacttgaatctggtatgagcttacgcgtgctgcacggacaacgatatgggcagtgtgctgtgaatttgtctggttcttccttggcttccctcagagaggggagccaagaacggctcatacgttcagcaatttgcgtgacaactcggcaatccgttcggacagatcggaattggcgagttccacgccgccggtcgcgtcttcgggtgccagtttgcccagggactccagcacaacgcccagatggcgcacggtgccctcattgccgtcgatgacagcagcccgttcgggcagcagctcgcggaagtagtcgcggtagaacacgaaatgcgtgcaacccagcaccaccgagtcgatgtgctccatgtcgtactggtcgaagtagccatgcagcgtgcgcatcaccaggtcatggtcgccgagccgcccggattccacgatctccaccaagtcggggcaaggctccttgaaaatcgtgttgttggaatcgaatcgatccatcagtttggcgaacttccgctcacgcaaggtcaggggagtggccgccacaatcaccctctggggaatatgatgcgggtcggaaggcacgtcaccccggtcgcacgccactttcagggccggctccatgccgatgatcggaatatcgtagtgttcgcgcaaatcgttcaccgcggcggaagtggcggtgttgcatgcgatgaccacggccttgacgccttgacgcacgaaccgttcgacaatatcgaaactcagggccctcacttgttcaggcgtcttgatgccgtacggtgcgttggccgaatcaccaaaatacagcacatgctcggccggcatatccttggcgatttggcgagccacggaaataccgccaagacccgaatcgaatacgccgattggagccgaagagctcatgcctgaatcctccctatagccatgcctgcaaccgtatgttgccgcgaccgatcacaaagccgattgttttgcggtgttgtttcgctccctagagtactctgaaagccatgagtcttccgcaacgagtaaccaagacacacgcaaccggcaatgatttcgtggtatacctcgacaagtccggcaaattcgagcctaccgccgatgaggtccgattcctgtgcgaccgtcacttcggcattggcggtgacggcctgattcgcctgacacggcctgatttcgtgtctgatttaagcgatgatcagctttcggacgtactggccgggggcgcgaaatggttcatggactatcgcaatgcggatggatcgttggcggagatgtgcggcaacggtacacgcgccatcaccttgttcgctcagcgtgagggggtggccgactccaccgagccgttccgcctcggcacccgtgccggcgtcaagattctgacgccacgcggcaatatgaggccgtacggagccaacgtgttccaggtcgaaatgggggagtggaagatcggcgaaaccgacgcctacgaggtcaccatccccggcactgagggctcggcgcgcggtacgtttgtggatatgggcaacccgcatgtggtcgcggtgatcgaggatgccttcgcgtccctgccagtggttgaatcactggatttggtcaccaaaccagtggtggctccggtcatcgaatccgaccagaacgtggaattcgtgcgggtcgacgacatcgatcagagcaccggcgtgggtgaagccacgatgcgcgtcaacgaacgtggctgcggcgaaaccctgtcctgcggcaccggcctgtgcgccacaggcattgtgctgcgggccaagaccggcatcagccactgggacatcaccgtacgtggcggcaccctgcgcgtggacgtcaccgacagcgacgtaaagctgaccggagcagccacgctggtcgccgatatcgatttgttgtaaaggaatcaggcagcgaacagggccgcgccttcggtgacgatgatgagtaccacgatcgccacgatccacagtatgtcgaccatgaggtcgatgttgaggcggtaatacttattgagtccggccggcaccgccgcgacctcagcctcaccgtcgctatcatcagccgccacagccttacgcgacggcaatccctgcacggccacggtcgcatggctcaacgccatgaactggatggtggtggagaacatcagggtcaggcaccacgggcacagcgcgtgaatcacgaacagcgactgcgtgctcagccagtacgagtaagccaaagcggccagtccgcccagccacgtgcaggtcgcgaaccaacgcggcaccttcacacgcgccaaaccgatcaccgcgatggtaatgaacaccgattcggcggcgatgccgaagaacgcgttcggatagctcagcccgccgaacttcgcgatttccgcttgccaggactgggccaccgccgaacaggacaccaccgagttcagatcgcagccgagtgcggactccggatgccgagccaattgcaaagtctcagcggacagaatgagcgaggcccccaacgccactgccgaggcaatcagcatgatgagatatgtccaagtggcactgtggcgccatccaatcaacggtcgtgcctccgccaagccaagcggcgtggtgttcgtggtgctggatgatgtgtcggttgcggtgttacgagtcatcatgtccctttcgatagcgctgcgctccagattagcctctgcggttgtcagctgggtgccgaatgtctggtttcggccgttggcagaaggtgacgacctgtctgcgccttgcgtgggaatgctgaaatgaggttacgatggaaggtatgactggatatgtgatgcctttggaaccgcccgccgtcgggtgggacatccactgccataccgccttctcggatggcacggaaacgccggccacgttggccgaacaatccaaggcattgggactcaagggcgtggccatttccgatcatgacaccaccgccggctggccggaggccgaagccgcggctcatagggtcggtttgccgttgctccgcggcaccgagatcaccgccacggatgagaacgtctccgtgcacatgctcggctaccagtatgatcccacgaatcagcacatcacggacttgttcgccaatactcgagccgcacggttgcaacgcacgcagcgcatggtcgaattgttgtctcgtgattatccgattacctggcaatccgtgctcgcccaagtcaaggagggtggcaaaaccaccattggccggcctcacatcgctgatgctttggtgagtgccggcgtatatcggactcgttcggaagcgtttgcggatgcggtcagcgcctcatccaaatactatattcccacgccttcgccgacctctcatgaagtggtggccgccgtcaagggagcaggcggtgtgattctgatcgcccatgccggtgatgtgagccgtaaccgcagactgttgtccgatgaccagatcgaggcattgatcagcgaaggactggacgggctggaggtatggcaccgtggcaattcaccggagcaacgagaacggctgctcaccatctgccgccggcaccagctgctggtcaccggtgggtctgactggcatggcaaaggcaaaccgaacaaactgggggagaacctcaccgacgaggccactgtcgaagagatcgttcatcgcggcgtgcttccgctatatcggtgattcagcaatacaaaagcggccttgagataatgcccaaggccgcttatgcgcgattcatggtcacagcgtgccgaagccgacggcgtgcttggtttcggagccgatgatcgcgtaaccgagtgccttggcgggcacgatgatgcgacggcccttgtcatcggtcagatcgatcgtcgtgttgtcggccacggcctgcgcgatggcctggctcacattgtcggctgattcgtcggtgctgaagttcaccggtcgtgccacgttctgaatgcccagttcgatatccatataaggctccttgttctgccgtctttgtgacgaacatcatggtaagtggccgtcgccggccgaggttctgtactctattgtgccgcgtgtctgcgtcgtcatgtgcggtgttacgcgctcggcgtggcgcggaacaccgtacacgacattatttggatgatgtggacgattcggccagcggattgccctcgctgtcatacccgtccaacccggcacgggcatcgcgcagagcgcgttcttcccgctccaacagcggaatcaccgtggtttgggcactcgaggctccgtactgaacgagactgtccggagtatcgtcattcaccgcatcgtcggtcggggcggcggattgagacgcaggggaagcgtcggttgacgtcgtgccgctatgcccgttcatactgaggagctccttcagcgtgatcgtcaccgaagaatgggaagcgccatgtgagggctgcggtttggtcgatcccgtaccggttgcgatgccggagacattcgcttgcgggtgattggcggtccggtcagcatcgggttcgacttccggggtaagatccacgtcgccagcggccacgatgtcagcggaaccggtgcgatcgggatcgggcgtgtcgtccgagacctcggccgccgcggtaccggtgtcggactgctgcggttgtgcgggtgcctgatgacggtcgtcctgcaacaatgtgccgacggtgattgtggaaggcaaaccgggcttcgttgacgaggcggcggccgaccctgcggctggggccggtgccggagtgtgcttgatcacgcccaactggtgtgcgagtcgttcgacctgtgccttgaactgcatgatgtgatcgttgtccgcacggttcaacgcctgaatgaattcgcccacctgttccatctgcagccacaggttggccctgagcatgatgagatcgtcaagtcgagagcccatcatgcggccgtatgcggaaagcacggcgttgcgatgggattcgtcgagcttgccgaaaatccaggcaaggtctcgtgccggatcgttgacctgcatatcctgccagttggtcaccgtggtgatggtggaaccggagaacaggaagtcgccgtcggaaaatccgccgtgaaccgtgcaggtggagaacgaccacaatccctcggtgtccatgatgcgcgcccagctgtcggtgatttcttggggaacatggccggcggagcgtaagcggcgaatccaggcggtcagctgcgaacgaatctgaccggtggtaactaccggatatttggcattggccagaaaagtcgaaggcaggcgatgaatggctccgatggcggtgccgacggccgcgcagtcatccaatgtcaacaggtcgagaggccgcgcctggccatcacggtggacggcaatcatcacggtcgtctcgcctgtgggaccgggcttgcgcggggtcagcggtgtggactccgcctgagtctgctgccccacggcctgtgcggtggccgtctggccgggtcgggaaacgtctcccggggcgaacgcgaccacacggtccatatcgaagccgaggccaccaggctcgcgcgcggctgccagtgtctgcgccgctttcacacggcgaatcagacgcgtacgcccttccttggtgtcagtggcgtatacgtcgtacaacttgcctgaggcatcttgaatcacggtctgatcgatgcctttggcctcgtcggttgcgctggcctgcacgttctcgcgtacgccggccacccccagattcggcaggacggctgaggcgagtgccgccaacatataatcgctacgtttcatcacccttccacactaatacatccgtggcgattcgcaccgcagaatgacacgcaaaacgcgtgattctggcgatgttttgtcgtgagcccgattcagccataggcatgagtcgtgccgtgagcgcgaatcgtgccacaatggacgcatggaacaggcgcaggggattcttgaggggctcgatgagcggcagcgtaccgccgcgactacgttgcaagggccggtgcgcattatcgccggcgcaggtgccggtaaaacacgcacggtcacgcggcgaatcgcctatgcctgcgccaccggggcatggaagccggagcgggtgcttgccgtcaccttttcggtaaaagcggcggcggaaatgcgcgcacgattgggccagctcggcgtagggggaggtactggacgttccggttcgggcgcgggaactgccggagtcacggccgcgaccttccactcagcggcattgcatcagctcaacagcgtctgggcagacatatgcgaggctccatttccgcatgtgatcgaagatcagcgtgacgtcgtctcccgcgcgatcatccgcgccaccgcacgtaccgatgccgatccgctgaccgttcgcgatgtgctcgccgaaatcaattgggccaaaatctcgttggtggcggtggaagattatgcccgggcatgtgccatcgcccataggcagccgcccgccggactcgacaccgctcggttcgccgacgtctacagcgcctacgagcaggaaaagacctcgcgtggcgaaatcgattttgacgatattctgttgctcgtatgccatatcatggatggttttcccgaagccgccgcccaaattcgttccaccatcggctggctcaccgtcgacgagtatcaggacgtctcgcccctgcaacacaggctactgaccctgtggctgggcgggggaggacctgacggcaagagcgcaatgaaccgcaacgtatgcgtcgtgggcgatccggcccagaccatctactcgtttgccggtgcttccagctgggatctgctgcgtttcgccgatgaattcgggccgctcgccgccgatgtcaatctcaacaccgactatcgttcgacgccggaagtcgtgaacctcgccaaccgggtgcttgcggccgcgccgaaccgtgaggattacctgaaactggtttccgcccgtgaatccggtccgcgcgttacccgaaccgcttatgagagcgatatggaagaggcacagggcgtggcggcacgcatagcccggttggttgccaacggggccaagccgtccgattgcgcgatcctcacccgcatcaacgcccaacagccggtattcggtgccgccttgcgcgctgcgagactgaaatatcgcgtccgcaaggattcgggatggcaatcatccgcgctcgccgacgatgccgcgtccaaacgcgcactattggaggcgatgggtttggacgccaccggacttgccgcaaacgacgatctcggggttacgatttccacgatccacgcatccaagggtctggaattcaagcacgtgtttctgatcggctgttcggaagggctcttgccgtatggttcgccggaaacgggggatgcgctggaagaggaacgccggcttatgtatgtgggcatcacccgagctgaggattcgctgcatttgtcgtatgcacggaccaaggatggttatggagcgcagcgcagacgcccatcacgatttttgtgacgggcgtctgtaatgcatactgaatgctcctgaacgttcaggagcgggaattggctgaaggccggttgactatgcctgcgtatcctccgagttgccgttttcaccgtcttcgccatcttcgccgagcagcttggacagttcggcatcccaatcgatatcgccggtcttgccatctgcggcagggtgagaagcggaaccgttggcatcggaagaagaacctgaaggggcgtcggatgacggagacgcgccatctgcgggcttgtcgccaggcagcgaaggcagcagatcgggatgcgtccacttggcgtcacggccttcagggccttcggcggcggtgatcatctcccatatcccggtggcctcgcgcatgcgcttgggacgcagctgcaaaccgagcagactttcgaacgtacgctcggcggggccacccatcgcgcgctcgcggcgcatcatctcacgcaactgttcgatatgaggcagatgggccataccggcgcgccacaccacgcaatccacccagccctcgaccatcgccagcagcgattccagcgaagccagcgcctcgcgctgttcgggagtgtcggggatgccgaccttggtgagattcaccgcgccggaaatcgactccggatccatcgacgtggcgtcacgcagctgttcctccatcgcatccagatcgatggagatgccgcgtgcgtacttgccgatgagcgcctcgaaacgcggcatcagccacggtaccgaggcgtacaggcgggcgtgagccatttcctgcagggccaggaaggaaagcacttcagattcggggattttctcggtggtctcgaatccggagagcgcagcctcgaacgcggcggcgtcggcggcatcggcggaagcatcagagccggagacttgggcggtaccgtcagttgccggagtatcgctgttgccggccgaagtgaagccaatgggattggcagaagcgtcggtggatgtggagaacggattgaccgagtcggttgaagtgccggccgtgtcggcctcggccgcagaagcctcaccgttcagcatcttcgcgtattcggtggcgttctgggcaatcagtccaccagccgggttcttcagcaacgcgatgccctgatcgaagctgccatgcacttcatggctcagattgccggccgcatgccccaactgcatggcaaaggacgtgttgcccagcagcttcatcagttgggctgggtctttcataccgtcgggaatcggaatcggcaccggtccggcgaacatgccggcaatctcgccatcgccgaacgcgccgccaagacgctccgaaatcaccgaagccaaagcgtcgttcatcgactcggccacaggagctgcgaacttcgcccactggtcgatggtgccctccacccagccggcgcgggtcagcacatccggatcgccgggcgcgggattgaactcgcaggcggtatccagccacaggttcgcctcactcatcgcgcggcgagccgcctcgccatccacggcggacacgctggatgcagaaccggaggcgttggcctgctgcaaggcaatcgacttggcgagcttgacgttgatcggcccttcctcgacagtgcgctgcatatcgcccatcgtgttgagtccgccggcgctgaacgcggccatcatctgctggacttcggatggattgggcagtcggctggggtcctgactcatcagctgttcacggatctcctcaggcaactggctgatctgctgccaggccatctcaccctgaatggggccgaagcatttgatcagccactcgtgaatcgcgttgtcgtccatgcgtatccttctttgccgcggtgtgttaccccaagtgtagggtctgcccgggcctgttcgcttgtggccgagcaatattttcggtttatgttcgttttcggccgatttcggccctccgcttacactgtagggtatgtttgcacgccacaggaatcaggaaccagacctcgtccaggagcaggagagcccgactgcggattcggaagcgggagatgagcacatgccatcgttcgaagtgaagcatgattcgcgcctatctcgtggaatcagccgtgctcgggcctatgcggccgctcgtccgaaacgccatttcgtcggtgcattcgccgtgttgcttggtgtggtgattctgctgctgcccagcccgtacgtcatcgagatgcccggacccacccaggatgtgctgggcaaagttgaggatggtgcggttatcgacatcactggtaccggcgtgacgacgtataaggattccggcaagctgctgctgaccacggtgaacgcgtccggcgtgcccgggtacccgatcatcaacgcgcaggccgtctggggttggtccaatccgcaggtggaggtcatgccgcgtgaggccacggtaccggtgggccagagcgcggaccagtatcagaagaaagtcgaacaagacatggccggttcccaggattcggccagtgccgtcggtctggcgtatgccaaagcccatgcggacgaactgggcattgacgccagtgcattgcaacacgccaaggtgacgatgcacgtggacagcatcggcgggccgtccgcaggcatgatgtacacgctcggtctcatcgacaaactcacccccgccaacgagagcggcggcaagaccatcgccggcaccggcaccatagacaaggacggcaaagtcggcagaatcggcggcatagagctgaagatgcttggcgccaagcgcgatggcgccacatggttcctggcccccgcgtcgaattgttcggatgtggccggccgcgtgccggatggtctgcgcgacgtcaaggtcgccacgctggacgaggcgtatcaggcgttggtggccatcggcaaggggcaggccgacgatttgcctcattgcgaggcctgacatgcgcggccagtcgttgtttctggtgagacgactcgcatgggtctgcccacaatgcggcgattttcggccgcgttaacgcatttgttcgcgaagacttgctaatgtgtcccctgtgaatcaaacggcatcacagaacgctgaagaatttggtttcgagcccggcgatatcgtccaggagtggctctgggacgacgacgtggacgattccattcgtgcccagattgaagagctcacgggcgaggatctcgtggacgaggactacgactccgctgtggacggcgtcatcgtatggtggcgcgacggcgatgatgaggacgaattgtccgatacgatcgttgacgcctacgcggtactgggcaatgacggcccgctgtggatactgactcccaagcccggccgcccgggtgccgccagctcgtccaccgtgcagtccgctgcacagaccgccggtatgaacgccgccaccccgctgaccgtcagctcggactggaacggcatccgcctgcgcgcattcggcaagggccgctgataagcctcaatcaatacgcttgactttaagcgtgttgaccggcgtcgtgtgctgcgtagtgctgctgggcgtgactgaatgtcattgcgattgagcgctacggcacgcgtatgcgacaccacgtgtcgcgcagtgctggccatacgctattgttgtcatttgcgggcaattagctcagttggttagagcgccacctttacacggtggatgtcgggggttcgagtccctcattgcccactttcatttttcatcgcttcatggaatcccctcattccacggatataggctgtgacgatattccctgacagtcttcggcaagggttctgaaatctcaatgagatgcgtgcagaaggaaaccggcagtactgctacaaaatcgtgaatttcggtcttcttggtcagatgcgtctcaatagtcacgtaaagttgtggcagagtgtttatatccagcaggaggtcgaatagccgatggcgcaggaacttcgtgaaggggacggcaagtcgggcatcgcacgtgcgggcaagcgcaagtgggggtatgaccccgctcaggtggacgctttcctggagcgcgcccatgctttgtatgacagcgagggcatgaatctcacccagcatgacattcagaacgtgtcctttgatttgcgcaagaacggctatgtgatcgcacaggttgacgccgcgcttggacgtctggaacgtgccgtggtcgataagcagaccacatgggagatcgcacagcatgggcgtgtgacgtggaaggcgaagaccgagaagctgtatcacgaagtccagaaccatgcggagcgtgacgagcgcgaacgcttcaagtccggagcgcccaagcagccttcgtacgataagaagcaggtggatcgtctggtcgaccagattgtggacaaggcggcggccgcattgggcgttgacggcgtgaccgaagacgatgtacggtctttggccgatctcaatgcgaatacggtcaacaatgtgatcttcacccagcgcaagggcaagaaaggctatgacgagcgacaggtcgattacttcctgaacgcctgcgtgcagttgctgagtcgcttggaatcctatgcacgtgtggccgatttcgtgtccggcgagcccacggctcctgcccagaccgccacgaacgtgaccgttcaagcgaacggcgtctcaccgttgttcgcttccggaacgcagcgcccggcaactgacgaacgttttgcgccgtctgccgttgctcatgacgaatcattcgatgccctgcatcaggccgagcagagcttgttcactgctccggctccggttgctcccgcggcgccggccgcgggagcaccgatcgcctatgcgccggctcctgcatcgttcgatgcttccacaagcaccaataacaccaatacggaacagccggtttcctttgctcccgtagcatacccggtgcatacgtccaacgagtctgcggcgaagcccgtctccgagacgccttccgtggctcctaccgcagctgttgcggctgagcctcccgccagtgccccgtccgcgccggtttccggtgtgaccgctggcagcgccccctcgtttgctccggcacagtcgtcatacgaatccgcagctccgtcatcgaccccgtcggtgttcgcggaacatcccgtggatatggtgcaggacggttcctctctggccgctctcgcccacatggctgcggtttctcaggaacttccggcggtggatgcgccgtccttcgctcccaagatgcccagccttgatacaccgaatgcgctgaaattgaatgaggtaccgggttcggtttcatccccggcaccctccgccccggcagcgcaacctgtgaatagcactgccgacgaggctgcgtccgctgccatgccggtctcctttgctcccaccagcaagccggatcgtaacacgaactccattccggttcgcgtatccgatagtcagcctgcagacagcacggtctcccgtccggctgtggaatcatctgaatacgtcgccgcctcccacgacacggaagcagctcagccgtcacaggataagcacgattccaacgattcgttcccgctgctgttcccgcttggcggtaacttcgattcggatatccccgacctgtcgttccccacactgaacaatgacgatacgaagaaggaacagtgagcatagcctccaactccaccgtcatcattctcggatccaccggatccatcggcacccaaggacttgacgtcatctcgcgtcaccctgaacgatttaccgtcaccggtctggcggcgggcggagcacatatcgagctgctggcgcaacaggccgcacagttccatgtgcccgaagtcgcggtgtttgatgagaccaaggttccagcactgcaagcggctctcgcacaggccggcgcacaaggtgtccgcgtgaccggcggtccggattcggtcatcgccatggccggatccggtgcgaatgtcgtattgaacggcatcaccggctcgatcggcctcgaaccatcgatcgcggcgctcaaggccggttcccagctggcattggctaacaaggagtccgtagtcgcgggcggtcatctgctgttcagcgcgcaagtgcgcgagaaccagatcaacccggtcgattccgagcattccgccatctggcaatccctgcgctccggaacccacgccgaagtcgccaagcttgtggtcaccgcctccggcggcccattccgcggctggaaacgtgtcgacatggagaacatcactcccgagcaggcgctgcatcatccgacgtggaacatggggccggttgtcaccatcaactcctccacactgatgaacaagggcctcgaagtcatcgaggcgtcccgcttgttcaatgtgtcgcctgaacgcatcgacgtgaccgtgcacccgcagtccatcgtccattccatggtcgaatttgtggacggcgccacgatttgccaggcttcgccgccagacatgcgtctgcctatcgcgctgggcctgtccgcgccggaccgcatgaccaatgtggccgccgcgtgcgactggacgcaagccgcaacttggacctttgagccgttggacgatgaggcgttccccgccgtgcaactggcccgccactgcctggccgcctccgagaagcatacggcggtgctcaatgcagccaatgaacaggccgtgcatgcgtttcttgatcatcggctgccgtacctcggcatcgtggacacggtcaaagccgtgctggaccagatggacgccgagcttcgtggtaacccgctgttcacggacgtggaggaaatgaaccagcttgagcttgaagcccgccgacgcgccgacaacctgataaacaagcaatgatgaataccttgaatacggaaaatcccatcgaaaagccgttccgcaaaaccggtgatccggtcgacctggccagcgaatcgcccttgcacccgcgccgcaagtcccgccgcatcatggtgggcccggtgccggtgggcgggggagcgcccatctccgtgcagtcgatgaccaacacgctcacggccaacgtacctgccacgttgcagcagatcgccgaactgaccgccgccggctgcgacatcgtgcgcgtggccgtgccgagtcaggacgatgccgacgcactgccggaaatctgccgcaaatcgccgattccggtcatcgccgatatccacttccagtccaaatacgtgttccaagccatcgacgccggctgcgcggccgtgcgtgtgaaccccggcaacatccgtaagttcgacgaagtcggcccggacatctgcaaggccgccaccgacgcgggcatctcgctgcgtatcggcgtgaacgccggctcgctggacaaggaactctacgccaaatacggtggcccgactccggaagcgctggtggcctccgccttgaaggaagcgcacatgttcgaggacgtcggcttccacgatttcaagatctccgtcaaacaccatgacgtcatcaccatggtcgaaacgtaccgactgctcgcttccaagggcgattggccgctgcacctcggcgtcaccgaggccggccctgcttggcaaggcaccatcaaatcctgcctggcgttcggtgcgctcttggccgagggcattggcgacacgattcgcgtgtctctctccgcgccgccggccgaagaggtcaaggtgggttgcaaactcttggaatacatgggattgcgcccccgcaagttcgacatcatctcctgcccgagctgcggccgcgcccaagtggatgtgatccagctcgcctccgccgtcaccgaaggcctgaaggacgtgaccgcgccgatccgagtggccgtcatgggttgcatcgtcaacggtccgggcgaggcacgcgaagccgacctcggcgtggcctccggcaatggcaagggccagatcttcatcaagggcaaggtcatcaagaccgtgcccgaagaccagatcgtcgacacgctgctcaccatagcgaacgatatcgccgcccaaatggaggccgacggtcaagtccccgtcaattccaccggcccggtcgtggtcccaatccagcaccccggtcactgattcggccgaataggccctcggcataaatatcgcggtcagattacaatagcgcacgtgccgcaagaagaagagcatcgcctgactgttcgatccaagccgtggaccagcacccaccggctgatggtcagcctgcccatcttcattatcctgattggcgtgctggtctccatttccaatctgaccacggtgccttggaacatcgaacccaccggccagtcgatggccacgctcaccgacgataccgaagtcaccttcgataacccgtccggagaaacgctgccggcaaaaggcacgtatgaggtcaccgagcgatacatcacgctgaacatgaccagcgacggcaatctgaccaaggagtccggtgctcggggcaaggccaatgcggacggcgtccaagctatcaaggtattgattcgggaacctcagaacgcatcaggcaagcgccccggcgtggtgttcatgcacggtgccggatacggcacctgtgacaactcctttggcgacgtggcctccggtatggcttcggccggctttgtgaccgcagtgctcgacaaacccgtctggaacaccaccgacatcaaccgcgattatccggcctcagccaaggcttatgatcaggtcatcgaatacctgcgagaccaaagcgatgtagacgaggccaaggtcggcatctatgccacctccgaatcgacatggatctcctcgtatctgctcgaggacgatccggacgtcgccttccagattcttctgagcccgatggtgttcagcccacgccaatcactgggatttttcgtcacccaggacttcacccttgttggcgcgaacgaaggctatcaatccatcgtccaacgtgtgttcagcgcggacaccggcctgttcggactgaacaatttcgacctcgccacactcaaacccgccgcctacgccgtacccacctatgtggcttacggttcgaaagacgtgatgacggcgcaggtcgacggcgtgcgtgcgattctctacaacgcccacaaagccgataactggaatgtgaccgtgcgcagctacccggtcgccaaccatgtgctgcgtttgggagatgagtccgaagcgggcaccccgtttgcggacgcctatgtggacgatctcatcgactgggccgtcggcacttccgccggactcacgcagaccagcgaaaaggtggccggcaccaatctgtaccaatcaatcggtctgccgggcgctttgaaggcaagacgcgtcggcaccatatatggtgtgattctgcacgtcacggtggtactgctgctgctcgcatccatcgtgctggcactggtggcgctgggtcgcaaaatcgcggcggatgcccgatggcggcgagagaagcgcgaggccaaacgtgcgggcatgctgataccggaacggcctgtggtactcggtttcgcacatggtttcggcaatgcgctgctgactttgaccctcaccactcttgccacattgctcatcttcttcgccggactcgggcaggtgatcatgggcgtggtcaaacttgcatggggtggcgcacctaccgagacgccgggtgtcatgtattggagctggccggtcatccaagtggtgtccgtgctggtgctatgggcttggtcccgcgtctttatgcacctgatagaagccgcttccgtccgcggcctgattcagataccccctcgtcgcgaatccgttcgagacatcgtcaccggtgccgacccggtactcgcctccacccgtctgggccgaatcctgttctggctggtgaccttcaccatgctgtacatactgttggtgttcgctttctggggtctgtttatttactgactacttcattgagtggagtctgccgggcgtcgcggggaaaggagatgagatgtcgctgtaccgagacgaaggtgtggtgttgcgcacctccaaactgggcgaggctgatcgtatcatcaccatcctgacgcgtgggcatggcaagattcgggcggtcgccaaaggcgtacgtcgcaccaaatcacgcttcggtgccaggctcgagccgttcatgcgcgtcgatgtgcttatcgctgaaggccgctcgcttgacgtggtatcccaagctgaagcggtcgccgcttatggtgctccgatcgcggcggattatgcggcgtatgaggccgccaacgtcatcgttgagactatcgataaaatcgccagcaccgaacatgagcagctgccgaaccaatatcggctgctcatcggcgcgttgaacgcgctcgccaaacaatcccacgccccgcaagccataggcgactcctatgtgatgcgcgccttggccttggccggttggacgccacgattgggcacttgcgtggtatgcggcaaggcggagccggcgtacctgtccatcgcgtccggcggtgtgatgtgcgaagccgaccacactaccgatgcgcgccgtatcgcaccgttcgtgttaaaccagttcgatgcactgattcgtggcgattggtcggtgcttgatgccgcgcctgtggagcgggttgtgcaggagttggttgaagattggggggagtattacctcgaacgcccgattcgttcgctgcgcttgatagattcatgagtatggcttttgagaacgttgattacacgtcgttggacattcccgcagctccgttcagcgaccccgctcgtattcccgacttccccaagaacaaggtaccccgccatatcggtgtgattatggacggtaatggtcgttgggccaagcagcgcggcatggtccgcaccaatggccatcaggccgccgaaccggtggtgttcgacactatcgccggtgccatcgaagccggtgtacggtatttgagcctgtacacgttctccactgaaaactggaagcgctcgccacaggaagtgcgcttcctcatgggtttctcgcgtgaaatcatccaccgtcgtgtggaacagatggacgagtggggtgtgcgcgtgcgctggtccggccgtcgccccaagctgtggaagtcggtgatcgacgagcttgaagccgccgaggagcgcaccaagaacaacaaggtcatcgatgtggtgttctgcatcaactatggtggccgtgctgaaatcgccgacgcctgcgccgccatcgctcgcgaagtgcgcgatggcaagatttccggcgaccgtgtgactgaaaagatgattgccgaccatctgtacaatccggacattcccgattgcgacttggtgatccgtacttccggcgaacagcgcacctccaacttcctgccgtgggaggccgcttacgccgagctcgacttcgtgcccgaactcttcccggactgcggccgtgacgtgctatggcgctccatcgaccattacatccaccgcgatcgccgattcggcggtgtgaaatagtccttgttaggccccctctgacgggctgagccgtaaagcaaacagcccggtgggctgtttgtaggcgaagacgagacgagagtcaagccagaagaatgcgagcggcagcttgtccgtaattgcggtcgagctgcccgtgtagcggactgaggggagttaccggcacacctcagccatcctctctacaaactcatccaaaaaacgttccgaatccacaccaagtgccacatgcacatgcggcatggaatgattcaccagcccaaccgggtctccggtggtccggcctcgtactccattgaaatcaccggtattggtctccgcgcgcaacgcaagatcaaaacaatcgaccagtgaagaatcaagtgcaaccgccgccgctaacggatcatgcaacggcataccgccagagaacagtgcggggtcggcttccaaatttgccttgatggaaaagtccgcgagatcagccaagaaccgcccgcgcttggtccccgtcgcacgccaccggtcggccgccgattgcggtagcaaacactggtgagtcacatcaagtcccaccattgtgatgtctgcgccggaatgaaatacacgattcgcggcctcagggtcttggatgatattcgtctcagctaccgcatcccaacaattaccgggttgggtaagcgtaccgcccatcatcaccagcctgagtttcgatgcaatatccggtgctcgagtaatagccgcatccacatccgtcaacggcccggtagccagcacggtaacgtctcggccaaactcgcgaacctgctcaatcagatactcaatcccatccgcagcatcaacggagcatctccttttgcccccgctggcgagagctgtcggcatagtcgactgggggtggcccaccgaccgagagcggttcacacgagaacaagcacccaacgccggatgagcatgaacatcccccgccaaatacccgccaacagaaacaacctcatcgggcacatccacagacatgtcatcaccagacatatcatcaccagacatatcatcaccagacatatcatcaccagacatatcatcaccaggcacaccagctccatcagccagagccccggaccctgccagccgagtattccccagtccatcatccccgtggaactgggcacaccctgcatcaggaataaacgcatcagcccaagaaggatgctcagaccctaaaaacactggaatatccgcccgaccaaacaaatcaagcaccgcgcaagtattggcataagccgtgttcgcatccacattgccataactggcaatcacgccacccaactcgcactcatccgtcgaccccaacaaatacgccaacgccaacgcatcatcaacacccgtatccatgctggcaataatacggtcaggacattggaccatagaatcgtctccttgttagcgtgatccgttatgaataaccttatcggccgatacgcaaaaatgcgtcctttcctcatgggaaggacgcatttttgcgtagattcaaactcggaatatcggaaattacttgccgatgaattcgtcggtggcaaggtccttggcctgcggggcctcatgaattatcttgtcatgactgtcggtgtatgcgtcttcttcagccaggaagtcgaagtattcctgagcgcccttgaagtcgttggtgccgagcacgaaagagccgtccttgatcttggccggatcgccccagtactggccgtcgacgataacctgcatgctcttcttgacgaattcgggcttgaggttggcgtcaggggcttcgtccacgagaatctgcgcggcgtcatccgggttggcgtacgcgtactcgtaacccttttgagtggcctgagtgaacttcttgaccaggtcgggattgttcttgatggtcttgtcattggtgatgatgccgatggtgtcggcgttgccgggcacgccatagtcaggctcggtgaagcagttgagcttcgggccgtacatgtcggcttgcacgccttcccacgtggcgtagaagccgccgaaatcggccttgccggattccatggtctggaaggtggaggtgccgacggtcaccttgtcgaattcgcccttgccgccatcggtttggatcatgcggcgcaccacggcatcggactcgttggagccgaaggtggcgaaggtcttgccatccaaatccttaggggacttgatggcggtgttggacgccagtgcgcaccaaatggcgctcggcttctgctgcacctgcagcacctgcttgatgtgagcgcccttcagcgtgtagacgcccacgttggtcaggttggacagggcgaagtcggccacaccgttgttcacggcctgttcggcaccggcctgggccacggccacgatatccacgtcaaggccggcgtccttgaagtagcccttgttcttggccacgtacacgccgatgtggttggtatcgggtgcccaggaaagcatgaaagtgaccttcttgaggtcggaggtgttggagttggaggagtcggcggtgttggtctggccacatgcggcgaaaccgaaagtcatggcaagggcgcccacgagggcagcggccttggatacaaggcttttcttcataatgatggttccctaattcgttgtctctctatcgttctctgggattgcttcgaacggaagtcggcagaaaacgatatggagggccttgatttccgttcgaccagcgcccccgacattccctatgaaagctcgggaaagccggtttgccacacgctggtaaagctgttccattatagagacagggttggagacctcatgagaagccgcttcgttcagtcggtcctggccgccggctcgtgcctttgacggtaaaaaaagaactactggtccgcgtcggggtcttcgtcgtcgccgggcgggccgagcaggatgcgctcgctggcgtttaccgccagcatcagtacgcatgtcatcaggataatgacgatggtggcggagaagatcagcggcgtgcggaatgaattgtaggcagcctgcagccagatgccaaggcccttgcgtgcgccaaggtattcagcggtggatgccgtggcgaagatgtatgcggcagatactcggataccgccatagatctgacgcgcggcaacgcgcagcttcacgtgccagagcgtccagaccggggtcgcgccgcaggtcaatgcgacgtcggaatagaactggggcactgcttctagtccgcgcacagtctgcacggcgatggggaagaggccgaataccgccacgattacgattttgccggaaatctcaaaaccgaaccaaatcaggaacaacggggcgatggaaatcagcggcatggtttgtgcggcggcaagcagcggatagaacgccgcgttgaacgtgtgcgagcagtacagtgcaatgccgatcataatgccgaagaacacggcaaacaggaatccaaccacgccctcatagccggtgattgccgcggccgggccgagcgtgttccatgtttcgatggtggcggcgaaaatctcgcttggcgcggagatcatcgtgggggagacatgtcctagatccacccacgtttcccagactgccagcaatacgatgacggcgatgacggtgggcatgcggcgcttgaggcgcttggcgatggacatgggatgtcaccttgctttccgcgccagtccggtttgctggtggcgcttgcggccggggcgtggaacagtaaggtgaggagcctgcgcgcctgccggtcgtgtgatggattgtgttatatgccgtccatcagtataggcgaaggcgaacgacagggcgcacaaaaaaacctccctcgtcagagggaggtgaaagagctactccagtccgatggacttcatgtggtggagcttcagggaatccaccttgagactaccggactcggcgacgagcttgatggcgcgcgggccttcggaggcgtaggagtaggagctcagcacttggtggccaccgttgacgtagacctccacggagccgcaatccacgaacacgcgcaggtccagcttgccggaggccagttcggcgtcggtcagtggggcggcgcggtagccgcgatcgccgttggccatggcctgacgatccaccaccacgcggccgatctggccgtcataagccacgtaggtgtaggcaccgtcctcagtggcgtgaatcttcagacccgcacgctcggcagtggaggcagccaagtcgatggtcatttcgatttccacggcctcggcgtcgtcggcgatgatctgctcgccatccatgtcgagtgtgaccgaaccatggtcgagggtatcctcgcgcaggccttccatttcggcgaccggcgcggtgaccacgtcgccgtcatcgccaagggtgatctcgcgcggcagggtgagctggccacaccagccgtcatcctccatgggaatcggctgcacgaacgggctcatccagccatagacgatctgacggccgtccacattgaaggactgcggggcgtagtagttgtggccgcaatcccacaggcggaactcggtttccggcttgaattcgccgcccggctcccacgtgccgatcatgtagccggcgttgctgacgttgcggttcatgaagccgctgggcttggaccccatggcggagaagccaatgacccacttctcgttgccgtccttgtctttgatggggaagaagtcggggcattcgagcatgaacacatccggatccgggtgctggaagagcacgcgctcgtattcccagcggaccatgtccttggaggagaacagccacatctggccgcgcttgtccgcagaggagacaccgaaggtcatgtaccaggtgtcgccggtcttccagaccttcgggtcgcggtagtggtggtcgaccttgtcggtcgggcagtcgatgatcatgccctgcttggtggcggaggtgagctcgtcattgtccggcagcgcggtcatctgcacctgccagtcgccgccggtgttgtcgttgccgttggcccaacggtggccggtgtagtagaagcgaaggtctccgttgtcgtcgatgacggcggaaccggagaacacgccgtccttctcctgctctaaggacggcgcgaacatgatgggctcgcgcttccagttgagcatgtcggtggaggagacgtggccccagtgcatcggaccccactgggtgccgtaggggtgcagctggtagaacacgtgccagcggcccttgtagaagcacaggccgttcgggtcgttgatccagccaccgttggaggcgatgtgatacttcgggtaccagcggttgttgcgcttggcggccatctcagccacgccggcttcggcttttgccagttcagcagcgtggtcgcggatgggggtgagaacaggggtttcgggagtgaagtcagtcatggctgtcctttcaggccttggccgcttccatctgacgcagctgcttgtcggtgtagaacgggtcgccgccgacttcctgatcatcatgcttgatgacgaagaagccgtaaatcagtgcgcacagcacgatggcagagatgacccagaaggtcacgcgggatcccatgtcgttgttcggcagaatctgagccatcttgtcgtggaaggcacccagaggggtcgagaagatgacctgacccacttgggaagcgatctggaagcccaccatgtacagcgtggcagagagcttggtgtcgaagtgcagagtgaagtagcggaatgccggcaggcagaacagcggcacttcgatggagtggaacagcttgacgatggagacggtgatcgggtcgtggaacacgccgcacaagccgatgcgcaggaacatcacggtagcgccgagcagcagagcgttgcgcacgccgatcttcttcatgatgatcgggaccacgcccatcattgcggactcaaggaagacctggaaaccgttcagggtgccgtaggtggcgttgccgatttcttcagtggggaagaggttggcgtagtaggtcgggaacatctgctgatcgaacacggtgtagaaggtgttggtcagcagcatgaagacgatgagcacccacagggtcggcatcttgagaacggcgaccatttccttgagggacgggttggtgggggctgcgttcgggtcggtttccttcttgagctcttccttctgctcggccgggacccagaaggcgtacacgaggagcatgccaaggccgaatgcggagccgacccagaagttgatcagcgggttgatgttgaacaggaagccggcgcacagcgccacgatggcgtaaccgaaggagccccaagcacgggactggccatattcgaaaccgaatttacgggagtagcgttcggtgacggcctcgaacagggagcagccggacatgaagccggcagacagaacgatggagccgatgagtgcgccgatccagcgggtggtgccaccggcgaggatcatcggggcgtaaacgaattggacgaatgggccaacgcaggcggcgattaccgagactacgatgacgagcttgcgcttgatgccgagctgatcctgaatcacgccgtacacaaacatgatgaccagggtggccagcgagttgatggagtagatggtgccgacttcagcattggtcaatccaacgcctgagatgagccagcgctggaagaaggaccaccagatgccccaggagcagaagaacatgaagatgccgaaagagctctgcagataggaaggattcttccatgcagatttggttgcacttgccataatcatcctttgattactacttggttggttattggttatgtaacgcttctgctcgggcggccgtgcctttgtagaagttgttgcgtagtaattattatgcgacgtcaatcgatttacgtcaatcgattgacgtaaatcggcgtgtcgtatccgttcgacacgcaaaaggcctccgtgctgaacggaggccttgagaaatcgtgtgggactcggttacttcaccgaggccttttcgatcagcgtgcagtggatcttcgccggaatcggcgcgtcgatcggcggcaggggagcggtggtcgctggccatgagacgtcgtccatcgagcgtccttcgataatcgacaccagcttggccacggcccagtagcccatctcgaaatgcggcagttccacagtggtgagcatcggttccagcgtttcggcgaacacgcgatggttgtccacgccgaccacggagatgtccttgccgaccgtgagtcctcggcgtgcggcgcattcgtacacataccaggcgcgggcatcgttgaagcagaagaatccgtccggatgctcggcatcgaacaaatcgctgactgcggtcagtgccggcccgttgttgagcacattgacgaccagatgatcgtcatagtcgaggccggcgtccctgagcgccgcctgatagccttccaaacgatcgtcctgcgcaatcagcggctccaagcaacccacataggcgatacgtgcgcatccggccttaaccaatctggtggtggcgtcgtagccgatttggaactcgtccggttccacgctcgggattttgccaagcgagtcggtggcatccaccaacaccagtggcgtcttggccagcgaggaaggcacatgggtgatgcggttcgacatcttggcgtacagaaagccgtcggtgccgtatcgcttgagtgcggcgatttcctcgctctcgctgttctcgccgtcggtgctcacggtgatgagcatatagccgaactggcttgcagcggtctgcgcgcccagaatcataccgccggcgtacggggtggtggccacctcctcactgatgaaaccgaggatgtgcgtcctgcctgtacgcagcgaactggccagcggattcgactggtagccgagcttggtggcgatggcgcgcacattgtccgcaattttggactttacgcgcccctcgtcgcgtccgttgagcaccagcgataccgtagagacggaaacccccgccttgttcgcgatttccttcatcgtaaccatgcgtcaaacgatacaccctaattgacggactgccaggaaagtatcagttttctccaccgactccgccgaggttgcgcaccgcaccgatgaataatggtatgccgtccggggtgacgtacgaatacagaaatgggcgatccaccgtgaactcgacgttgtccaccggcgcgctaacggagtctgcgccgaccttggtgaaggacatggccttggcgccggcttcgttcacctcgatgcgcgtgccttgcagaatcgagccgatatacaggttctcgccgtgcgaaccggtgtcgatcatcttggtgaagtcggcgtcgcctgcactgaacgcatcggtcacccccagtttttcgaatgccttgatggtggcttccgagtcgaacatgctgtcgatggtgaatcgcggtagcgtgacgttcaccatgaccgagttgacggagacgccccatccgggcatactgtccgcggcgcaacccattgcgccctcgccaagggaagccgtcgagcatgtaccgaacgcccaactgagcttctcggcatcgccggccaactcgtcgaaatgcccttcggccggcagcacgatggccagattgccgccgttgtcgaacggaatctccacccgctgccaagtgttgtactcatcatgtccgtaagccatttggctgaaggtccggtgcatcatcggcacctgagcatctccggcttcgccgtggaaggtgccgttgccggtggactgctcttcgaacggatccttccaacggccatccgcatagacggtgttgatgatggacaggacttcacggtcacgcagcgtgatcttcggcttgagcgaaccattcgtatgcttggcgatccaatcggacatctttgcggcggcctgatcgtcgaacggtaacgtggtgacttcggcctcgaacatcttcttgacggtggattggtaatcgctggcaagagagtagtcgtcatcaatccacagcgagttcgcggcgctcatctcggatttcgcccccgaatattgcccgttgatcgaacttagcagcgattggtagtcgctatcggtcagcgaaccggagcccagcagttcgttcagttgcgagcgggtcgtgccattggcgccctgcgcggcgatggccaacgccatccacatcgaagcaggagagtagttcacattgccggtgcctcggtcgccggcttccatcgccaggaattccggtgcggtgcggtaggcgaaggttgcggtgctgttgactaccggctgcgtggcaggcgtggccttcggcttgaacatattgcgaaccaatgcgctgccatcgccggccgtccaccatacgccgccggcgacggcaaggacaagcactactgtcacgatggcggcgatacaagcgttacggcatttgcgttgtccgcgcaaccggtactgttccatcagttgctcgctcatggttggcccctttgcttggatcggctcgtgcatcattgcatgaaatcgctgttttcattatattgcggctttcccttgagcccaggaacggtatgggaaccccggccgtaagcgaagattggtccagccgaatgccagtggtccgatgattgcgctcgccaacgggaaagacagactgccggatcgtgtcgaaccgagtatcaagttggtgattcccaacaccaatggccagtgcagaaccataccggggaaccatacgaacaggtttttggcagccctgtcaagaacctcgtcgggcatgagatacattgatgagctccactgcagtagcagcaacaccgctatcagtacaaccatgccaatccaatgcgcgcggttccatgtgaacagtcgttgcatcccgcgctcggcggcggcattgcgcatatcgctcctgttgagcttgctgagtgcttgtgcacggttcattgccgtcctcctttaccgccttgtcaaggattgatgatgattccatcgtaaatcacgcaggaaatgtggaatgatagttgtcatagtgaccatgacgtgtcaggacggagtagttcggcgtcgggcacactgaaggggtgaatgtaatggaagaagcgcgcaaccgcaacatacgcatcggcattgtggacaatgacccatatgcgctgaaagtgttcggcgcgctaatcgaacgtatgtccagcgattttgccgtgatatagacctgcgatttgggtgctgtggccatcagccgatgcctgagccccaccaagcggcctgacgtgctggttacggatatgtctatgggcgcattggatcgcacgcatcaagtcattgatgtgattgaaggcaggggagaagcggcgcacagtgcagtgactccgcatgattcgaccgttgatgccgctcctggcattgcatgtgacatcacagacgctgattgtccgctggagacgcagacctatccaccggcaccggcctcaaccgttaccaacaattactagaacaacaaaacggcgccctgcatatcaccacgcaagacgccgaatggacattatcagcagttattccactgtgaggaaaccgatcacccaaccgacttctgcgcagtctccgcgccaaagaagccgacaatcagcatcgatgcaatagcaatcgcgctgatggccacaaagatggacgtggcaccaagcgaggtaagcatccagcccaccaccatcggcatcaacacattgagcagcttggccacggcgttcgcgaagccgacgcaacggaagcgaaccttggtggcgaacagttccggagcgtacacagccaccacggaagccataagcacgtacaggcacatcatgagcaggaagccaacgataattgcgctcacggtagaggtctggaaggcatacatcaaaccgaacacgccagtgaacaggaaggccggcacaatcgtgcgcttgcggccgatacggtcgataagcagagagccaatcaggcagccgaccggggcaccgagcatcatcaccgtggaggtgagcagcgagctggacaggttaataccacgcttgaccagaatcgtcggaacccaagaagtgaaggcgtaggagcacacgttcgtggcggccacagcaaccacagccacaagcaggcagatgccgagcgaacggcctccggcgttgcgggtgtcgctggtgtcggccttggcggctgcgtcgatcggttcggaaccgttggcctcaagctgcttgacgatggcgtcggcctcatcgtaacggccgcgcacggcgagccaacgcggggattcggggatgtcgcggcgcagccaccagatgatggcggccaccaggccgatggccacgaacagcggacgccaggaccagcgggggatgatccatgcacacagcagcatagcgattggcacaccgcagttggccacgagcgagacaatcgcgcaccagtggccacggcggttcatcggtgcgaactcgttgaccatggcgaagccggtgacgatttcagcgccgaggcccaggccggcacccagacggcacagggacagcacagccatgttcggggcgaatgcgccgaggaaggtgaagccgccaaacagcagcaggttgatttggtaagccacgcggcggcccttcaggtcaccgacgaagccggccagcagcgaaccgaccagcagacccaggaagcccgcggacataaaggtggaattttgcgcaacggtggaccagcgggtagccaacgtgctggaggcgacggcgctgccaatatatacgtcgatgctgtccatcagcatgccagcggcgaccagcgtcacgatgcgatggaacatcggggtttcatgtgcgcgatccatgcgcgagataatatcctgaaccttggcttgatccgtcacggtggtatgtgcttgtgcgttttccatagccgcgggattgccggaaatctgctgttcagcagcagtcatatttgagccctcttcttgcaaacctgcccgcgtgcaactgctcaatggtgttgcggcgagcgaactcttgattggactgtgtgttccgttcgccctcccattgtgtgggatgaacgacgtttgcgatccaagtcttgaattctacgtagcgagccaatcgttgtgagatagctcactacatggggcttaactataggttcgattttgtggcacgccgcgttgcggtcacatcgtgaacgataacagaggttgtgacgctcctatatatgccccacttacgctcttaccccgtcgaaagaaggcagaaccgtgattcccatggggcggtaaaacactcatggggcggtatttggcccatggggcggttagcggattatgcctttccgcagaatagagccgttttcgactaccgccccatgagggttttaccaccccatgggtgagctaccgccccatgaaacgtgtaataacaaagcatgcccttgctggtggaagcgatgctttgctacttcgcctgcttgtcggcgaggatctcatccaccagcttgggcttttcggtcagctggccggtgaagccggggcggatatccatgtgcagcaccagagaagtgcggtagccctgctcggcgagcttcttggcggcctcaccggccaccttgagcacgtcgtccagatcgccttccacgttggtgaacagggcgttggtttcctgcggcaggccggattcgcgaatcacctcgacggcctgagccacgtatggcgaaacctcggagcccacgccattggccgacacctgaatggcggccacggtattgaggtacggtttgccggtttccgggtcgatcggcacttcctgagtaacggcattacggtcaataatcataattctccttttattacttggctcccctcagagaggagagccagtaggactcagcgatacttccagaaatgatccatcgggccggagccgtggccaagattcagctgggccttcagcgcaccggtcagatacttcttcgcatgcttgatggccttgggcaatgtgtcgccaagcgccagatacgaggcgatggcggagctcagcgtgcatccggtgccgtgcgtgttcggattattgatacgcgcgccatcaaaccaggtcacggttccatccgtctcggcaagcacatcgttggcatcctcggtgccatgaccacccttgaccagcgcggcacagccataacgctccacgaggcggtgggcggcggcctccatatcctcctgatcgcgaatcagcgtatcggtcagcacttcggcctcgggaatgttcggagtcacgaccgtggccatcgggaacagcttgccagtcaaggccgcaatggcatcgtcactgatgagattggcaccggaagtggccaccataaccgggtcgagcacgatgttcgtggcgtgatggaaggtgagtcgttcagcgatgacgtcgatgatgtcagtggcagacaccatgccgattttcaccgcgaccggcggaatatcctcaaacaccatgttgatctggtcggcgagaatgtccggtttggtgtcctgaatggaacgcacgccggtggtgttctgtgcggtgagcgcggtgatggcgctcatgccgaacacgccgcaggccagcatggtcttcagatcggcctgcatgccggcaccgccggacgagtcggagccggagatcgcgagaacagcgggaagtgtagatgttgcaatttgtgccatagtgttcattctaagtggggcccatgatgtttttcggagcggttttccttgatgttttgccgctcctgtggtgagacggggaaggtttgctgattgcaattgattcatgaaatgttcgggaggaggcatggctgataacgatgtactgcgccgtgacggcgtcttggtgcgcatcaccggaactcaccgcatattttggcgtaatgcctaacggacacaccacacagctcacatttccgcgtcaggaagtgttcgatgtgggcgacgtgttgctcgtcggtacggatttctatcgcaaagtgccgcatgatgtgtggccgttgaagccccgtgtgggcatcgtgcgccgtgcgctcaacgaaggcgtggtcctggagacttccgacggcctcggtccagatggcgcacacttcggcaccgccttcgagcgagtcgagcgtcgtcccgaattaagacaccaccgggcataataattggctcccctcagagaggggagccagagaggtttactcctgggcggtggagtagagcttgccgccctgggcggtgtacttttcgctcatcgcatccatgccggcgaggatttcttcggggctgagcacgttggcggacaccacgccgttatcgacattggccttggccgtagccagtgcctcggagtcgatgcctgcagcagcctccttcacgatttgctgctgagcggcctcgccaccgaatgccttgcggatgttctgggagatggccatcgagcagaacttcgggccgcacatcgagcagaagtgcgccatcttggccggctcggcgggcagggtatcgtcgtggaaggcgatggcggtgtccggatcgtaggacagattgaactggtcgagccaacggaactcgaagcgagccttggaaatcgcattgtcgcgatccatcgcgtgcgggtggtgcttggcgatgtctgcggcgtggcaggcgatcttgtaggcaatcacgccctgcttcacatcatccttgttcggcaggccgaggtgttccttcggggtcacgtagcacagcatagcggtgccgtaacgaccgatctcggtggcgccgatagcggaggtgatgtgatcgtaacccggagcggtatcggtggtcagcggtccgagggtgtagaacggggcgttgtggcacacggccttctccagctcgatgttcatgcgtacggtgtcgaacggcacgtggcccgggccctcgatcatcacctgcacgtccttggcccaggcgcgctcggtcagctcgcccagagtcatgagctcggaaagctgcgcggcgtcgttcgcgtcggctagggagccggggcgcaggccatcgcccagagagaacgccacgtcgtacttggcgaagatgtcgcacagctcgtcgaagtgcgtgtacaggaagctctcctggtggtggcgcaggcaccagtcggccatgatggagccaccgcgggagacgatgccggtcacgcggttggcggtcagcggcacgtaacgcagcagcacgccggcgtggatggtcatgtaatccacaccttgctcgcactgttcgattacggtgtcgcggaacagttcccagctcagcttggaggcatcatcctcgaccttttcgagggcctggtacatcggcacggtgccgatcggcacgggggagttgcgaagaatccactcacgggtggtatggatgtcgttaccggtggataggtccatcacggtatcggcgccccacttggtggcccacgtcagcttctccacttcctcatcgatggaggaggtgacggccgagttgcccatgttggcgttgagcttggtcaggaaggcggatccgataatcatcggctcggcctcggggtggttgatgttgcagggcatcaccgcgcggccggcggccagctcggagcgcacgagctccacatcgcagttctcgcgggtggccacgtactgcatctccggggtgatgatgccgtggcgggcgtaccacatctgggtgatcgggtggtccttggcacgcatcggctcatgcttgcgtccacgccattccttggtggcgcggccgcgcttgatggcgcgcttgccatcgtcctcaaggttgcggcggcggccctcgtagtcttcgatgtcgccgcggtcgcggatccagtcgagacgcaggggcttcaagccttccttcgggtcgcacttggggccttcggtgttgtagtcgtggaacggcgggttcgggcccacgccgggcgtgtcgctcagcttgatttcggtgtacggcacttccaggtcgtaggaaccatactgataggtgaacggtacggacttggtcttgcggatgtgcgccttgtcgcgctgcttggaaccacgggcggcgatgtccacgcgctgctgcttggcaagcttctgggcatccttggcgtccttggcgttggtgaacttcttctcagtggcctcggaaccgggcttcgcggccccttcctgagcagcctgagtgtcagtagcgggggtgtgggttacgacgcgcggagcgtagccgtgcttcttgtcgccgcggacggccttccagccttcgaccatggtgcgcgcggcctcttccgggttctcggcacccgcgatggcggagaccacgaaccagccagcagccttggtatcggcgagcatggccatatcggctgcggtcacgccgccgcccacgaccaccgggaattcgctggcaacgcagatggtgttgatctgggcggcgtccagcgtcttgccggagccgtcgttgccgcccacggaagcctcgggcttggtggtggagacgtgcagaggaccggcgccaatgtagtcgatgcagccgtcgggcagctcgttgatgagccgaacgaggctttcggtctcagccgacaggcccacgatggcctcgtcgccgagcagggcgcgggcttcgcgcggctccatgtcggtctggccgatgtgcacaccgtccaccttgatgcccttgcggcgggcctgccacaccacgtcggcacggtcgtcgatcacaaaggccacggaatcggacttctcattgtcctcgatgatttgcgcgatgtcgcgagccatgtcggtcagctcagaggcatcggcctccttggcgcgcagttggatgaaggttgcgccgccgtgcagagcctgatccaccacgtcggtcagcggacggcctttgcagtcctccggccccaccacgaagtacgcggacaggtcgaagctgtcgcgcatggaggcgtataggtattcattactcattattattcctgcttttgttgtttcttgtggaagtcttattggaaaaaactgttatgagctccctcatcagagggaactgaaactactgcaccaaaatctcggattccgccacctgttcggcggtcacattccacagcgcgtcaaggaacgcaacttggaacgagcccggtccgtacgaagttgtatcggccacctctcccgcgcggttgtacagcagagacgcggacagggcggcggtcaacggatcggagaccgccaaatacgtggcagccacgccgcccagcgagcagccggcaccggtgatcttggtcatcatcgcgctgccgcccggcagtcggtacacggtttcgccatcggtcaccagatcggcgatgccggacacggccacggcgcagcgggtggaagcgtcatgggaggaatgcttggcgtgctgttcggtcagatactgtgccagcgccaccgccgcgccggttgcggactccacgtcgtcgacggattccactccggcggggcggtgctcggaagcgtcccccacggtttcggtattgagcccccacatgttcgccagcgcgattacctcggatgcattcgcgcgaatcatggtcgggggagcggccttgaaggcctgaagaatggcggtacgggtgcggccgatgccggcggccaccgggtcgagcacccacggcttgtccaagtagttgagtcgctgggcgatttcgggcagtgcgtccttatagaacggcagcagcgtgcccacgttgatgtagttcgcgcccgcgattttcgcggtttcgatcacgtcgtccggcaggaaactcatggccgcagtgccgccggccgccagttgcgcgttggcaaccaaattgatggtcacaaaattggtgaatgactgggccaacggagtcgtctcgcgtacgcggcgaacggcatcggcgatattgtcacggatgggtgaatcggctggaaccggagtcccggcggtataaccgctggacacgccggtaaacgatgatgcactattgctcatttactgctccctacgatggtcttaaccaacaggttctaagggtcaggctcaggcctttctcaactcgcgaaccacatgcgagttcccctgcattacagtgccgacgctatgcgccaacatggacattatcgtgacggatttgttcgatacgtgtcgtcaggtctggcgcgtccccgtccattcgtgatacatagacgcctccgccgagcaacatctcccgaatttgtgacgctgacgcgatgtcagtggcacaaattcgggaagggtaaaacaacaggaacaatatggaggtgttgcgatataggaatcgctgcgaacggtcgctcgtgagacgcggaacatataccggacaatgccgcctgacctgtcaccatatacggctatcctgaagcggttgttattagaccccaaaccgttcaaaccagaaggtgcattgtggctcagtccaaactcgatgaagtcgtatcccttgcgaagcgtcgcggcttcgtgttccccgccggcgaaatttacggcggcacccgttccgcttgggattacggccctctcggcgtcgctctcaaggacaatatcaagcgtgaatggtggcgctccatggtcgtcacccgtcctgatgtcgtcggtgtcgacacttccatcattctgccgcccgaagtgtgggtggcgtccggccacgtgagcgtgttcaacgatccgctcgtcgagtgtctcaactgccacaagcgcaaccgcgccgacaagctcgaggaatcctacgccgagaagcacggcgacaagatgccggaaaacggcatgaaggacatcgtctgcccgaactgcggcacccgtggccagtggaccgaaccgcgcgacttcaacatgatgctgcgcacccacctcggcccggtcgaggacgagaacagcctgcactacctgcgtccggagactgcacagggcatcttcgtggacttcaagaacgtgatgacctcttcccgttccaggccgccgttcggcatcgccaacatgggtaagtccttccgtaacgagatcaccccgggtaacttcatcttccgcacccgtgagttcgagcagatggagatggagttcttcgtcacgcccggcaccgatgaggaatggcaccagtactggatcgacgcccgcacccgctggtacatcgacctcggcgtcaagccggagaacctgcgccactacgagcatccgaaggagaagctctcccactactccaagcgcaccgtggacatcgaatacaagttcggcttccagggttccgactggggcgagctcgaaggcatcgccaaccgtaccgattacgatttgagcgcgcactccaagcactccggcgaagacctgagctacttcaaccaggccaccggcgagaagtacgtgccgtacgtcatcgaaccggccgccggcctgacccgctccctgatgtgcttcctcgtggacgcctacgatgtggacgaggccccgaacaccaagggcggcgttgacaagcgcaccgtgctgcgtctcgacccgcgtctggccccggtcaaggccgccgtgctgccgctgagcaagaagcctgaactgcagaccgtggcccagaacctggccgacgacctgcgcttcaacgagtggatgatcgactacgacgagtccggtgccatcggtcgtcgttaccgtcgtcaggacgagatcggcaccccgctgtgcatcaccgtggacttcgacaccctcgaggaccacgctgtgaccatccgtgagcgtgacaccatggcccaggagcgcgtcgctcttgacaaggtggccgattacgtggccgcccgcatcggcgagaagcgcacccgcgtgcccctgaagcctgtggaaatgggcggtgagccttggcctgagtccggcgttcaggaagccggcggcctgtactaagccggagtcgcacaacttgggctcccctctgtgggctgagccgtaaggaagacatcccagtgggctgtttgtaggcgaagtggcggcgatagacgccggggctcctctctcaggggagcccctacttattttcttaggaatcacatggcacaatccgaatccgaaacagtgctcaccgagcatcacgagaccgacaacctcgacccacgtacggacgcgccggcgcgccccgggaccccggtgcatatcgccccggtccaactcggcaacatcaccgtgccgaccccggtggtgctctcgccgatggcgggagtgaccaactggcccttccgcgtgatttgcgaggaatatggtcccgatggactctacgtggccgagatgatcaccgctcgagccctcgtggcgcataacccgaaagcactgcgcctctgtcatttcgccaaaagcgaaaaaatccgttcactgcagttgtacggcgtgaacccctccatcaccgaacaggcggcgaaaatcgtggtcgacggcaacatggccgaccatgtggatctgaacttcggttgcccggtgcccaaggtcactcgtcgaggcggtggttcggccttgccttggaaaaccgacattttcactgagctattacagcgcgtggtcgccgtatgcgagccggcgggcatccccgtcaccgcgaagatccgcgtcggcatcgaccataaccatgagaccttcctcgaagccggacacatcgcgcaggaggagggctgcaaggccgtaaccctgcatgcccgtaccaccgccgaatactatggcggtcattccgactggtcccgcatcggcgagctcaaggaacacctcaacattccggtattcggcaatggcgatatctggggtgccgaggatgcgctcgaaatggtgcgcgagaccggctgcgacggtgtggccatcggccgcggatgccagggccggccgtggctgttcgccaacatcaaaaacgccttcgagggcaatcccgaacggctcaacccgaatctgggcgaggtctgccgcgtgattcaccgtcatgccgagctgcttaccgagttttatgagggcgatgagatgatggccgtccacgatctgcgcaagcacatcgcctggtatctgaaaggattcccggtgggcggctccacccgcaaggcctttatggaatgcgagagcctggccgatgtggaccgcgagatcggcaagctcgacccgactatcgaatacccgccacgcgtggtcgacaaaccgcgcggccgcgtgcgtttcgccaagaaggtgcacttgccgtatggctggttggaatcgcgtaccaccacccacgaagagcgtgaggcgctcttcggtgacgacccaatggacgccagttactgagaaaatactgaaaatacacgcaacacgcgccattctgcgcgtgaatttccctccaagagtagcctgtttgcgctactcttgggtgtaaccgtgaagtgacaggagccaaacgtgagcgagatcgcgcagaatgagttcaacgacaagaccaacatcaaggttgttggcgtcggcggtgccggcggtaatgccgtcaatcgcatgattgccgagggattacagaatgttgaatttgtggcggtaaataccgatgcgaaggatcttctgcgctctgatgcggatgtcaagatttccctttccgataagtccagtcgtggtctcggtgctggtgccgacccggagcgtggagccaaggcggcccaggaccaccagtcggatatcgaagaggcgcttaggggtgccgacatggtgttcgtcacctgcggcgagggcggtggcaccggtactggcgccagcccgatcgtcgctcgtgcggctcatcaacagggtgctctcaccatcgcggttgttactcgtccgttcagcttcgaaggccctcagcgttccgcttccgccgaatacggcatcgacaacctgcgcaaggaagtcgacgcgctgatcgtcattccgaacgatcgcctgctcgagctttccgaccgttccatcggcatcattgaggccttcaagaccgctgataccgcactgcttgccggtgttcagggcatcactgacctgatttcgatgaactcctatattcacgtcgacttcaacgatgtgaactccattcttcgtggtgctggtactgcgctgtttggtatcggttccgcacggggagaggatcgtgccacgcaggccgccgaaatcgccatcagctctccgctgcttgaggaaagcatcgaaggcgcacacggtgcgctgatcaacatcgccggtccgaccgacctgaagttgcaggaggcctctgctgccaccgaactggtgcgcaaggccattcaccctgaagcccagattatttggggtcttgctctggacgatgcttatggcgatgaagtgcgtgtcactgttattgctgctggttttgaccccgtcgccgctcaagatgacgacactcagagcacggtgacgccggttgtgccaaccgccgccgatcctgcgactcccgtggcacagccagctccagcaccggcaccggctgcacagcccgctgccactgcccaaccggcattcacaccggctaccggtgactccgcatcgttgccttttgatgatccgacttccgctcatccgaatatcgccgtgaacgatccggctggcgatctcgacatccctgacttcctgcgctgaaaggattgatccatggctgggttcatgaaaaacgcgatgtcctatctgggcatgagtgacgttgtggacgatgaggacgactacatcgaggaggacgaggagcagaagccggcttcgaagtccgcatttgattccgaccatacggtcacgccgctggcgtcaaccaccgcgcctgccgcatcgtcgactaccaagccgttccccggtggtcgtgtgaacagaatcaccaccatccatccgaagtcatatgaggatgctcaactggtcggccgtgcattgcgtgacggtgttccggtcgtactgaatctcaccggtgtggccgaagccgtggcatatcgcatcgtggacttctccgccggcgtggtgttcggcgtgcgtggttccctcgagcgtgtcactccgcgcgtgttcctgttgagcccggcgcaggtgaacatcaaggtcgaagagccgacaaaaccagcctcggcacacgatttgttcgctgactgaccggttcagtagttttcgcattcgacgttatatcggtattcggccgactcccagcaaggagtcggccgattcttattgtgctccgagcaaacttttcatgcgcggttgttagtctgtcagcatgctttccttagtgttctctttgatcggccgcattcttgcatggctcatcaacgcgtatatcacggttctgttcgtgcgcatgattctggactgggtctccgttctcgcacgaaactggtatccacgtggtgtggtggcccagctgatcaatattgtgtattccattaccgaaccccctctgcgctggctacgtcgctatattcgcccattgccgctcggttcgatttatcttgatgtcagcttcattgtgctgtattttgcgctggtggtactggaaagtgttgttctgatagtgttctgaggccgtttttgacccgccggaggcatatatctggcataaaaacccacgtcgaatgttctgaaacgatggggtcgtgatagcattctgacttgagaccaacgtaagtgcgggcgatgccccaaagcgaggtgcaagatttatggctctgttgacgccgaaggatattagggagcataccttccagactgttcgattcaaggaaggttatgatgtcgacgaggtcgatgacttccttgatcaggtcacggaaaccgtcgaggctcttggacgtcaggcggtagccggcggtcaggccacccagtctctgggtcctgacgtgaccaaccttaatgcgaagatctccgatcttaccggtcaggtgcagcaactcgagtcggagaatgctggtttgaagaacgctgtggctcaggcccagcaggccgctcaggctggcaatgatcaggcagcacagcttgtctctgccaagctcagcgaagccgaggaatccaaccgcgcgctgtcctcccagaatgagcagctcaagggtcaggtcgatcagctgaacgctcaaatcgatcagctcaccgctcaggctgctcaggcctccggtgaccaggaggctgtcggtcagcagatcgccgccattcagcaggaacgtgatcagttccgcgcggccaacgaggagctgtcccgtcagctcgccgctgctcagcagcagggttccgccgctcagcagcagtccgctcagatcgctgagctgtcccgtcagctcgaagaagccaagcagcgtgaaaaccagcttcgtgctcaggtttctaaggtcgagccgagcaccgagaccggttctctgcagaagatcgctggcgccgcttccatgccgggcaccgagcccgagcgcgccaccgccatgctgaccctggctatgcagctgcacgatcagtacgtggagaagggcaagaacaaggccaaggaaatcaccgaggccagccagaacaagtacaacgatctggtcaccaaggccaacaactactccgagcgtacccgttccgaggccgacgactactccactcgtactcgttccgacgccgacacctattcggatcgtacccgctccgaggccgacgcttaccgtgaccagactcacgcggatgccgagacctactcccagaacacccgttctgaggccgacgcatactccgtcaagactcgtcaggatgcggacaactactccaagtctcagcacgatgacgctgacaactacgagaaggaagtgcagcagcgtgccgccgagtatgacaagaacactcgttccgcggctgatgcgtacgacaagaacacccgctctgcagccgatacgtatgccgagcaggtgcgcgacaaccttcaggctcagtccaaggtcgtcgagggcaacatccagagcctcaagcagttcgagactgaataccgcgcccgcctcaccgagtacctcggccagctggcatcgcaggtttccgagtcgaacaactacgtcgaccagacctcgtccaagaccaactgagcgtaggcaggtacaggtcgtatgacgaaccaacagggacggctgcgcacccgcgtggccgtctttgcatgtgtggccgcggctgcgctgattgtcgatcagctcaccaaggcttgggcgatggccgcgttatccaacggtcagaccattcgcgtgattcccggactgctgtccttcaccttggtgcgtaatccgggcgcgtccttgggcatgggatcaggcgctacttgggtaatcagtctgttggccgttgtggcttgcgtggcccttgctgtggctggggtgcgcactgtctccatgaaatggtcggtggcgatttctttcgcgtttgcaggcgctctgggcaacctgattgaccgtgttatgtacgctgacggcttcctcgacggcaaagtggtggatttccttaactatggctggtccgttggcaatgtggcggatatctatctggtagtcgccggtgtggtcctggtgattctgattcttatgggggagccgttctcacacaaggatctcatcgagcaatccgacgaatccctacagtctgagccggaggcggacgccaagtaatgagtcgaatagtccctgctcccgatgcattggtgggtaagcgtttcgacgtagccgtggccaaaatgctgggtatttcacgatctaaagccgccgatctggttgactccgggcaggcgcgcgttttaggacgtgaagttgcgcggtccagcacattgcaggcgggggagaccgtcgaatttgatttggcggaggaacaggccgagcctgagcctatcgcaactgatatggccgttgtctacgaagacgatgatgtcgttgtagtcgataagcctgtaggcgtggcggcgcatgcctcggttggctggaccggtccaaccgtgctcggatcactgcgtgaccgcggcgtgcatatcacttcctatggtgcggccgggcgtgaaggcattgtttctcgccttgatgtaggcacttccggcttgatgttggtgtgcaagtccgaccttgcgtacaccgagatgcgtcggcagttcgccgagcatgaggtaaagaaaacctatcatgcgctcgtgcagggtggtcttaaagagaacaaagcaaccattgaggcaccgatcgggcgcgccaaagtgtccgatttccgcttctgcgtgactccggccggcaaaccggccgttacgcactgggatgtgctggagcgtttcggccatgaggccactctggtatccgtgaatctggagaccggacgtactcatcagattcgcgtgcatttctcctcgattgggcatcccctgtgcggcgaccccatgtatggtgccaatccggtgctgtctgaggccttgggacttgaccggcagtggctgcacgccatgaagctcgaattccgtcatccccgcacccgcgtctggaccacggtccggtcccagtacccggccgacttggctgccgcactcgatgccatgcgtgcccgacacatcgaacccgctgaacctgccgaatatgccgaagttctggtggactaattccgcgacgtgtgcatcatgcgttttaatatttagattcagttccggcttcgccggattcatcccagaataacgagagatcggtcatgatggctctccgtcatgaccataccccaagtgactgcggatgctgagtaccattcagtccaatggtcggtaaccgtacgtgaattaccggtatttccgctcaacgtgtctcggtactccagcgtgaagtgaacagaaatgagccaaagcagtaatgaagccgggcggtatatgccatccggattgcagaatctcctgctgataaaaaccgtttcctagtcgttgaccgtgcccgttccgacgacgatcgcggcctacgacgcgttcatcctctacccggcccaccgatacgacatcaagggcaagaggattctcaagcaggaaaagaagtactatgccgtggacttggggatgcgacgtatcctgtgctccaacaacgtgcgggacatcggacgcctcctcgagaacgtggtgttcctcgaactgatgcgccgcgagggcgacgtgtatgtcggacagagctccggcagcgagatcgacttcgtcacgaacgggccaggcggacgtcggtactaccaggtcagcgaatcggtgcacgattcggcgacgctggattgggagccgtcctcgctgcgcgccgtgcgtgacaactatcccaagacgctgattacgctggatgacgaacggccctactcccacgaaggcatccgacagatatacgcgcttgactggctgttgaacgaagaccacaagaaacagtagatactagggcggccagcgggttagcaagacatcagttggtgaggactgctgacattgcactccgacggatgaattgaatactcatatggtatccgattctgaacaattgagtgggggcgttgatggttgccatcgtttgagctggctaaatgcgatttcgcgccatgctgtttcaacaacggtggcaacagctacagttgaactatgcatgggttgaagagtgcgattgacaggggagcggacgcgtgggcacgttcgctgcctgggcgcgtgctcgaccggtatgtgtcgcggagcggccccctgctggcgaatggtctggcatatggtctgctgttcgccttttttgccggcgtctggattgcggtgagcgtgttcggccttatcatggtcggcaacattgattggcagcagatgctgattgacgcggtgcgtgaagtcattcccggtgtggccgactcgtttctgacgtcttccgcgctaggcgccatgtcaagcgcattgacgtggaccggtctggccacgttggccatattctggtggacagtgaccggctggatgaactcgctgcgccacgccgtacgggccatgttcgacgactgcggcgacgagctcaatatcgtcgtcgcaaggttacgcgatacgcttgccgccatcgccatcgcaatactgttcattctttcgaccgcggccggtacggtgtccggcggcatcgtacgccgactgctgcaatggggcggcatccccagcagttcgttgcccggcatcgtgcttttggagatgaccggtttcggtaccggtgtcgcgctgaatttcgcgttgttcatgttgctgctgcgcgtggtctcccacatcaaagccggacgattcacgatactcggcgcgttactgggatctctgacggtttccgcaatgcagcttctcggtgcgcgactattagccggagcctcccggaatccgatgcttgccccgttcgccgcgttgatcggcgtgctcatttggttcaacctcgtcgcccaggtcattttgctctgtgccgccctcattgccgagtgccgacaaaagagctgagcgtctgaactgactaatatgacgattagcgatgaagcctctctcgccgagatgattcgcgaactcagctggcactacagttattgccgtggtctctccatcttggcatatcgcaaacgagtagcttcacccgtgataccgagcttgcgaccaattgtttcccatgattggccacgttcatgcatgagcagtaccatctgcgcaatgcgggcatcaatgtattccagttcggctttgcgtcgattgattagacggctgagctccagttcgggagagaagtttgggctgtcctcgggaatgccttctgctggtgattcctgagactccacggcatctgccgcagcgttgccgatttccatgagtttggcctgtatctcgggagagtagtcttcaaatttcatcgttatcactgccttagtgtcgctgttgctgatactccactttataggcatgtggcctcaccggtaaatatttaccgctgcccagaccacacggtatggtggagcgcatggctgattacgggaacaactttgtgcaactgcataaccatacgcactattcgctgctcgatggtgcgtcgaagattcctgatttggccaagcgtgcggccgaacttggcatgcctgcggtcggtatcaccgaccatggcaacatgcatggcgcctacgagatgtacaccaactgcgtggccaatggcgtcaagcccatcatcggcatcgaagcttacgtgaccccggaaaccgcgcgtcaagacaagtcccgtgtgcactggggcaccgaagcccagcgccgcgacgacgtctccggtggtggtcttatcacccacttgaccatgtgggccgaaaacgacgaaggcctggtcaacctcatcaaagcctcgtccgtggccaacctcgaaggtcgcgtcatgcgctacccgcgtatggataaggaggtgctcgccacctattccaaaggtgtgatcgcctcctccggatgcccttcgggcatcatccagactcgtctgcgcctcggtcaattcgaggaggccctgcgcgccgccggcgaattccaggacatcttcggcaaagacaacttcttcatcgaacttatggatcacggtctgcccatcgaaactcaggtgaccggtgacctgctgaccatcgccaagaaactcaacgcaccactgctggccaccaacgattcccactacgtacacgccgaagatgccggcgcacaggacgccatgctctgcatcaactccggttcccgtcttgacgatccggaccgattcaagttcgacggcaccggctactacatcaaaaccgccgaagagatgcgcgaactgttcaaggaccacccggacgcctgcgacaatacgctcgttatcgccgaacgctgcaacgtgatgttcgacgaccacgaagacggcgcgttcatgccgaaattcccttgccccgaaggctgggatgagacctccctgttcctcaaaaaagtcgaggaaggtctggagaagcgttacgacggcaacccgccgctcgacgtattgaagcaggccgactacgaatgtggtgtgatttgccagatgcagttctgcggatacttcctcgtggtcgccgactacattcagtgggccaaggaccacggcattatggtgggtccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagcctgcatgacatcttcgacccggccgccaaacgttatgccgaggccagggaattccgagaactctacgattccgacccggacaccaagcgcatcaccgaggaagccaagggtatcgaaggcctgatccgacagaccggtgtacatgcctgcgccaccatcatgggtagcgcacccatcaccgacacctcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactacgccaagcgcaaaaacggcctgcagaagatcacgccaattcaccctgagcttgaggagcctctgaagcaggtgcttgacgagacctatggtctgatcatctaccaggagcaggtgcagtccgccgcccgaatcctcgccggttattcactgggcaaggcagacgtgctgcgtcgagccatgggtaagaagaagcccgaagtgctggccaaggagaaggtgccgttcttcgccggtatgaaggagcacggatattccgaagaggcctcccaggccgtgtgggatattctggtgccgttctccggctacgctttcaacaaagcgcactccgccgcatacggtctgatctcctactggaccgcatatctgaagacgcactacccggtcgaattcatggccgccctgttgcaaggtgccgccaccaacaaagacaagaccgcactgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgctcaccgtgcacgaggccgccatcgattcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaaacttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccatccaatgcatgttcttcggcaaggtctatgaagcggccgccgccgaacttgccgtggacgccatcgtacagattcgtggccaagtggagttgcgcgacgaaaccgtttctctgagagccacggaaatgcagattccgaccttggaagccgaggatgaacgtccgttggtcatcacgctgccgtcggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgagatacttcgttgtttgctgagatcaagattctgtttggccccagctgcttgcctgccgcctgattggcgggtttcgcccctggcctctccctcacctggctttgctgggggctccttcatcagagggagctaaggcgtgtgccaccatacgatgtgcgcgactactgtggaacgtatgggcatggagatagcggatactggtaacaacgatgacgagcaacaatggattgccacgatgctggaacggctgtctcattcgcagttccgcgccaaattcgctttgaccgacaaagaccgagcctatgcccgcaccaaaggcaaggcgaccatcgatcgtcatgcgcgagaaatgttgcgagaccgcataggcgcagccgaaccgaagaacgacggcagacagacgccatggcgcggccatccggtattcaccgctcagcatgctaccgccacatgctgccgcggatgcatcgaaaaatggcatcatctgcccaaaggccgtgaactcgccgaagcggaggtaaaccgacttgccgatttggtcatggcgtggattgaacgggaccttatcaatcatccggttcggtgaagcaccccgcatcctcagtatgcctgtatgccttcaatagttatgggccaacagccaacataggcctcgaaaaccgtagatgcaaggtattggcgaatgcggcagaacgccgaacgttgcctatagcgcgttcgtcaataatgcgacatgatgtctattcaagaagagttgatgaagtgtcaactctgccccaaggaggcggaatatgtactacagcagcggcaattatgaggctttcgcacgtccgaagaagccggccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggccttggctatgtgatgcgtggcggccgcgaaatggacaatcatttcgaggtcatgtgggatctgttccgctcgattccctccatcgaaaccgaaggcgtcagcgtactcgacgagtactactggctcaacaaggaggacccgaactactcgctgtgccgcgccaccaagaatctcggcaaggacgcggggctcaagggcaagttcgggctgtccgacaaggcttcgatggaaatcatgaagctgttcttcaccccggacgaagacctgtatgacaagccgatcaccgatttcttcgatgatgaggtgctgaactccaacttctggctgtactggcgcaccatgttcgccttcgaaaactggcactccgcgctggaaatgaagctgtacatcaagcgctacattcatcacatcggaggcctgccggacttttccgcgctgcgtttcacccgctacaaccagtacgagtcgatgattctgccgatggtcaagtatctggaatcgcacggcgtcgaattccgctacaacaccaaggtcgagaacgtggaattcgcgattggcgggggagccggccccaagcgcgagcacaccggcgtaggccaagacaccatccagaagattcaggccacctccggcttcttcaagcgcaaccctgccagcacgcccaccaagaagcttgccgtgcgcatcgacgtggatcacgagggcaataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgccgaccaggacccgagctttggacatccggagaagttctgctccgatccgaatgccaccaagtggatgagcgccaccgtcaccaccctggacggcgagattccgccgtacatccagaagatctgcaagcgcgacccgttctccggcaaggtcgtcaccggcggcatcgtcaccgtgcaggactccaactggctcatgagttggaccctgaaccgccagcagcagttccgcgaccagcccaaggaccagctgtgcgtatgggtctacggcctgttcccggacaagcccggcaactatgtgaagaagccgatgaccgaatgcaccggtgaagagatttgcgaggagtggctttaccacatgggcgtgccgaccgacaagatcgaggcgcttgcaaagcaccacgccaacaccgtgccggtcatgatgccgtacatcaccgcgttcttcatgccgcgcgcggccggcgaccgcccggacgtggtgcccgatggtgccgtgaacttcgcattccttggccagttcgccgagaccccgcgcgacacgattttcaccaccgaatactcgatgcgcaccggtatggaagctgtctacacgttgctcggcgtggaccgcggcgtgcctgaagtgtggggtagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgttacgcgaataccgcgtaatctgacatccatctggctcccctcaaggtgaggggagccagcacgcgaagcgtgattgaggagagttgctcacaacggagtgttaagagaaagacaaaaacatgactgattctgatccccagttaatccgccacgccaccatcgacgatctggacgcgctggccgccatggaatccgaatgcttcccggccgccgaggccgccggccgctcgtccctgcgcgcccgaatcgagacctatccggaatgtttttggctattgattgatggcgagatcgtcatggcgttcatcaacggtttcgcgaccgatcggcgcgacttgaccgatgacatgtacgaggatgccgcgcagcacaaccctcaaggtgactggcaaatgattttcggcgtggatactgcgccgaagtatcagcatcgcggttgcgccagtacactcatgaggaaagtcattgaagacactcgtgcagctggacgtaaaggcctggtgctcacctgcaaagatcggctggtcggattctatgcgcaatttgggtatgaggacgagggcatttcggagtccactcacggtgacgtggtctggcatcagatgcgcctgaccttctaatccccctttggcttccctctttgatgctgggtcgtttaaaaaacagtccggtggactgtttttttagacgaaggcgagacgatagtcgagccataagggcgcgagctttgctcgtccgtaattgcgggtgagctgtccgcgtgatcggactgaggggagttgaacgtggaatgaattgttgcgacacgccggtgaacatctgatttcgttacgtgagcccataaaaagccggcgtatcctgatggtaacgcgtgattcaagctgatttcgacacgccgggcgaagcctgtcgtttcaacgatttgggcttatcttcgtgcgcccgatttgcgcgagtccgtgaatgcgtgtaagttatttccttgctgccgctcggcgagtggttctccttccggagggctgcgaggtgggtgagtggtggtggtttgagaactcaagagcgtgtttgtactacttctttatagtcaataactgttagaattacaggaccaacaagggtgttgcacttctaaatagacatcgggtcgggcgtttcgcgagggcggttttgctataattagtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttccctttttgcgacgcattcccgggaatattgcgttgggagaatagttgggtgtgtgttttgcgacgcattggaatattgcgttgggaggagaggaaaagtacgggggcgcaggaggtccccaaaccagtgagttgtggcccggcgcgtcgttgtccggaggaatcgtaatataggtattcgtgtgtgccagcagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtttacaccaccaccccgaagaagccgaactcggctctgcgtaaggtcgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgacttctcccgcgcccgtcgtgagaagaccatggctgagcgtctcgccaatgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacatcatcgatacccctggccacgtggacttcacggccgaggtggagcgctccctgcgtgtgctcgatggtgccgttgccgtgttcgacggcaaggaaggcgtggagccgcagtccgaaaccgtgtggcgtcaggctgacaagtacggcgttccgcgtatctgcttcatcaacaagatggacaagctgggcgcgaacttctactactccgtcgacaccatcaaggagaagctgggtgctactccgatcgtgatgcagctgccgattggttccgagaacgacttcactggcgttgtcgacctggttgagatgcaggcttacgtgtggaacggcaccgaggagctcggcgccaagtacgacaccactgaaatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgcggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagtccctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaggtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgctttccaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcctaagctaattgaaatattcgtgcatcatacagcgtacagttaaaccatgttccctctgctcgaaaccttggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggccgtgcagctcggcgtggtggaaaagccgatcgtgaacgattcggtggaccgcgtcaccctgtgcgaggaccggctggtgttggcgggggagcctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggtagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctcgctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgtggcgcccacaccttgattcggcttcacatccgctccattgttcgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgattccatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagattgattgtcgtttaatggaacatgaggataacgggccctaatcgctcggtgccggaaacaaggagttgtgaatatgtctgaaaccatgaaagccgcgattttcgttgagcctggcaagatgaccgtggaagaagtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgtccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgcaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacgaccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatgaggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgctgtcgttggccgtgatgatactggagaccatgaaactcaggcggcggcagccaagggcgaagtcgagaaagaggtgacggcgtgacacttgaacagaggtcagatagcgcggcggcaggccacgaggcatgtgaccagccgatcaggagcctggaaatcctcaaccaatgcgttccgctgttcgagacgctgaaggatccgaaccggcagcagttgctggtgcaattggtgtgccatgggccgcagacggtgggggagctggccgaatcgtcggcactgtcccgcacggccgtgtcccatcacatcaaactgctggaacaagccggattcatcgaaatcagcaaagacgccacccgccgcatttgctcggtgcgtgcggatcgatggctgccgctgctcgatgaactgtcttccgccctgaaagccgaccttgcggcggcggagcagtgccgagcatgagcgacgatcaacggccgcaggcgattgaggtgcgcggtgcgcgcgtgcataacctcaagaacatcgacatcgacattccgctgggcgaactggtgggcgtggccggcgtctccggttcgggcaaaagctctctggcgctcggcgtgctgtatgcggaaggttcgcggcgctacttggaagcgctgtccacgtacacgcgccgtcgactgactcaagccagccgcgcccaggtggacgaagtgctgcatgtgccggccgcgctggccctgcaccagcggcccactgtgcccggcatccgttcgacgttcggcacgatgaccgaattgctcaacagcctgcgactcctgttttcccgcgtcgcctcgcacgtgtgcccgcattgcggggcgcgcaatgaaccgacgctgaacgtggcggccggcctgcccatcacctgtgctggctgcggcaaggaattccacgcgcccggcgccgaattgctcgccttcaactcggccggcgcctgcccgacctgctccggcaccggcatcgtgcgcgaagtaaaccgcgcggccctggtcccggacgagtcgaaaagcatcgacgacggcgcggtgctgccatggggttcgctcatgtgggacctcatgaaacaggtgtgcggcgcgatgggcgtgcgcaccaacgtgccgttcaacgaactcacacccgaagaacgcgacatcgtattcaacgggccggccgtcaaaaagcatattctttacaagccgaagaaaggcgacgatttcgccgaactcgacttcacctacttcaacgccgtgtacacggtggagaacgcgctcgccaaagccaaggacgagaagggcctgaagcgtgtggtccggttcctcaaggaaggcccatgcgccgactgcggcggcacacgactgagcgtcgccgcccgggccccgcatgtgcgcgggctgaacttggccgaagccggcgcgatgaccttggacgcggcggcggattgggtgcgcggagtgccggaatccctgcccgccgacatgcggccgatggccgccaacatctgcgaatcgttcttggatgtggcccgacggctgctcgatctgggcctcggctatctggcgcttgaccgcgccggcgccacgctttcgaccggcgaacgccagcgtgtgcagctcgcccgggccgtgcgcaaccgcaccatcggcgtgctgtatgtgctcgacgagccatccatcggtcttcatccctcgaacgtggacgggctgctcggcgtgatgcacgacttggtggcggacggcaattccgtggtggtcgtggaccatgatgtgcgtgtactcaaagcgtgtgaccatcttatcgaaatggggccggttgccggtgccgaaggcgggcatgtgatcgcgcaaggcacggtcggcgaggtggcggcgaaccccagtagtcgcattgcgccgttcctatccgaccaggtgagtgcgcgtatacgtgagcgtgtggccgaatcgcaagtgttcagccttggccacatccgcatgacaaccagtcagctgcatacggtcaaaccgttggacgttgatatcccgcgcggccggctcgtggcggtgaccggcgtctccggctccggcaaaaccacgatggtactcgaatcgctgattcccgcactcaaagcgcaggcggcgggggagctgttgccggaacacgtgcgcgagcttgagaccgagggcatccgtcgtgcgaatctcatcgatgccacgccgatcggcgcgaacgtgcgttctaccgtggccacttatgccgatattcacgacgaattgcggcgcgcctttgcccgatgtgaggcggctaagacgggcggctggaaggccggcgatttctcgtacaacaccggccgactgcgttgccctacgtgcgacggcaccggttcgatctcgctcgacgtgcagttcctgccggacgttaccatcgaatgcccggattgcggcggatcccggtatgcgcccgaagccggcgcgattcggcgtgccgttaagggagaatctcacctttcgttgagtctgccgcagctgatggcgatgagcgtggaccaggtgctgtccgtgaccggcgacctcaagaaggtccacgcgcgcctgaccaccttgcgtgatttgggcctcggctacctgacacttggcgagccgacaccggcgctttcgggcggcgaagcccagcggctgaaactcgccagcgaaatgggcagggcgcagtcggacgcggtattcgtgttcgatgagccgaccatcggtctgcacccgcttgatgtgcgcgtgctgctgggtgtgtttgaccgactcgtggcgagtggcgcgactgtcgtggtcatcgagcatgacctcgacgtgattgccagtgcggattggattatcgatatggggccgggcggcggagaaagcggcggacacatcgttgccacaggaactccggaacaagtcgcggccaatccgaacagcatcaccgggcggtatttgcactgacttgtatggcggtcacgcgcctttgcataggaccctgcgcgagtaggatagccgtccatggtgcagattcatggcattagacgcgcaagcgcggacgcgaaatatcggcagatgaccgggcagccggtcaaaccgctgatcctcaaactatgcctgccggccgtcatttccaatctggtgactactgcatacaacctgactgatacctttttcatcggccagctcggcaccgcgcagtccggtgctatcggcatcgcgttctccatcatgaccgtgatgcaggcgctcggcttcttcttcggcaacggcgcgggcaactcgatgagccgcgaactcggcaaacagaacaatgagcgcgcctcccgactactggccgtgggcttcgcgggcgcggtgctctctggtttggtgattgccgcaatcggattgctgaccctgcggccgctggtcgtcatgctgggatcgacctcgacgatcgccccatacgccgtgcaatacctgacgccgttgttggtcgccgcaccctgtgtatgcgggtcgttcgcgctcaacggactgctgcgataccaagggcaatcggcgttcggcatgatcgggctggtttcgggcgcattgctgaatttcctgctcgcgccgttgtttatcttcgtgctgcacctcggaatttttggtgccggcctggccaccgccatctgccagacggtgagcttcacgattctgaccacgatgagccgcaaattcggcgtaatgaagctgtccttgcgcaattgcaggccggatgtgctgctcatgcgcgaagtggccggcggcggcctgccttcgctgattcgccaaggtaccggctcgatctctgtgacctgtgtgaacatcgccgccaacccgttcggcgatgcggccatcgccggcatggccattgtgatgcgtatcatgttgggcgccaattcggtgatcgtgggcctcggccaaggtttccagccggtgtgcggatacaactacggggccggcctgttcgcgcgagtcaaagagggatattggttctgcgtgcggctcgccacctgcgtgctcgtggcgttggcagcgctgctgtggattttcgcgccgcaactggtcgagatctttcgttccgacccggccgtggtggcggtgggcgtggctgcgctacatattcaatgctgcacggtgattctcaacggctttaacatgatgggcaatatgatgacccagaccatgggccgcaccggcatcgcctcgttcctggccttgtgcaggcaaggcctgttcctggcgccaatcgtgctgattttgccgatgatgttcggcgtgctcggcgtggaaatggcccaatcggtgtccgacgtgctgacgttcgtggtcaccatcccgttcatgcggcgaatcctgcatgaattgcggtgaatggtagatggcaactatgaataatcgaagtgcaaagcgggtgccgggcgttccttctcccgcgtatatcgaatcgctgtaccgcaccatggctgccgcccttggcccgaccggatggtggccggctgaaaccacattcgagattatggtgggcgcggtgctgacgcagaatacggcgtggggcaatgtgaatcgttcgcttgcggcgttgaacgcggagggtgtgctcgaaccccataagctggcgattatggggccagcgcatctgcaggaacttattcgcccgtccggcttttatgtcaacaaatccaagacggtacagtcactgagccgatggtatgtggagcgttgcggagcctcacctgagggcgcggcagatattcccgacgccgaattgcggaccgaattgctcggattatttggtatcgggggcgaaacggccgacgacctgatgctatatgtgttttcgcgccgcacattcgtggccgatacttatgctcgccgactattcgccttcctcggatttgatgtgccagccggctatctggcattccacaaggcctattcgcccgtggtgctggatacgagcctcagtgtcaaggatttgcaggaattccatgggctcattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccttgactggctgcgctcgatgctgggtgtcgaaaacgagtctgtgacagaatagttcgaccgacgcaatcgccaaaacgccgaacaggagccaatgatgaccgaagacaagccgatcgccaagccgattatcgatgatgcgacgcgcgagaaaatggcgcttatgttctctggcgaggtctacctgccggatgatgtggacggcttttttgatctgcaggccgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgcccgtccacatcggcgagaacgtctggatcggcgcgaatgtcaccgtgctgcccggggtcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtgatggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcaggcggcgttggacggcatgtgctcgttgctgctcaacgtgctcatccccgtgcttgtgttttcgaacgccgtcgatggtgcggaccgcgcgcagcttgcctctaactggggcgtgatgctgctgaccgccgtgatgtacgcgctgctcatcctggtgttctggctggtcgccgaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccagacgctgctctggacgtacggcgtatggctgtgcgagccggtcgacgaaacgactggcggcaacgcaattggcgcgcgaggtgcggtcgtgaacggttcggtgaacggcgccggttcggtgggcaatgctggttcggcgagcaatgccgcaaacggtggttctccggccgtcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttgggcggcctgttcgcgctgaccaagtggtggggtgtcctcaaacgctacgaactctatgctggcctagtcgccaagatgatcgcattcccgctcgccttctacgcgctactgaccgcgctgaccggcgcattgccgcaactgccgatcacccatgacatggtgctgatgattacggtcatcgccggactgccgaccatgaccaccattgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccgggggcctccggcgcttggaatttcatcgacgccgccaacgactcggcatccgaggcggccgtgccgtatttcaaggagatattcgattacgcgcgcacgctcgatccgcagcatcgtcctctgacctacaccaatctgatgatggccgccgcaggcaaagacaagtgccatcaattcgcggatgtcatctgcctgaaccggtattacggctggtatatgcaaggcgggtatcagctcatcggagccaagaaggccttcatcgacgagatgaaccaatggatgaacaccgaacccaacaagccattcctgttcaccgaatacgttgcggacaccgatgccggtgcgcacaagctgccaagcgtgcagtggagtgaggaataccagtgtgagtacctcaccatgcagcacgaagtgttcgacatgttcgaggcagtggtgggcgagcaggtatggaacctctgcgacttccaaaccggtgaaggcatcatgcgcgtcgacggcaacaagaagggcgtcttcactcgcgaccgtcagcccaaagccgccgcctatgtactcaaggagcgttgggagactaagtagcggcccgcccctggaatattccaggagcaacgcacatcgcataacatacaacgcaacatacgaaaaagaacctcgtgaaacgaatttcacgaggttctttctagttacgctgaatgactcccattagactcccacaagagaagagcaatggcgaaatcccaacgttgctaagctctcaaactcagatgtggaagtagagctcgtactcgagcggggtcggagacaggcgagcctggtcgatctcgtcgcgcttgaggccaatccaggtctcgatcaggtcgtcggtgaacacgtcgccggcggtgaggaagtcgtggtcctcttccagggcgtccatagcctcagccagggagctcggcacctgcttgatgccagcgtgctcttccggcggcagctcgtagaggtccttgtcgaccggctccggaggctcgatgtggttcaggatgccgtccaggccagccatcagctgagcggagaaggccaagaacgggttgcaggacggatccggagcgcggaactcgatgcgcttggcagccggggaggtgccggccagcggaatacggatggcggcagaacggttacgagcggagtacaccaggttgaccggagcctcgaagcccggaaccagacggtggtaggagttcagggacgggttggtgaaggccagcacggaggaggagtgcttgatcagaccgccgatgtaccagcgggccagatcggacaggccagcgtagcccttctcgtcgtagaacagcggcttgccgtccttccacagggactggtggcagtgcataccagtgccgttgtcgccggcgatcggcttcggcatgaaggtcgcagccttgccggccagagcggcggtctcgtggacgacgtacttgtacttcatcaggtcatcgcctgcgtgctgcagggtgttgaagcggtagttgatctcctgctgaccagcgccggccacctcgtggtgggaacgctcgagaatcaggccgaccttctgcaggttggcgaccatatcgtcgcgcagatcctgagtgtggtcaatcggcggaaccgggaagtagcccttcttgacgcggttcttgaaaccgatgttcggggtgccgtcttcctcaacgtcaacaccggagttccacggagcttcgatggagtcgacctcgtagaaggagcggttcatgccgttctcgaagcggaccttgtcgaagatgaagaactcggcctcaggagcgaaggaggcggtgtcggcgataccggtggacttcaggtaggcctcggccttgccagcaacctgacgcgggtcgcgggagtacggctcgtcggtcagcgggtcgacgatggagaaggccacgtcaagggtcttgtgcttgcggaacgggtcaatgaaagcggtctcaacgtccgggaccagcttcatgtcggactcgttgatggcttggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcggcgtcttccttggacttgagttcggtcacgggaccgctcctttcgtatgaaatataacggtatccatcgtaaaatcgcgcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtggatattgacaggtgacgtaggtggatgtatgtggacgcgattatgagacatatgacgaagccccggaaccgattgaacggattccggggcttctgtgcgatttggtggtgtgctgccgatcagcgaccgcgcatcgcgcggcgggagatcttctgcgggtggttcgggtccatgcccttggggatggcataacccttcttggcctgcagcgtgcgcagacgatcgttcagcgtttccatctcggccttggtcagcaggaagcgacgacgcggatgaatcttggcgatcagtgcgttcttgtggttcgtgggctcatagctcttggacttggtcaccgtgctacgcagcttgtccagtggcacctgcttggggccgtggcccacggagatgcggtacaccggaatggaggagccggcggtgacgcccttgatatcgtgttcctgacgatccatcgccttcatgatgcgaccgtattcgccttcgccgatcaggtagatgccgttcatcgaagtgccgcgccagatggcatccttggtcttcgggtcgatccacaccggttcctgcgggaagttaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactaggcaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgcgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcgcgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttgccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacaggtgccgcccacggtggcgtcacgctcgatgagtgccactttcatgccgagttcggcggcgcgcagggctgtggaatagccgccggggccggccccgatgatgaccagatcaaactgttcgctcatgattgcctccttggtgcatataagtatggctcccatgctagggagccatatgtggctatcgccgccacttcgcctaaaaacagtccactggactgttttctttacggctcagcccctcaacgaggggagccagagtatatatggacatcagtctgccggccagtgaccgcgcttcgggtaacgcggcttgggaagcctccaacgacgcatctgaatcgaacggctccaagcgtaggagaaggagcgggagcccttggacacggactgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggagacgatcagaatcgcgaaggccaccgggatgaaccattcgccaaggttgaaacgggcatccacataatcacggatgtagatacgccaaggcaggcgttccgccttgggcatgtggttgatatcgcccttctgcatcgcctcgtactcggcgttctccttctcacgcagacgggctttggcggccttggcgctggccttgcggtccaccggaaccagcggacggataccggcggcctgagcctgcttcatcttcggggtaggacggccttttttctcagaaggatcggcggtcttcttcggggcctgctcaacgggaacttgggcctcttcttttttcctaaacggattccatgtcatgctttgaggttacggtgacgttcagacacttgtatactggcgcagccattgcaatgacgccgcttacacacatataaaggaggaccatcatggcaacgctcaccgctgacgagattcgttcgcgcgtcgaaaccgattggaaccgcatcgtcaaggtgctggccgaaaaggttgcgctgcagtcgatttccgccaagggcatcaccgccgaacatatgaagcgctccgctgaattcgtggcagacgaactgcgcctcgtgggtgtggatgccaaggtggtccaggcttccaatgccgacggcactccgggcgcatgggaggtcatcggctcgcatatcgtttctccggacgcccccaccgtgctgctctacgcccatcacgacgtgcagcctgttccggacccggccgagtggaacaccgacccgttcgtggccaccgaaatcgacggccgtctttacggccgtggctccgccgatgacggcggcggcatcgccatccactccggtgcgctgaaggctttgggcgacgacctcaacgtcaatatcaaagtgttcatcgaaggcgaagaggagatgggctcgccaagcttcattcccttcatcgaggctcaccgcgacgaattcgccgccgacgtgattatcgtggccgattccggcaactggtcggcggacattccttctttgaccacctcgctgcgcggcaacacctgcgtggacgtgaccgtgcagggccttgagcacccggtgcactccggtcagtacggcggcccgattcttgactccaacacgttggccgccatgctcatcgcttccatgtatgacgagaacggcgatctggccgtacccggcgtggccgcggaagagccgatcggcggtttgcagcacgaccttgacgaaaccaccgtgcgcgaggattctggcgtggtggccggttacgagttcgccggcaccggctcgctggcctcacgcctgtggactaagccgtccgtgaccgtgatcggcttcgacgcccacccggtcgagggatccttcaacgtgatcgccccggagacccgcttccgtctgtcgctgcgcaccgcgcccacccagcaccctgaagaagcgcaggaagcactggctgcattcctcgaatcccacgcgccgttcggtgccaaggtcactgtcgaacgcggcgaaaacggcatgggctgggccatggatccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatgtcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgtcattttctggggctgggacattgtctgctccgccccgctggccctgtttgaaggcgtgacccccggtttcgagggtctgctcaacggattctggctgttcgccggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgtcaccggtgctctggagcgttttgaatccggccgcagcaaggcgcgcgtctgatgcagattaatccggctgcggtagaggccagcggctggggatggcggcacgccacgcgtaaggacttcgcgttgcgtgccgtcgatttcaccatccggccaggtgaacgtgtgttgctgctcggtgcttcgggcgcgggcaaaagcacgatgatggccggtctcgcaggcgtacttggcggcgatgaggaaggcgagcaggagggctcgctcaccatcgatggcgtcgatgcgcgcgaggcgcgaggtcgcgtgggactggtgcttcaggacccggactcgcagatcattcttgaacgactgggcgatgacgcggccttcggctgcgaaaacctcaacgtgccgcgcgaggagatttggcagcgagtgcgcgaatcattggatatggtgggactcggcggactcgaactggatcggtccacccgccatctgtccggcggtcagcgtcaacgtctcgcgttggccggcgtgctggctatgaagcccggtctgctgttgttggacgaaccgaccgccaacctcgatcccgaaggcgtggtcgaagtgcatgacgcggtcaaaaaggtcatcgaggccaccggacagaccatggttgtggtcgaacatcatatcgatgtatggctcgatctggtcgatcgcgtgattgtgctcggccgacccgatgcaagttcgcccacgggtgcggtcattgccgacggcaagccggacgaggtgttcgccgagatgggcgacgtgttggccgccggtggcgcgtgggtgccgggccgtgcgattcccgattactcaccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgtgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgctgttgctgtgcattccgatgttcatcagtctggatgcggtatccgcatccacggcgctcggcatcgaattcgtgctgctgtggattggtggcgtggctccgtggaccgtatgccgtaagacctggccggtatggatcgccgccgccggcagttttatctccgtgttcctctacggccgcacctcgggcgagatcctgtggcagggtggctggattgtgatcagcgagggatccatcaatctggccatcgccacggctatcagggtggcggccattgccgtacccggcgtgattctggccttgggcctcgatcccactgatttggcggacggtctggttgagattctgcacttctcaccgcgattcgtatacggcggattggccggattgcgcatgtttacgctgctgcaggaagattggcgcgcactcggcttgtcccagcgttcgcgcggccttggtgacggtaacgccatcgcccgtgccctctcccaagcgttcggactgctggtgctctccatccggcgtgccaccaaacttgccaccgccatggaagcgcgcggcttcggctccggcgccccacgttcccaagcccgcatctcgcgtctgaagcctatcgactggatcttctacgtcatctgtctggccgtcccgctggcctccataggcgtagccgtcggcaccgggaattggcacttcgcctttcagggtgtctgaaaggcggcagactggcacagtgcctttcagggtgtctgaaaggcgacagattagcacagtgcctttcaaggtgtctgaacgccttatgatgcccccgctggcgggggctgtcggcgtagccgactggggtggttccagcctcgaccaccctcagtctcgcgactgacgtaatgacccggcagtagggtagtggctatgcccatcaacgcccagattcttgataatccgaaatccgaccgcgtgcgccgcatcgccgatctgacccgcgccaaaggccgcgaacgttcgggccgttttcttatcgaaggcccgcaatccgtgcgcgaggccgtcacttggcggccggacgtggtgcaggacctgtatgtagaggtttcgcaggcgctggaacatccgcgtatcatctcctccacgttggagaagatcgtcgaaacctcgcaggatgccacgatttatgtgcactactgcaccggcgacgtgatgcgccgcatcagtccggacgcccaaggcatcgcggccgtcggcaatgccgagtccatgcacgccggagccgatgacgtcgaacttggcaagaacggtcgggccccgcagattgccgccttctggcaggtgcgcgacccgggcaacgccggcatcgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgaccataatatggacgtctgggccgccgacgtatacggcaccgaagaacgcaagccggaaagcctgcccgcagtactggcggacaaggcggcggtcgaggctccgaaagccgtgctgttcggcaatgaggcgcgtggcttggaaccggacatcctcacgcgctgcggccgcatcgtctccatcccgctttatggcaaggccgaatcgctgaacctcggcacctcggccgcggtgatgctgatgtcgctgtctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgccgaccagaagaaggaagccggcaagctcatgggcaagctgcgcgccgacttcggccgcgcctatggtcccaaggaggtcgagctcaaggaagccgccgagaaggccgcgcttgccgccgaaaccgtggatatgacgctgccggtgagccgtaagcctctgggcgcccgtcacccgctgcctaagctgatggaggacgtcgaggacttcttcatctccatgggctggcagatctcctccggcccggaaatcgaagccgaatggtacaacttcgactccctgaatttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggagtgccgctgtacatcgcgtccccgggccgcgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcactgagccgagcgccgaactcgacctgtggttccccgacaagaagggcggccccggctggctcgagtggggcggctgcggcatggtgaacccgaacgtgctgaagtccgccggcatcgacccggacgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaaggaccttgtcaaggtgggtcttgaggaagaggagattcactcctctcaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgaaccgcgcaagacctacggccacatctccaacggcatgtgtgcctccgaacgtgagctgggtctgggcgacaaccacaatggcatcatcctgctgcgtcagtatggcttctccgaggctgaatacgaggctctgaagcctggtcaggacgccatgcacctgctgcacctcgaccagcctctgcttgagatcaacatcaccccggaccgtggctacacgctgtcctaccgtggcgtggcccgcgaataccaccactccaccggtgccgcctacgccgatccggccgtggcactcaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgatccgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagacctgcttatcaccgattcgccgaacggcgaacgcggctcgcgcatcctcggccttgccggtgtgatgggcggcctgtatggcgaagtgaccgccgacaccaagaacattcttctggaggccgcgcacttcgatcaggtgaccatcgcccgttcggcccgtcgccacaagattccatccgaggcctcccgccgcttcgaacgtggcgtcgacaccgcgctgcagcctgccgccacccagatggccgccgaactcatggccaagtacggcaacggcgagcccagcgaacacccgaacgacgtgaacaacacgccgcgcgccaaggccatccacttcaaggcctccgaagtggcccgcgtagccggcctcgacgtggacatcaaccgcatctccgacatcctgaccgacattggctgcacggtggccggtggcggcaacggtgagttcgccgtaaccgcgccgagctggcgtccggacttgaacgagccgtgcgacctggtcgaggagatcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggtgacgacgattacaaggccttcggcttcgacccggaagccaccaagaaggtcagcgtcgagatcgccaacccgctctacggcgaccgtccgtacctgcgtcgcgagattctgccgaccctggccaccaccgtgcagcgcaacatccgccgcggcatcgaaaacgtgtccctgtacgagctcggccacgtctacctgtgggatccgaacgcgcccgccatcccggcactgcccggcggcgtgcgccccaccgacgaacagctcgccgcgcttgacgccggtctgcccgaacagcccgaccatgtggccggcatcctgaccggtctggccgaggacgacggctggatgggcggcaagcgcccggtcgactggtccgacgccgtcgaggccgtgcgccgcatcgccggccgtatcggtgccgcaatcgaactcgaccagcccgccgccgacgatgtgccagtccaatggcaccccggccgcgccgcccgcgtcatggtgggcgacgtcttcaccggctgggttggtgaactgcacccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcaccgagcaagacgctgtccgccgaagacagcgacgccatccgcaaggccatcgtggctgaggccgccgaaatcggcgcccagctgcgcgcctgacccaaccaatcatccgaatcgaggagcgccatgagccaagcggagcaggacaagccgaaatacgggcagtaccagcagcctgaatatggtgctatgtctggccaatacgggccgaattacaacccgtatatttatggcgctcccgagccggatactaagaaggattccgccgcagccgctggcgataacggtggcgcggcacaatctcagcaggctggccagccgtatggtcagcagccggcgtggcccggcaatcagcaggcgggcggctggccgtacgctcaaggcggccaacagtccggtccgggcgcatatccgggcgggtacccgggcatgcagggccagccgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcactttccatatgaagggcttcggtttggccgtggccgccgtggtaatcaacgtgctgtacaccatcgccgtcatctggatggccttcaatggctatgacgccatgagcctttaccaggaagccctccagcaactgaccggcggcaccggctcctcctccgactccatctccgcataagtagcgttcacataccaacacacccactgcataaatatgcaatagtctgcataatcgcgtatactcatccgaagacacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgttgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgcctcgaagaacaggccgcttgggatgagttctacggcggcgatttctatgagcattggacctacggcatgcccgagctcatcaccggcaaagctgcggacggctcctacacccgccagcgtgcggcgcttcctggcaccaagcgcatcgcaggtcctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgaaatcctgcagaacttcgcccacgcggccggcaagagcgcggccgaagccagcgaattcacgctcggcttcacaccgattctcgcccccatgtcccgaggtatcctcgccaccgtgtccgcccgcatgacggacaaggccaagacactgagcgatgaggagattcgcgccgtatggtccaaggcctatgaaggtcaggacttcatggtgctgctgcccgagggcacgctgcccgccaccggcaacatcatcggatccaacgcagcccacctgcaggtcgtcaccgaccgcaaggccggccgcatctacgcttttgccgccatcgacaacctcaaccgtggtaccgccggacaagcggtccaatcactgaacatcgcactaggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcgccaccgcggaaacggtcgccgggctcatcggcgccgaaccgaatgatgtggctgtctgctccaccggtctcatcggtgaactgctgccgttggacaacgtgctggctggtgccaagagtgcccatgaggctcttgccgccaccgccgaagccggcaccgacgcctcccacgccatcatgaccaccgacaccaagccgaagacggtcgaactgaccggctccaacggctggaagatcggcggcatggtcaagggctcgggcatgattgccccgcagctggccaccatgttgtgcgtcatcaccaccgatgcggttgtctccgccggtcagatgcaggccgcactcgctgtggctgccgaacattcgttcaaccgcatcgacgtggacggctgcatgtccaccaacgacacggtcctgctgctcgcctccggtgcctctggcatcgaaccggacaaggacgaattcaacaagctggtgcgtgaggcctgcgcatccctgtcccgccagatcatcggcgacggcgaaggtgcctcccacgacatccgtatcaccgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccgcctgaagtcgcgccttacgattcgaacaaggtgaccgtggacgtcaacggcgtgcgcatctgcgagaacggcggtgccggccgcgaccgtagcgaggtcgacatgaccccgcgcgaagtccacattgacatcgacctgaacaccggctcggacgccgaggccaccgtctggaccgacgatctcacccacgaatacgtccacatcaacgccgactacgaaagctgacaaacagcccagtgggctgtttgtagcagccggcagcgatagcgtcgccggcgtcgcagaaaagagaaaaattgtctacagaattgaagggacctgggttccatttcgacgtgcacaccgatttgcgcgccgatcagaaggcagaagtgcttattgaagcgctgccatggctggaggagttcgccggccagcgtatcgtcgtcaaatacggcggcaatgccatggtcgatgaccatctgaagcagtgcttcgccgaagacatggtctttctgcgtcaggtgggtctgcacccgatcgtcgtgcacggcggcggtccgcagatttcccacatgctcaaggccctcggcatcaaatccgaattcaaaggcggcctgagggtcaccacccccgaggccatggatgtggtgcgcatggttctgaccggcaaggtgtcacgcgaactggtaggcctgatcaacgcgcacggcccgctggccgtaggtctgtccggtgaagacggcggcctgttctcggccatgcagcgcaggcccgtcatcgatggcaagcccaccgatatcggcctggtcggcgacgtggtttccgtcgatgcctcggcagtcgaggatctggtggctgccggtcgtatcccggtcgtctcttccgtggctccgaacgaagaagatgccactgaagtgctcaacgtgaacgctgattccgccgccgccgctttggctgccgctgtgggcgcgcacaagctcgttatcttgactgatgtggatggtctgtacgccgattggccggataagaattctctgattggccggatcggtgtggaaaacctgcgcgatatgctgccggacctggaatccggtatgcgacccaagatggaggcctgtgtcagggccatcgacggtggcgtgccccaagcccatgtcatcgacgggcgcaagccgcattcgattttgaacgagatattcacctccgcaggcatcggtaccatggttatgcccgatgaaggactggaaatgaggagctcttatggctactgagcatgaggaaaaactaggtacggaagacagcaagtggctgggagagtactctcaggtccacatgaatgtgttcggtacgccgttgcgcgtcatggatcacggccaaggtgcccacatctgggatgttgacggtaacgaatacctcgatttcctggcaggcatcgccgtcaattccctcggatacgcccaccccaagtgggtcaaggcggttgccgatcaggctgccaaggtggcgcatatcagcaactatttcgcgtccgagccgcaaattgaattggcatcaaaactggtcaagctggctggtgcacctgaaggctccaaagtctacttcggcaactccggtgctgaaggcaatgaagctgccctcaagctcgccaagctgtatggacgcaccttgcctggtgccctgccttccatcggcggcaagcccgcacgcattctcgcaatgactcacggcttccatggccgtacgatgggtgcgctgtccgccacgtggaaacccggtatccgcaagccgtatgatccgctggtgccgaacatcgaattcgtgcgcgccggcgacaaggtcgccctgcacgacgcttttgcacagaccggtctcggtcgctatggcaagggtccggtggctgctgtgattctggaacttatccaaggcgaagccggcgtgcagccgttgggcgccgattacgtcaagttcgtgcgcgaactgtgcgatatcaaccacgcgctgcttatcatcgatgaagtacagaccggtatcggacgtaccggcaagtggttcgcattccagcgtgacgatctgtccggcggcgtgacgccggatatggtgactttcgccaagggtgtggcaggcggattcccgatgggcggcatgatcgctttcggcgagaaacttgcggctctgttcactcctggttcccacggctccacctttgccggcaatccgctgggtgcggctgcgggactcgccactcttgacgtgattgaagacgagaatctggtggccaacgccgaagctcgcggcgaacagctgcgcgatggcattatggccaccggtaatccgctgttcgtttccgtacgcggccgtggtttgctggacgccgtcgagctcaagcatccctgctcccacgcggtgatgaactactgcctcgaacacgggctcatcgtcaacgcggtggctcccaatgcgctgcgtttcgcaccgccgctgattgtaaccgcacaagacgtggaccaggcacttgccatcctcaaggatgtgcctacggacctgcccgacgactgatttctctctgtcactgccgacccaccgatccaaggagatcatcatgaccccagaacttcgccacatgctgcgtgacgacgacctcaaccatgaggaacagaagcaggtgctcgaacttgccatcaagttccaccacgaccgcttctacaagcagccgttcgccggtccgcaggccgtcgctgtactgttcgacaagccctccacccgcacccgttccagcttctccatcggcgttgccgagcttggcggctacccgctggtcatcgacaagtccggctcccagctgggccgtggcgagcccgtggccgataccgctcgtgtgctcaaccgcatggcttacggtgtggtgtggcgcaccttcggccagggccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccctacggctacctgccccgcccggacatcgtggccgacgccaagcgcatcgcggccgagaccggcggctccatcctggtcaccaccgatgccaaggaagcggtgaaggacgccgattgcgtgttcaccgacacctgggtctccatgggcgaggaagccgaatacgccatccgttccaagccgttctgggattaccaggtcaacaccgaacttatggcattggccaagccggatgcgctcttccagcactgtctgcccgcctaccgcggcaaggaagtcaccgctgaagtgatcgacggcccgcagtccgtggtgtgggacgaggccgagaaccgtctgcacgcacagaaagcgttgctgacttggttgaccggcaaggcccgtggagacgaaagcctgctcgcatgagtgaaaccggtccgtccctgcagcgccctgccagcagggcggcgcggctgagtgccatagaacaggcgctcgccacgcatatcatcacctcgcaatcacagctgtccaaaatccttatcgacgagggtattgcggtgactcaggcgaccctgagccgcgatcttgatgagatgcatgcggtgaagacccggctgaaggacggcacggtggcctacacggtgggtcgcagcgtcgttgcttcggaaggtgaggatgtaggggagcgcggtgaggcacagatgtctcgcgtgctgaacggactggtcacctcggtggccgccgccagaaatctggtcgtggtgcacacgccttccggtgccgcacaatacgtggcctcggtgattgacaagcagtcgatcgaaggcgtgctaggcaccatcgccggagacgacaccgtcatggtgatctgcaccaatgacgacaccgccgtcttccgctccgactggctactaagcctcgcctccaaataaccaacacgccgtgcataaatatacagtcttctgtatatacttgcatcagttcgtttttcagaccttgaacgaaagggaaccaatggcagataacaagcgcattgttctggcctactccggcggtcttgacacatccgtcgccatctcgtacctgaaggagcgcaccggcaaggacgtcgtggccgtgtccctcgacgtcggccagggcggcgaaagccttgagaccatcaagcagcgcgccctcgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggtgccgacaccatctcccacggttgcaccggcaagggtaacgaccaggttcgtttcgaggtctccattgcctccatcgacccgacgctgaaggccatcagcccgattcgcgacctgtccctgacccgcgacgtcgagattgcgttcgccaaggagcacaagctgccgatcacccagaccgagaagtccccgtactccatcgaccagaacgtgtggggccgcgccattgagaccggcttccttgaggatccgtggaacggcccgaccaaggactgctactcctacaccgacgacccggccttcccgccggtcgaagatgaagtcgtcatcgagttcaaggaaggcgtgccggtcaagatcgacggacgtgacgtcactccgctgcaggccatcgaagagatgaaccgccgcgccggagcccagggcgtcggccgcatcgacctcatcgaggaccgcctggtcggcatcaagtcccgcgagctgtacgaggccccgggtgccgtggccctgattaccgctcatcaggagcttgagaactgctgcctcgaacgcgaacagcaccgcatcaagcgcgacatcgacaagcgctggggcgagttggtctacgatgcgcagtggttctccccggcgactcagtcgctcaacgcgttcatcgaggacacccagaagtacgtgtccggtgagattcgcatggtcctgcacggcggtcgcgccgtcgtgaccggccgtcgttccgactcctcgctgtacgactacaagctcgccacctatgattccggcgataccttcgaccagaagtcctccaacggcttcatcgacatctacggcctgccgtcccgcgtggccgcagcgcgcgacgtcaagttcggcaacggcatcgaggtcccggagaacaccgtcgagtaatcatttactttggctcccctcgttgaggggccgcgccgtaaagcaaacagcccagtgggctgtttgcaggtgaggtgcgaacgacagtgagccaacaatcagcagccgtcaggctgtccgtaattacaggacgctgtcgccgcagatgactgaggggagtacgagcaaagattatgctcgtgctcccctcgtttttttgccgatgacggaagaagctcagtgctctccgtaatgagttcggcagacggctatttccaggttttgaacatcgttacccgtaatgcggtatacgatgcggttcttttcatcaatacgacgtgaccagtatccctgacattgccgccatggaatacgaacaacttgaatccaccggtatgtagcccaacgctgatagtctgacaagcagtctgatttgtttgcaatccatggtttcaaggagccttcatgactgagaacaacgaacatctggccctgtggggtggtcgctttacgtctggtccgtcgccggaattggcccgactgtccaagtccacgcagttcgactggcgcttggccgacgacgacatcgccggttcccgcgcccacgcccgtgctctcggccgtgcgggacttctgaccgccgacgagctgcagcgcatggaggatgcgctcgacacgctccagcgccacgttgacgatggctccttcgcccccatcgaagacgatgaggacgaggccaccgccctcgaacgcggtctgattgacattgccggcgatgaactcggcggcaagctcagggccggccgttcccgcaacgaccagatcgcctgcctgattcgcatgtggttgcgccgtcactcccgcgtaatcgccggactcctgcttgacctcgtcaacgccctgatcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctccccgtacggctccggcgcactggccggcaacacgctcggcctcgacccggaggccgtggcacgtgagctcggcttctcccgcgtgaccgacaactccatcgatggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggcctgctggccaccctgaagggcctgcccaccgcctacgctcgcgatctgcaggaagacaaggaggccgtgttcgaccaggtcgatacgctcgaagtgctgctgcccgccttcaccggcatggtcaggaccatgcacttcgacggcgaccgcctggaagaggaagctccgaccggcttcgcgctggccaccgacatcgccgaatggctcgtcaagaacggggtgccgttccgccacgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatgaagctccctctgatgagggagctctattttgttgttgtcactgcaacggcatacactgagaaaccgtaacgaacgggagccgtgaggctgagaggaagtcgccagacttcgaccggggaacttgacgcgggtcatgccgccgtaaggaatcgttgtcgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctcccggtggaagacaagccgctgaacctgggcggtcacgagttccagtcgcgattcattctgggctccggccgctacgacctgaacctcatcaaggctacggtcgaacatgcaggcacgcaaatcgtcaccatggcactgcgccgcgcgcagaccaccgagaacagcgtgctcgactacattcccgaaggcattacgctgctgcccaacacctccggtgcgcgcaacgccgaggaagccgtgcgtatcgcccgactggcacgcgaagtgtgccacaccgacttcgtcaaggtcgaaatcgaacacgagaccaagtacctcttgccggacaacgccgaaaccatccgagccaccgaaatgctggccaaggaaggcttcgtggtcatgccctacatgttcccggacccgattgcggcccgtcagctggaggaggccggtgccgctgccgttatgccgctcggttcgttgatcggctccaatatgggcctgcgcatgcgtgacttcatcgaaatcatcatcgccaacgcgcatgtgccggtcatcatcgacgctggtatcggccgtccgagccaggcctgcgatgcgatggagatgggtgcggatgcggtgatggcgtacacggccgttgcctctgctggcaatatcccgctgatggctgaggcgttcaagcacgccatcgatgctggtcgtgcggcgtatttgtctggccttggcaaagtgaccgagggacaggctgtgccgtccagcccgactacggggtatttgcactgacacttttattagctcccctctctgaggggagctggccgcgtagcggactgaggggagatggaaacatggagaaaacatggcattgactgatgaacaggtggagcggtacgcgcgccatctgattttgaagggtgtgggggtcaaagggcaaaagcggttgctggcctccagcgtgctcatcatcggagcgggcggtcttggttctccggccgccctgtatctggcggcggccggcgtcggccatatcggactggtggacggcgatgtggtggatatgagcaatctgcaacgccaaatcatccataccactgcacgtgtcggagcgcccaaagtggaatccgcggccacagccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtatatccatgccggcgtggtcggattcgccggtcaggtgatgaccgtcattcccggcgaaggcccctgctaccgctgcatcttccgcgacctgcccgccgccggtgagattccgacctgcaaggaagccggcgtactgggcgcggtggtcggcgtgatcggcagtctggaggcgactgaggccgtcaagctgattgccggcgtgggggagccgctcgtggctcgcatgctcactgtggatgccctgaccatgaatattcgacgggtcccactgccaaagcatgtgccggattgcccggtgtgcggtgagcagccgaccattactgctattgatccggccaactatattcagccggcctgcgcgatttagagctatgtggtgcccctccttgaggggtgccaagatcagaacgagaggggaagaacatgcctattgctttgcataatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggctacgatgtagcaagcctcgatggcggttttcaaggttatctcgactatcttgaaacccaccacgattaacggttcccgttgtcgttcttttggatgagtgtgcacggacatatttgtgccctacaatcggtcacggtattactcgatggattcttgaatatcgccgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgttcggcactgtcgccatgttctgcgaaacttgactgtgcccgattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctgatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgatgcttccggtgcgctgttcggccgcggtggcaacctcgaagacatcgacgaggaaatgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggccacggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgactccgaggctgacgattccgccgaatccgccgactccgactccaccgaacccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggcatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtatgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctggatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggacatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggcgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttagggggttagccttggatgaagtggtcgatctgatcctgcttgcccatgaggatgagttcgtcgttgcgatgcatgaccagttccttggagccgtactggaactccttgcctggggccttgaggcccaccacggtcacgccgtacttgtcatgtacttgtacgtcctcgatgctgcggcctaccgcgtacaggggcgtgtggaccttgacgacggtgtacggcccgtcgatttcgatgtaatccagataattgccggccaccagatggcccacgcgcttgccggcatcggtctccgcgttgatgatgtggcgggcgccgatgcgctgcagaatgcgcgcatgctcctgggacacggacttggcccacaggtcggaaacgccggcgtccagcaggttgccggtgatgatcaccgaagcctcgatgctgtcgccgatggccacgacggccgtgtcgaactgggaggcgtcgatctgctcgatggccagcacatcggtcatatcggcctgaatggtgggcagatgcgcggaccaacgggccacaagctccgggttcttgtccactgcgagcacatcctgacccatctggtcgagggtggcggccacggacccgccgaaacggcccagtccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccacccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcacgcctttgacctcggaaagcttcgtggtgcccagctcgttcgcggtgagcatacgctgggagaccttgagtctgcgggaaacgccaagagccaccatcgaggcgaaggtcatgactcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggttagaataatgagcagtgcgaccgaatcgacaggaggatgccatggccaagcgcaacgcggtggtggtgacgcataccaggctcaggcagaccggaaccgtagtggccgaggcggtgagccagctgcgagtggccggtttcgaagtcgccatcatcgacaacaccgaggcccccgatttcggcgtgcagccgccgtgcgtgtcggacgacaccgaaatcgtcgtggtcctgggcggcgacggcacgatactgcgcgccgccgaactcgtccactgcacccaagtgccgattctcggcgtgaacatggggcatgtcggcttcttggccgaattcgaaagcttccagatcgacgaggcgatccgccgggtctccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccacgcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccgactctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgctggcgtcgctggtaccgagcccgacaagccgggcgaacgtgacggcaaggcaggatcctgatgctcgaagaactcgatatccgcaatctggggccgattcgagaagccaccattgcgccggccgcaggcatgaccgccatcaccggtgagaccggtgccggcaaatccatgctgctctccgcgatccgactggtctccggcggggccgccgaatcctcgcgcgtctcggccggggcggacgaggcttgggcccaggcgattttcgcgctctcggatgatgccgtcgcatctgaacattccggcgacaccaacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggctgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaatcgacccgcagccgggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttctccgagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcgcccgtcggtggggccccaccttggccgacgtgctcgcttggcgggacaaggcggcgttcgatctggaggatctggatgcctcgccggaaaaggtcgccgaactcgaatccgaacggcagacgctgtacgatgcggccctcgccgccgccgacgtgctgagcgccgcgcgcgtggctgccgctgccgacttgggtgcgcgcgtcactgaagaactcggctcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcaacggcgaaacccgcgtccacgaaatcgcccgcatgctctccggcagcgaatccgaagcctccctggaccacgcccgagaactcctatccgattctcgacttacgctcccgctggcgggagctggcgccgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtgccgcccgactacatgaccaaagtttccgccatgcaattccgccagatcgccgaatacaccatcgcacgcttcggccttacagacacgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaggcgcctaggcgccgcgccggtcgactgcacggtgttcgaagacctgctggtcggcatgaagtcggccaaatcggtcggcatgaaggtctgggccatgcacgacgactcctccgcctccgattggcccgaaatctgccacctggccgacggtgtcctcttcgacttccatgacgccccgcgcgtgctgtgataaaaaagttacgcccccgctggcggggctgtcggcgggggcgttgttgggcatgggtacccctttccgaggccattgtaggcacgagtcatgtttcgacactataagctgacgatgtatttgctcactgtttgactgttatgtaacacaccttgacagttaagcagaacagttatactgtgttgtataacagctaaacagctggggtgctagtcaaccacaatcgaaaggggcataggtgaaactgatcatctcatccgtgtccggtgaacccatctacgagcaaatcaaaacccaaatccgttcggcggtgctcagcggcgagttgaaggcgggcgaggccctgccttccttgaggaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcaaaacccagattcgcgaaagcctggccgaggcaagccggggcgccaaagccgccggcattccgctggacgcattggaccgcatgctcgaagaggaataccgcaagaaataacctcgagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccgggtcgattcacgtgctcggcctcgacaacatcgccaacgaggagctcgtcaaagaacaactcggtgtggtgttcgacttcagctacatgcatgaacagtggcaagtcaagaacattgaacgtattgtcgcgccactgtatccatcatgggacggtggatgctatcgcaagtatctggatacttttggccttggtgacgcacagaacggcaagaaacatatcaaggatctttcccgcggcatgcagatgaagctgatgctggccatcgcattgagtcatgatgccaagctgctgattctcgacgagccgaccagcggactcgatgtgcttgcccgcgacgaactcatggatatcctgcatgcctacattgaggatggcgagcattcggtactgttcagcacccatatcactgccgacctcgaacgtgccgctgacttcattacctacatcaccgatggccgtctctactacaccggtccgaaagacgagtttgaggaatcgttccgcctgattaagggcggtccagacgaactggcacaactgcctgcggacgtagtgctgggctcacatacgtatgccaccggattcgatgcgctggtccggtcagacaggcttgatgctgttgcgtcggtggtttcggggcttgtcgttgaatcggcttccattgatgacatcattcgactgaccaatgcccatgattccaatcgtgacttgagcgggaggtgagcggccatggaggcaatactgagggtgtcgcggtctcggcaacatgcattgaccactgcattgcgcgtcgatatggcctacctgtgcgtcggcgaacggactgtgttctcgttgttgttggcaccgttgttctccgtcatctttcaaggtgaagcttatggtgatggcttcggctatcgcatgggtgtcatcatgacggtattcatctgcgccatgtgggtgctaaccatggcggttgctgacttacagaacggatatcgacttcgtggcattattccggcttcgaggaagagtcaggtggccgcgcgatatgtggttggattggtgatttccgtattgtcgatagcgatgattgttctgattgacgggttgcaagtgctggtcaatccggattggtcattcgcgggcaatctgtgggcggcgccgttgggaggtttctgcaccgcgctgatggtcgcgcttatcgtgcccacgggttatctgtggaccaaactaggcggtcttcgagtcacgatgatggtgatttatgtcgttgtattggctgtatccatactgctatctatttcgcctgcttcggtgaccagaggattggcccatgccgcgaatgccatcatcgcgcaacgattgtggctggttattgcggtattggcaacgacggttgtggcatatggaatctcgtatgtaattgcctctcgcatatttgcttcaagggaatggtgacgatgagctggaaatccgtagtaaagcaatgtcgattcgattgtgtcgggacgggtctgtttagcgtggcgaatatggtatttctgctggttttcccggtgctgtctatcgtggtgtcgctggtgacgataccgacccacgtcgatgaacacgttgccagtggtctgatgggcggactcggaggtttggcatcggcgatggcatgtatgagtgcattggggcctgcgtcatccgaggaatctgcagggcacagtgccatgcgagggctgattcctgtttcacgcactgcacaagttgtaggtcggtacctttttctgttggtggttggcctgctctgggctttggacgtggtgatatgcggcggcgtcttcattgtctttggcgatatagcagatatggggtggatcggtaccttggcagcaggtgctttcatcttcgctttggctgtcattcttgggtcggtgctgctggcctgtgcataccggttcaccttccgcaagatgatggtggcctctgtcgcggtcatggttggcttgtatgccgtcattgcgctgctggcccgattgcctgtcgactggcaatggcttttgctgaatattaccgatttcctgacgatctggtggcatacggcgcttgttctcgccgtgctgtgtctgctcgcatattttggctccatgcttatagccatccgcatctaccgagccaaagaactctagccgcgcatttgtccgaccgcgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgccggcgtcacggcgggtgggcctgcggtccataagattgtcgcgaatcggctccataccgagcgtcagcgcgggcgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccgtcgaacatcatgccggattccaagccggcgcggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcctttggcgaacacggtaatgccgtcgccgtcacgcaccacagtggtcatgctcttggtctccgacgagaacggatacgtgtggagcaccgtcgcgcgctcgcggcgaatccggtagtcgagtccggccttgtgcgcggcgaccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggtgcattgtacgcctcgatcacggtcatgcggttctgggtcaatgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatagagcatgttcgtgcggtcggccaccggggtcttcgggtcggtgaacacggcgtcggcggctttggcactcggcacgctttcgccggtgagcgcggattcgtcggcggtcagatcgttcgattcgatgaggcgcgcatcggccggcagcttgtcgccggtgctgatctgcagtacgtcgccgatggtgatgtctcgctgcgacaccagcgtgacctcgccatcgcgcaccacggtgacggtcgtgtcgtcattgatgtcgttcagcgcttcgaatgccttggcgctgcgaccctccatcaccacggtgattgtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttgacgatgcgggaaagcatcgattccggcttcggcttggtgaaggcgttgggaccgtactggttcaggttgtgcgcggcctgttcgctggtcaggccttgatgtgcatcggtgcccagcgtgctgatgactgctggcgcatcctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaaccgatacatgctggtaaagcatgtatcggttgggaattgtcagttagtgccgtcagcggactatcacagcgcctgggcggccttctccacgtagtcctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcttgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccg

SEQ ID NO: 26 - DNA, 2473844 bp, Bifidobacterium longum (residues 1,236,923-2,473,844 of 2,473,844)
  modified_base (655361)..(655457): a, c, t, g, unknown or other
  modified_base (832193)..(832289): a, c, t, g, unknown or other
  modified_base (1330979)..(1331076): a, c, t, g, unknown or other
  modified_base (1999775)..(1999873): a, c, t, g, unknown or other
tccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcaccgacccggagatcatccgccagcgcacgctcgacggtgccaagatccttgccgaacgactactggccgacgacgtcaaggccaacggcatctccgtgctgaccggcggcaccgatgtgcatctggtgatggtcgacctgcgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacccgcggcttcggaccgaaggaatacgaggaggtggccgacatcatcggcaccgcgctcgccgccggcccgtccgccgacgtgaccgcgctgaaggcccgcgtcgacaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggcccggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccactctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttccttgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatcccagggaagacaatcccaccgccggcgaaatcgaagaggaaaccgaatcagccgatgacgccgccggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgttcttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcatcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgcttaacgcttcggcagacatcgaatccgaaatcaccacgcccgtgtacttcagggcgttgcgaatatgaccgtcgataatcgtagaagaaaacaccgccggattattcgggtcgatggattgatacgtggccaacgacatcatcaccatcgcaggatcggtcttggtgatcgcctggtcaaaggcacctgcctcggccccgcccaacgtggtggtcgtatccagaatgccttcggtggtgaagtcggtattgccgcttaccgcgcccaacccaggataatgtttgaccgccgcgccgacctgagcgtctcgcaaaccttcaataacggcgatgccatgttcggcgttgccggccgcatccaatccgaaatcacgatccagcgcgccaatcggagcatttgaggcacgatcgcccaccaccgtgccgagcaccggtgccaaatcgacatttatgccagcagcagctaattgcgaaccccacgtgcctgccgattgacgcaatgcgtcagcggacattgtgccctgctcaacggcactgggcattgtgtcgaaaccggtaccagtcagatgctgcacctgaccaccctcctgatcggtggcgatgatgagacgattgccggccggcgcatatccttggagttgcgcggtcgcggtcttgaccgtatcggcgccggtattccaattgccaatgagaatggccgagccaatgtgctcatcggcgattgttgaagccaacgaggagggatcggaaccggcaagcaacggcaccatcactaactgtcccacacgttcctcaagtgtcatggcggataccgcacgttgggcttgtgcggccggttcgttcttcttcggggaaggaacgtcggcgcgtggtaacgcacttgtctgggaggtctggggagtggtggtgttgccgtttgatgtggatttggcgaaccatccgacatgccatccgtaggctgccacgccggccaacaccactgccaaagcacatattgtcgccacgattggagtgctcctgtgccgaagttggcgtgtggcgtgtgctgagggacgcatatgttgtggccgttggctgttcataccggcaagcgtagaacggagcgtagaacagaacgctgcctcattctgtgctcagggcataacctacctcccgccctttcgataggcttgagttatgtcttttaacgatcctttctcaatactgttcggcaatggcggcgattcacgacgcaacaatgcgaacaatgacgatccgatcatcctcgatgtcgaggccgatggggacggtccggcccgcaacaccaacgccggcccctccgggtcatcccgccctccacgtggcccggccaatccgcgtatcacccgtaagccagcgtccggtggctcaggaggcagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccttgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggctctcagttcaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcactcatgtgctgatgggtggtatccgcattactatgccggttaacggacgcggcctgttctccatcaccaagcgttgccgtcgccagcttggcatctggctgatgctcaacatgttcgcttgggcagtgcgccagatgatcggcgtcttcgaccagctcaccgtgcagggttcacgcatcaccggtgcctcctacaccgccgtgcatgccaacatccccgtcaccttcatcatggccgcgctgaccgccatcctcggcgtggtgctgggcatctggctcatgcgttcccacacgctcgaaggccaggcgtccatcggcgtgcgcgcctccgccgcgctcaaggcctggcgtgtgccggtgacctccattgccgtcgtggtcgtggtgggtcttgtgctcaccgtggcatggccggtgctgttgcagcgcttccgcgtcaacccgaacgcacaggagatggaatccacctacattcagcgcaatatcgacgccacccgcgccgcctacggtcttgacaagctcaagaccgagcaatacaaggtaaccgacaagggcgagcagggcgctctggccaaggagggcgacaccaccgcgcagattcgtctgctcgacccgcaggtcgtcagccccacattcaaacagctgcagcagtccaagcagtactacaccttcgccgacactttggcagtcgacaagtacgagatcgacggcgtttcccaagacaccgtgattgccgcccgcgagcttgacctggccggcaacgacaaccgcaattgggtcaatgaccacaccgtgtacacccacggttacggcgtggtggccgcttacggtaacaaggtgaccgccgacggccagcctgaattcttcgaatccggcatccccactcagggcaagctcactgaatccgaaaagtatgagcctcgcatctacttctcgccgaacaccaccgaatactcgatcgtcggcgcaccggagggcacgcaggcttgggagttcgactacccgaccggttcggaaggcgccctgaccacgttcaagggcgacggcggcccctcggttggcaacctgttctcccgtattctctacgcaatccgcttcggctccgatcagattctcttctccgaccgtgtgaccagcgaatcgcagattctttacgatcgttcccccaaggagcgcgtggccaaggtggcgccgtacctgacgcttgacggccgtgtgtatccggccgtggtcgatggccgcgtcaagtggatcgtcgacggctacaccacctccgacgcctacccgtactcgcagatgaccgacctcggctccgccaccaaggattccaccaccgtctcttccgcaacggtctcatccttgggctcgcagaaggccaactacatccgcaactcggtcaaggccaccgtggacgcctacgacggttccgtggatctgtacgtatgggatcaatccgacccggtaatcaaggcatgggagaagatcttccccggccagtaccaccagctctccgatatctccggcgacctgatgagccacatgcgctacccggaaagcctgttcaaggtgcagcgcgagctgctctccaagtaccacgtgacctccgccaaccagtactactccggcgaggacttctggcagacgccggtcgacccgaccgaatcccagtcccagcaggaccaggacatcctgcagccgccgtactacctgaccttgcagaccggtggcaccaaggaaccggtgttctcgctgagctccacctacattccggctggccagtccacccgtgagatcctcaccggcttcctgtcggtcgactcggatgccggcaatgagaagggcaagataggctcaaactacggcaccatccgattgcaggagctgcccaaggattcgaacgtaccgggccccggccaggcgcagaacaacttcaacgccaacgccgacgtgtccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggtaggatttgcggatacgttggatgaggccttggatcaggtgttcggtggtgattccggcgcggccgcaggcgatgccgagaacgtgtccggtgacggatcgtctggtgaccagtcgtccggcatatccggtgaccaatctggttccgataccaatggtggccagtccggcaccacggacggcaagtcggattccggctcgtcttccgaccgtagccccgaactccagcaggcgctgaacgatgccgcccaagccatgaaggacagccagtccgccatgaagaacggcgactggaccgcctacggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacgtccaagccatcgccgacatctacaacgcctcagtgatggccggcggtgcgaccgccgacctcaccccgcgcaccttcgaccaacgccgcgcctgggtcgaatcccatacgccgccctacggcgtttttgttgtggaatcggaagacggttcaatcattggcttcggtgcgctctccgtgttctatgaccgcgcaggatatgacggtgtcaccgatttggcctattacatcgatccggcatggcaaggcaggggagtaggcacgttcatgcttgacaggctgctcaccgaggcgctggcccgccacatgcgcaaggcctgcggcatcattttcgccgataacgccggctccattgccctcatgcaccgcttcggcttcacccaattcggactcatgcccgccgctgccaccgactccaccggcaccatgcgggacatgtcctactggtatttggacctgtagccttgcagtaagtcatttcagtcaagaaaagtgtgaggatgccggagcaaacgagcttgacggcggcgttgagtacaatcttgacggttggatccggccgggcatgggccagtgcgcgaggcgaacgcgcgcatgacgtacggaacgtacagaacgtgcatacgggaataaaggaagacggacgaggagcggattatggcatcggatttctggctgattgcgggactgggcaaccccggcaaaaaatatgaggacacgcggcacaacatgggcttcatgaccgccgacgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgcatgggcgtcggtcactccaagcgcggtgcgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggtaggcatcctgtctgagctggaacaggacaagaccttcctgaagctcgccgccggcgacatcgaggcttcggacgacgtcgacaactccgtcctggccggcatccccgaaggtttgcgcccggctttggccgccgccatcgggcagggtgtggccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgtgatcctcctgagcgacccggagaaactgcgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgaacatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcatcatcggcaccggcgccaacaaaaccactcgcgaatacctggtcatcgaatatgcgccttccaagcgcggcgccccggcggacaaactgttcatccccaccgaccagctcgaccaggtcagcaaatacatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgaggccatcgaggggctggaaaccggcacggtggacgtggtcatcggcacgcacaagctgctgaacccgaaaatcaagttcaaggatctgggactcgtcatcatcgatgaggagcagcgtttcggcgtggaacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagattcacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcttgtacgacccgtccaagccgatgaccgagcagtcccatgaccggctcgccaccatcgcgcagaacacggcgctcggctccggtttcgatgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagagaacgtcgagccggtggccgtgtccatcgacctgcccatcgaagcgtcgattccgatcgagtacatcgattcggacaagctgcgtctggaagcgtaccgcaagctcgcctccgtccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgcccggtcacccaccagctcatcgtccccaccccgttcaccggctccctgggccaaggccccatgagctccgaccaggtagtcctctggaccaaccagttacttgatgatttggcatggaccccgtcgtcaagcaaacggcagagccgtttgtagacggggtgcgaggcggcagtcgagccagctatggctcaccgggcaacctccggtgagccatattcatattcatgccgtcgtttgtgacgatgattcaccccagacggaatcgttccggctgtccagcgagcgggattaagtgactgctatgagcgaaacgactacgaaccgcacgaaccagagcgcgaccacggcaacacttgccggctatgagattccccgcctcggcatgggcacgatggcgctcgccatcgaggggcgcccctccaaccgtgatcaggcaatcgagaccatccatgccgcgctcgatgccggagtccgttatttggacacggcttggtcctattatctgcccagcgcacccggcaccggcgaaccggaggatatgggctatggtgaatatctggtccgcgatgctctgcactcgtggcatggccccaaagatcaggtgctcgtagccaccaaaaccggctggctgcgcacgcttgacggcaacggcaactacggctggcaggccgacgcccgacctgaaaccatgatcgccaatgccaaggaatcagcccgccgcctcggtgtcgatacgctcgatctgctctactcgcactgcaatgatccgcaggtgccgtacgaagaccagatgggcgcactcaagcagctcgtggacgaaggtgtggccaaagcggttggtatctccagaatcgacaacgcggacatcgaaaccgcccgcaatattttgggcgatcgtctcgtggccgtccagaaccagttctccccggttcaccgcgaccccgaacacacgttggaaacctgcgaaaagctcggtttggcttttgtctgctggtcgccgctcggtggattccttgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgagatcggctacctcaatggcaaggacgttgactgagcgatttcgtccgtactgccttgcaatcaggcggcacactggcattgtgagcgctaacgctaaattttgggcgtgttgttcacaacgtccacaaatcgcactactcttaagaatgtcattcaagatacacaaccgttttaaggagtagttgtggcagtaattgaaagcgtgtacgcgcgtcagattctcgattcccgtggcaacccgaccgttcaggtcgttctggacaccgaagacggcgcccagggcctgggcctggttccgtccggcgcctccaccggtgaggctgaggcttgggagcgtcgcgatggcgacaagtccgtctacggcggcaagggtgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcttgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcactgagaccctcgacgccatcgagctggccaccgccaacggctacacctccatggtttcccaccgctccggcgagaccccggacaccaccatctccgacctggctgttgctaagaacacccgccagatcaagaccggtgccccggcccgtggcgagcgcgttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacgagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgatcgccaaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggctccgatagcgaatcccagaaaacggaagattccagtagcagcaacaaaaaagtcctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaatccgatcagaacacccaacagaatacccaacagaacacaggggagggaacccaacagtgaccatcgatatcgccgccaaggccaaggcccttgtcgataccgtgcttgccgagcccgccaacgatcatgacatcgacctggtgcagcgtcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggccttggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccagtccttggttatggggccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcaacggcgtcagtgcgcccactacccaggttcagggcgcgttttccatgaacatcggttccgtgcgcatgaccgaacgtcatctgaccaatgatccgccgacccagacacagatcgatgaggccgttgcggacgtcgatgaacatatcgatgaggccttccgcaccgtggacgcaggcaaggcccgtaccatcattggcgtgtccggcacggtgaccacgatgaccgccttggccatgggattgaaggaatacgaccacaccgtggtcgacgggcatcggttgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttataatagaaaagttggcctccgtggcgaaatggtatacgcagtcgacttaaaatcgatcgcttcggcttgtgggttcgagtcccaccggaggcaccttgaaatcggcctgtggccgatgccgttttgcggctgtgccgtggtctctccccagtcggcttcgccgacagcccccctcgtcagagggggctcgcagctcactatgtggagagcttataaggccgaaacaaaaggccgttaggctatgtggcgttgtgacgatgtacctgatgaaacgaggaatccacatggcttcacgctggaccgatgtcgaacgagtcgaacaaggcgccctgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcatgacgcgcgcggccatcatcgcacaaggcgaaagcgattccgggcgctgggctgggatacgatatcgtgatggcatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctttatggttctctggcgctgaccggtctcggccacggcaccgatcgtgctgcgatggctgggctcgaaggcaatctgccggccaccgtggataccgaccacatgatgcacatccgcgagatctgcgcgttggatgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacgagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgaccgccggtgccatcggatacctgttcaaacgcaacgcctcaatttccggtgcggaagtcggttgccagggcgaagtcggctcggcctgttcgatggcggcggccggacttgccgcagtcgtaggcggcacgccggaacaggtggaaaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggtggacttgccgtcaatgtcgtcgaatgctgattgacatgtccggtattcaccagcatgatgaccggaattgacgtatacggccagcgtgtcgtatcgcacagggatgaaggactaccgccgattcgccgatggtgctaaggtagggcgcattgtgtctttgaaggaggactaatgacagatcagatgcctcaggtgaacgccgaatttggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagtttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacattatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgactgtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaacggttccagcgcaaacgaaaccggggtatacgtgccggcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggccgtccgtgcacgtcgagacgaatcttgcgttccacttccgcaggggcaatgccctcgattttcagcgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagttgacgatacgcttcttacgctgccgtaacctacgttagcgtaacttttatgcttgtcaataccgactcgcgcgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcggtggtgattgtgctcatcgcgctgatttgtgtcgtggcgttagtcatcggcttgttcatcacccatagcatgggattgtggggagctcagccgcaggcgcaaacatcggcacagtcgaccggggccgatgcgttggattccgccgatgatggcacgacggattcttctgacgccaagtccaaggccaagaagaacacgtctgatagcgccaaagacaagaacagcgacgattcgtccaagaaaagctcgacggagaagtcgaagccttccactccggtgatcacatccagccagttgtctgacatcgcggattcatactcgtcctccgatgtggccgtctccgccatggtcatcgatggaacatccgccgactcctcagaggacgccaccatcgcgaccacgtcgcagtccggcaagcaattcgtggctgccgatttctatctgccggtctatcttgcggcccaggacaatggcgatgacaacgtcaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgccgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttctctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcagattgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcatcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccactgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacgccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcgtcagggcatcgcgttcacgccatagcacacagttccataaaaatgatgtaatgacacgagaaagaatttgacaaaaccgaaattgcatgtgtgtaatttagtccgtatgaaaagctcaataggcaaggagaatcgcatgtggggtgtggtcgacgattcagccgaagagccatggcacgaattgtggggactattccgacctgatggcgatgtatcttggcagcacaaggcgttgtgcgcgcaaaccgatccggaggcgttcttcccggaaaaggggggctcgacccgtgatgccaaacgtgtgtgcgcaaaatgcgaagtgcgtgagcaatgcctgaaatgggccatcgaccatgatgagcgattcggtatttggggtggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggggtcgtcatcatcgccgacgcgaccgggcgcaccagttcgaggataaccacctcgttcgaggtcatcccctcgccatcggggccggtgatggaggtgccgcagtccaagcatgtgaccattcacatcgtctcggccaagggcgcacgctccttcggcgatgcggtcagccgggcattggatcgtgccgatctggatgacgctccccgcgcattgtggctgctccatgatgattcccgcccttcggatgactcatgccttgaacgattgcttgaggcgtggcgcaatacgccgggcgccagtgtgctcgggtgcaaacagtgcgattgggaaggctcccatctgcatgatgtcggtatgtatgcgggtcaccacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaagaagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccaggcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtggccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcgggcaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtctgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcgggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcacgacaaatggtggtacgttcgtggtccgaacttgatttcgataatgtctgctccaacgccaaggtgttcggtttcgatttggacaacacactggccagctcaaaacagccgatgaagcccgcgatgatcgaacggttctgtgcgttgctcgaccatacggtggtggccctgatctcagggggcggcatggcggtggtcacctcgcaggtgctggatgtactcaccccgaatgccaggcgcggcaatctgcatgtcatgcctacctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctcttgggcagttcgcgcccgtagcggccaagcaggcatgggatcgcgataacacgaagaaacaggcgctggtcgaagcggtcaaggccgatctgccgcatatgcgggtcagggccggcggatacaccagtgtggatgtcagcgaatgcggcatcgataaggcctatgccgtgcgcaagctgacgcagacacttggcatacgggccgatgaaatggtgttcgtgggtgatcgcatgacgcctacgggtaatgactatcccgcggttgaggccggtgcgatcggtgttcgtgttgagaatccgcaagatacggtacaactgctggatgcactgcttgcgcgattcgatactccagctcgatagtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgctgggccctgttcgcgcaatgccgggaacgggatgcagacagtggtggcggagcccgtatatggtccgcatcgatttatcagggagcggtacgtcgtgccattctcgactggaaggaccacgacgataccgagcttgacggcccgttcggccgcatcatggtgtcgctgctgaacaagacgccaataccatcatcatgcttgggtcatcgcgtattggtggttccggtgccatcatcgcgggcgtcaatgcgccgaagaggacgtgcccatacggcaccgttggccaaatcggtggcaggggcattgcgtgggtacggcgtcgatgcgcgaccatgcaatgccctgagctcctccaccaaggcacgctccgtgcagcaggtctcttcggcacagcgtgcccgtcgtatcaccggtcatgtcagggtgaagcgtgatctcatcggcaatggcgacgcggtgcttctcgttgatgatatcgtcaccacaggtgccactgtgcggcaatgcgttcaggcgtttcagcaggccggcaccaaggtggtgggcgtgctggtattggcggatgccgtggtgcgacggtccgatgacgatatcaacgggtgaatgacatcggtgacgatgccccagatagcaggcgaagcgccgttgctcggcatgtaatcggggtatcgcggattctcggcgtgcaatatggtgatgccggcccgtgaaaccagccgcttgatggcgatttcgtcgtccatgacagccgcaaccacatctccggggactggtgccaacgaacgatcgacaatcagcagatcgccgttgtgaatacccgcattgatcatggaatcgccggccatctgcataacaaacagcgtggcctcgtgcgccatggcctgtgactcggattgctgtgtcatgctgcgcctcccaccctgtattcgaacatctgttcgaatacagtatacggtaggacgtcggacaatatcagcgttcggcgatgtgatatttaggcaggatgatttcgaaatcggcacctcgcgtgtcgtcgaccactttgacggtgccaccgtgcaattgggccgcccagcgcgcgatggacaggccaagaccggtgccgcccgactcggtgccgggacccgtcttgcctttgacaaagcgccggaagatgtccaaacggtcggaaggcgcaatctgggagccgaaattcaccacattggtcacgatggtgccttggttttcgtcctcgtgggcgtcgaccagcacggtggtgccgtcggccgaatgtttcagcgcgttggcgatgatgttggtgaatagctggcgcaggcggtcctgatcgccttccatcgtgatgtcggccggcacggtgacgcggatgtcgtgggcgtggccaccatcggcgatttccaacggctcgatggtctcgtcaagaaagtcggcgaagttgaacttttcgatattcagactcgccgcaccggcctccatacggctcaggtccagtaggaaggcgatgagatcggagagacgctgcgtttgggtgaggatgctctccagattggtgggagtgggctcggtgacgccgtcggccatgttctcgaccatcgcctgcaaagcggaaacgggcgtgcgcagctcatggctcacattggcgatcatgtcgcggcgcattttatcggcatgctcgagttcgccggccatctcgttgaacgagcgagccagcttgccgacctcgtcatgacgatcctgatcgatatccacgcggaccgtgtaatcgccatccgccatggcttcggccacatcgcgcatctggcgtaggggagcggtgatgccgcgagagaagaaataggtgatgcccaaggccaccaccaaagtcagcggcatggcgatccaaccggaccagccgaatttcaggaggaaccagcacatggcaaacgcgatggcagtggcgataacgatcagtgcgctgagttccagcttcagagatgagaacaaatcaaccggcttgacgcgaggtttcatcgcatcaagccgggattgctgttgttttttggatgccatcacgcggtcggcggctcgaaagcgtagcccacgccatgcacggtgcggatggtatcggcaccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgttcgccgttcacggtgacgatgcgctgggccgggtcgatgaccatcgaaccgaagtcgagcagcttctcgttctccgagttcttggcgatgaccttcgcacgctccacgcggcgcagcagcgccttgcagcgggcgataagctcgcgcatggagaacggcttggtcatgtaatcatcggcacccgctcccagaccgatgaccttgtcggcctcgtcatcacgtgcggtgaggatcagcaccggcaccggacgttcggcgacgatgcgtttggtggcctctagaccatccataaccggcagcatgatgtccatgatcaccagatcggggcgtagctgggacgcggcctggacggcggaagcgccgtccccggccacgcgagcggtccatccttcagcggtgatgcgctgggcgatggccgtggcgagcgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgtgaatgatattcgccctcgaccgcttcgaaggtgccgttgtggatgtcggagccgccgtacttggcgtcatcggtggtgaacacttcggtccacttgccgccggtgggcagcgccacctggtaatcggaccaggcctcaccggagaagttgaccaccacagccaaggtctcgcccttggtaccgatgcgcaggaagctcagcgtgttgtggtcggcatcgtcgctggtcagccactggaagccggccgggtcgaagtcctggctccatagtgccggatgcgccttgtagaaggcgttaaggtcggcgaccatggtctggacctgacggtgctcctgccagttcaggcaatcccaatcgatggaggcgtcgtgatcccactcgccccactgggccagctcgttgcccatgaaggagagcttcttgcctgggtgagcccactgataggcgaacatcgaacgcacgccggccagcttctgccagtcatcgcccggcatcttgccgtacagggaacccttgccgtacacgacttcgtcgtggctgatgggcaatacgtagtgttcggagtaggcgtacaccatggagaaggtgatctcgttgtggtgccacttgcggttgatgggctcctcgtgcagatactcgagggtgtcgtgcatccagcccatgttccacttcatgccgaagccgatgccgccggcggaagtgggggcggtgatgcccggccatgcggtggactcctcggcgatcaccatgacgccggggttgttcttgtacgcggtggcggtggcctccttgaggaagtcgatggcctccaggttctcgcgtccgccgtagatgttcgggcgccaatggccgggttcgcggctgtagtcgaggtagagcatggagctgacggcatccacgcgcagtgcatcgacgtgcaggtcctcaagccagaacagggcgttggccaccaggaagttgcgtacttcgcggcgtccgaagttgaacacataggtgccccattcagggtgttcgccgcgcagcgggtccgggtcctcgtacagcggggtgccgtcgaagcggccgagcgcgaaggcatccttcgggaagtgggcgggcacccagtccatgatcacgccgatgccggcctgatggaactggtcgaccaggtaacggaagtcgtcgggggaaccgagacgggagtcgaccgcatagtagccggtgacctgatagccccaggagccggagaacgggtgctgggccagtggcatgaactccacgtgggtgaagccttcctgcttgacgtagtccacgagctgcttggccaggtcgcggtaggtcagtccctgcctccagctgccggcgtgcacctcatagatggagaccgggccatcatgcgggttggtggtgcggcggtgctgcatccaggcgtcatcgttccacttgtaggtggattcggtgacgatggaggcggtgttcggcggaacttcgtgctgacgctccatcgggtcagccttcatctcccatgtgtaattggcgttcaggatctggaacttgtaggtctcgcccgcgccgattccggggatgaagatctcccacacgccggaggagccgagctcgcgcatggcatgacggcggccatcccaagcgttgaagttaccgactacgcgcacggcatgggcgttcggggcccacacggagaatgcggtgcctaccacctgttcgccgggcgtgccgtctgcgccgcccatcggatcgtcatagcgcagcacatgcgcgccaagcgtctcccagagcttctcgtgacggccctcgccgaacagataggtgtccatgtcgccgactgtgggcatatagcgatatgggtcgtcctcaatgagcactgcgccgctttcccactcggtcctgacacggtagtcgggaatcgtgggctgcttcttagtgccggaagccggcacggtaaccacgaacacgccgttgtattcgtgggtcatcgggtattcgccatcctgggtgaggatggtcacggacttggcaagcggacgcagcacgcggattgtggcggtgtcggcatgcttgccgatgccgagatgcccgccgagaactccgtggggattgtagaattcagcattgctcaccgcatcgaggtcgccttgggcgacaggcacggtgacggtatcttccttgatcttcgtttcttcagccatgacccaaagtctacgtgcgttggagtcgtaaacgctacattggcgcgtcgaaaatggcgaattcttgcccttttcggtgtgtcttcgtggttgtgagcgctctcataggggcggtccaggccgcatggcataattattcgagtttttgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggtgtgcgtgacatcgtctccgcatccgaagtggccaaggtgttcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggcgagaagcgcatgctcaccaaggcccgtgccattctgacttctgagatcgccttgtccgagaagatcgacgaggcggaagcccagcgtctgctcgacgtgaatctgggctacgagcccgctcagcccggtgacgacaagcatcacaccgccgagcccgaagaggccgcggccgatactttggctcgtgttgaagccgagaagaagtccaagaagaagtgatttgattgttttgaggccccggtcgtgtccttatgcgatgcgccggggcttcgtgattcataatcgtttgctgccgttcgtctgggcaacgccatcgaaggggactgcatggggtctgtaggagtgctgatagggcaaggttttgacgctcaccgttttgcgcctgctggctcaggccgtgaactgtggattgccgggctctactggccggtgcctgattcatgcagcgaggccgatgccgccaaatacgaggggatcgaaggcgattccgatggcgatgtggccgcgcacgctctgattgacgcgttgcttgccgccgcccgattgggagacattggttcactgttcggtgtcggtgcggacgcgcatggtgccggaatgcatggcatcgatatgttgcaagaagttgtggcgcatctggcatccaacgggtatacgccggcatcggcctcggtggcgatcatcggcaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcggcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgcttctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcgcagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggttggagtgggacttggtgaactcggacgcccatgtttccaacgatttctcgtccgcctgccatgccttgagccgcttctggaaggctttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcggccagcgagccccattgattgagggaggccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcttgcaccgggttcatcgtccagctgccgttgcccaagggcatcaacgagaacgcgatcatcgacatgatcgacccggccaaggatgccgacggcatgcacccgtacaacctcggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgtcgccgcaatgggttcggccggattcgtgacgcccgacaaaatcaaggacggcgccgtgctggtcgatgtgggcgtcagccgcgtctacgacgaagaagccggtcgctaccgcatcaagggcgacgtggacaaggcctgctacgacaaggcctccgcctacacccccaaccccggaggcgtgggtcccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgagggcaccgtcatcgaagccgtcaagggcggcctcatcgtcgacatcggtctgcgtggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctctctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagaccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtttaacggaaacccggtccgattgggccgggtttcttgtgtttttggagttatccgccaatgactcacctcagtctcgctacgcgagccggatcccctccctgaggggagctgtcggcgatagccgaccgaggggagcgccagctatcatgggcaccatgatgcgaataggactgaccggcggcatcgccgcgggcaaaagtacggtggcggcgcgactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggcacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatcccggtctacgaggaactggccgtgcgcatcgaattcttcggcgacgagatcgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccacttcgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgtgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaacttgcggcccgtctgcgcgacgagatccgagacctcaaaaaagaactccgtcaaatgacggaagccaacaagtaaccaaattcccatacccgaggcgggcagtcaggggatgcgttgtcgaccgtaaagacttggcctgagcggcccggagcgtgtcgaacaacacatcccctgactgcctggcgatcagcgctaccggaacggccccaaaaccgtcacatacataagttagtgtagggaatcatggcagaaaccccactcgcatttgaaatcatcaccttcgtggtgctcgcgttgttctttatcgtcgacctgttcgtcatcgggcgtcgaccgcatgtgccctccaccaaggaatgcgtgcagcatatcgccttcttcgtggttatggcgctgatcttcggcggatgcatctggttcttcgccggctccaagcccgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggcggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggtaagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcaccaaaaagtccgggtcatacggcatcacgatggcgcggggcgaattgttcgctccgcgctttttcgtattctcggcatcgtctggcctcacgatgtagcgtggaccggcggcaccggccagctcttgggatgggattgcattatcaactgcgtactgagtacgcagctgataatggtctgatggcatggtgacattgttcgtcacgaggtatgcaacggagacattgaagaatgcggatagatatgcgagatcgtcggcgttccatcgaactttccctcccagcttcaggtttagagtggattgagtgatgtgcatggcattagcgatactcgtctgaggaacgcgatgacgctgcttaaggaaatatacgttgtcggtaataatttgacttaaaaccttaggtaggccgttgtcagtgatttctgtctttttgttcattggtgaagtactcataaagcaatgataccttcttctttattggtttgtccaataccatgctatgctataggtatgcccaatagaacgatagataaactgatggcggacagggtggaccgtttgcgtcgccaggccaatatgactcagcagagatatgcggctgaggtactgcattgctcgcagggcacggcttccacgaaattggctggaaagactcgcatgagttcgtcagatgtgttgaacagtgcgaaggcattcaatgtctccacggattatatttatggactttccgatagtcccgagcctggatgtcaagaaggggtgacggcatgagcgagagagtgttgtggcttcggttgtgcgtgaccggaccgactcccgagtgcggggagattgtcggattgcgcatcgtcgacaggcaggcgcatcgcacggtgttcgacgcgttcttccaccccgtcagggaagacggctggaagagcgtgccggcaggaggggtgaacgtgaacctagcgaaccgtctgccgttgaacatctacgtggatgggatcgaacggatcctatccggtgcgacgctgctgcgcggcgagcacgtggcacgcgacatccgtttcctgcgcgccgccggcgtccgtatcgaggaccaggtcgtggcgcgtagcgtcacggccgaacatcataagagacttgcgtcggggattgccgtccccacgcgcaccgggaaccaggcttgccggcccatcccggtgggatgaacaaaccatcccttacccgaaacaaacccatccaccacccatctgcagcgaaaagagagaaccaggaatgccaaccctacaagcgcgtgcggcccacggcggccacagcggatcgacgcccctcggcgaccgcggaagcgacgtcgtgaacgaacccatacgcgtcgtcacaggtcgcggcggcgagcacgatgccggacgagagcccggcatcgaacagctcgccgtccgtgatccccgtggacagcatccaacgcagcccatccatgacggcgggatccacgacattacggaacagaccatcggcgacggccatgcgataggccagccaggccagacgcgcccgccgcgcgagcaccgtttcgtcacgggccagcgcctcgtaccgaatcgcggctcggaccgtcacgatcggggagacatggagacgcaggggcatcgatgcgccctgcaggaacccggatatccggtccaccgtcatgagacggcggcggaggacgagggagaagcccgcatccgtgttgtcttccatcatgcccgccgatcgattgtgcttggagacgatatccgttccatccatccacgcgtcccacaggtgatatcggctgcgcgggccggcccgtgaaaaagaaaatgcccgcacacgaattgccgttcgcgtgcgggcgatggtcccatcctttacccatttgcattgccccttaccggacgaatccggctcgggcgaaggaaccagcagaagccaaccccaccaatcatcacatcagaaggagccggcaagaccgaccccgaccaatcgtcggaccagaagaccaatcgtcggaccagaaggagccaatcatgaccaattcttacatcaaccccacccagccgaccaccggcgaaccccgatattcacaggatgcccccgcatggcaggacgtggagatcgtcgacgtgcccgccgtggaggagccggactcggccgagggcgcgcccgagccgatccgcatcatagacgagccggaaccgggggaggccacggcaggcgacgcggtcatcgaatacacgcgcgaccacctgcccgtcaacatgggcgtcgacacgaaccacagcgatttcacgcgcgaacaggccgaacagctcgtcggcgacatccaggaacagctctacgagaccgcgaaaagccagaaacgccttcacgacctgatcgcccaggcatacgacgggcgcgcgtggatcgccctcggataccccgcgggactgatcggctggaaccagctatgccaggacaggttcaccgccgacgccgtacgcatgaccgtccagcaacgcaccaacctcatcctcagcttccaggacgacccgatcagcaacaggtccctcgcggccgcgctcggagtcagcgagggcacggtcaggaaggccgtcaaaaaggcgaagggcgccgccgcgaagccgaagccggtcgtgggcgcggatggcaaacgatacagcgtgccggagctcacgccggcggaacgcctcgaactcgacgcgaagatccatgacatgaacctgcccgtcgaggagggcggccagggcatgacccagcaggagatcgccgcgaagctcgacatggcgcaatccacgatctgcgcgagcatcaaacgcgagaccatgcggcgcatgagcgagggactcgaacccgcggcccccgcaccggtcgacgagaccggcgcgatcggcgtgctgcccgacgatactgcaatcgacctgggcggcgaccggctcgccgcggacgacatgaacttcgtggaagcgttccgcaccgccgcgggagacgcgaacgccggactggcccgcctcgtggagctgatgagctccgaacgctggcagccaggcagcgagatcgtcgacgagatcgtcacccgcgccggccgtgacatcaagggcgtgctggccaacgtgggcccgttcatgcgcctcgtcgaccacgacctcgaggacatgtggcccgccgacgagaacgaccgcagccgcgaccaggacgaggtcaacggactgttcgaccagatcctgaccgtcgcgtcggaatgcgcctgacccgttagcagagaaggccggccatgagggccggccggagaggaaccggtatgaacgacaagaaaaccaaggaagtggacgggcgggagagcgtgagcatgctgcccggcgtgacggtgggcgtgatgatcgcggtcatcgcgttcgtgctgagcttcgacgcgttgaggctcgtgttcgtgtccagcggcatcaacccgctcctgtcatggggaggccccctgtgcgtggacggcacgatcctcctgtgcacgtgggcgacatggggattccgcaaaggccacatccgcggacgctggtacccgtgggccggactcgtgctgttcagcctgttcagcgtgacgggcaacgcgttgcacgcatggctcaacgccggcggcatgctccccacgtggggtgcgcccgcaatcatgagcatcccgcccatcgccctgctctactcgacgcatctgatcgtgatcatcgccggcgaccgccaggacaaactcgccaggatcaccggcaaggccgccggccccgatgacgggcacgccggacccgccgcagccacgccggaaacggccggcacggaaccggtccggacggaaaacccgcgggccatccccacgccgacggccggaccggagccgggcaaagccacggaacccgcgcccgccgacccgctggaccgctacctgttcgacccgccggcccaagcggaaaccgacgcgaatcggggaaagaaggaggatccggaggacatcccgttcgaccaggacctctcatggccctccgtgacgtccacgaccacgacgtccgcaaggcccacggagtccacaatccacatggtccgcatggaccaggcccatgcggaccaggaccttgcggaccaggaccgcatgggccggaaacccgagatggatcccaagggccagccgggcccggaggcagggggtcatgcgggccacgccgaacctgagcccgcggaatcccacgaaggggccatgtccggcccggaccgttcctccgacacgggatcggcccacgatgccggcccaaaagccggtgagccggcgcgcaaggcgacggccggcttcgaccccgacgaatggctcgcatgggccgacaagctgaaagccaacggcgagacggtcacctcgacccgggccgtggccgacggtctcgccccatccaccaccacggccaaacgacgcctgcacacgctgcgccgcgagcatcccggaaggttctgaccatgagggaaagcgatgaaccgttgacggacacattggtccgctgcctcgccgaccccacggacctgaaagccctcgaacggctcgagaacgacggggaccaagccggggccaggctcatgcgcgcccgcctcgccgaccaggccgcactccggctcgacgccgcgctggaggacaaccgggcgcgcgtgcgccggcagctgggccgcgactgggcatgggccacggacgaggtcatgagcgacctgacgatacgcaccatccgccgactcgactactggcaccgcaccaacacggaccgggccgagggaggggcgacgagcctggccgcgttcgtcaaccagctcaccggcaccgtggtcggcgaatggttcaaaacccaacggcccaaacaccgcacgggcatgacccagaccccggaacggcgcgcgggaaggctgaaaccacccacggacccggacgaccggacggcgtgggaacggtggcgccggcacgagcagaccctcgccgactccgacgtgatctgcgacgcatccgacatcttcgagggacgcgacggcgacggcgagagccccggatcgcccgccgcgggcgaccgggaaagctaccggcaatgggacggcgacacggcggacgccccattgccggtcagcgccggatacaagacggacatggaggccctcgccctcgcggtccaggccgaatggggactcgccgcatggaaacggatcctgacccgatgcatgacctcgaaccgcgcccgtcccctgctcagggagatccgccactggcttgaagcccaccacaacgggaccaccccgagactggaccgctacccctacctcagggcatgcgccggcacaggcgcccgtaatcggccgaaaaccggcgatggacgagtgaaagaacaaacgaaaggacaacgggaagccggacgacgaggcccgcgaaccatagaggaacgaaaggaacgaccatgaccacgatgatgacggccccggcaggggccgaacccgacgccgtcaccctgcagatccccgcgatccccatgacatgggaacaggcgtcgatcatgctcgacgcgacgttcgacgcatggaggatgctctccggcgagatcgacgccgcccgcggcgacgactggcaatggatccaggagatcctcgccctgcccgcgcacacccggtacatcaaggccgcgggcgacgaggccatggtgtgctccgccgcgatgcgcgagacatggcccggcagatggcatgatctgctgcgcgcacgcgtgcaggacgtcatcgacgcgctcgtctcccacgaacgggaggtccgcgccatggaccccggcatgttcgcgcgcatgccctcgcccgccctgtgcgacagggtgcggaaacgccacgacccgacccggacgacattgagcatgacggtgtaagagctcgcccgatgaggcgacaggaaaggaacggaagacgatgcggatcatcatcgacggacacggcaggatcgaccggcaggccatggccgtggaacgcctcaagaccatcgacatgacgccggccgggggcggggacgcccaggactgggtaggcgcatggctcgacgggttcgaccaggcattggacctgtgccgcgccctcgaaaccgccctcgacgccgacacggggaaggagctgtccggcgatgcgcgatgacggacacgaggacaggaacgaggaagccatgggccgcgccgccgcatcggcgggagccaggtacggaagcctggaacccaccagcaaggcgttcgacaggctcatgcaggaacacaagaaggaacgcgaaacggaaggagcgagaccatgagctggcaatgcacgtcatgggcgctcagggaggcgcccgcacccacggccacggccagactcgtgctcatcgccctggccgaccgctgccagcccgacggacgcagcgcatggcccaccgtggacaccctgatgctcgaggcgcacacgagcgaatcaagcgtcaaacgtgccctgaaggcgctcgaggagacgggatgcatccgccggggcaaccagaagctcgcccaatgggacgagcacggcaactacgtgcccgacccgtaccggtccgtcgtctgggaatgctgcatgaacgtgaccctcgagcacgtgtccgagaaacccggacgacaggccagggcggaacgcgccgaacggctcgaaagcgtcgacgcgacggacggggcaaaaggcgccggttttaggggtgtcaaaatgacacccctggaaaacggcggaaacaagccaaaacacagaggtgtcaaaatgacacccctggacgatgacggccaggccaggggtgtcactggtgacacctccagaggtgtcaccagtgacacccctattgtaagaacaaatacttctaaacaaatatcccctttgcctcctacggaggcatctccccggaccggggagagccgcgacgggaaaaaccaaaccgcccacatcatcgaagccgcatccgcgccggacgaggcgaaccgccctatgggtgagcccgacgacgaacgctggcaagacgccggccccgaaccggaagagcgggtccccgccgggatacgcgccagatggatcctcgaccggctcgaaaaccgccgagccgccatgggcctgaccccgaaaccggcaggccggcgggacaccgacgccgtcactcggctcgtcgaacggctcgacgccgccggcgaacccgacacgagcgggctcatggaacgggtcctcgaccacgcgctcgacaacgggttccaggccaaacgcgtcgacacgggacgccgcttcgcccgcctgttcgacgaactgcgcgacgacctgacctgcgaccagcgaaccctcgaacgccgacgcagggagcatgccgacgccagccaacccaccggaagcgacacaggggagagccggccggcggaaccggaatcctacgagacccgggcgcgccgcatgctcgccgaccgcatcggcgccgacatcgacgcgtccaccgccatccgcgccctcgccgacaggctgcgcctcgaccccgacccggacccaggccaagccgcacgctacgccgagctcgcgctccgcgccggccgcaaaacccgggccgaacaagcccgccgggagagcgaacgatcgagggaactccacgactaccgcgcctcgcacggcggcagctgcttcgccggcaactggcaactggagcaggcagaatgacgggctcaaccaagacacccgaacacgcggactcgtgcccaatccatgagtccatgcatggccgctcgccaggggaaggacgagaaatgaattatcaggaagacaagaacgccgaagcgccaggcatggggcctgatggaatggcatcagtccatgacgtcggcgcgtacgcccctcaaacggctggtcgtggcgatccaattcccgtcaccgtcgcgggtctcccacttgacggcgaagtattcctcaccggatactccaggagaggaagcgacggaagggcattgtcccgccctgacggacatcccgccaggtttggctgtatttcgtcaagtcggtgtttcgtgtttagtcatgtatttttttcgggtttagccgacagggtgtgggagagtagcacgccgccgcaccacacgtacaggaagccccttggagcacacgccccaaggggctttcgcatacccgaaacactcacgacccaaacccacacacccccacaaaaacacccggggcttctcgcactcatgagacccacgtccgggaccattcccggccggccccgccgtcggggccgaagagagacggcgcggcgcgttcccatttccgcaggaaatccggaaaacagcacgtccgtgaccgtggaatcccgacgcccgggcctcctccccccggtctgctgtgcggacggctccccccccctgaggggagccagaaactggcttggttatggggtcgctctacactggcttctgctatgcattacttcacccctaaacgttgcgctacgtcgaataaaatcatgtatcacgataaggcgcaggttcagcgtgccgctgatcaaagcctaatcgagcgcggagttgagctatgggtgtaccgttgcgaattttgcggatgctggcatctcacgcatcgcgatccgcaatccagttaccggcatgtaccgctgaaccagcaactcaagccacacagtcgtaaaaagggctacaagccacgtagacgttagcgtcagaagctccacaggcctcgccaacgccgtgtctgagacaggttacggtccaaacacgtcaggtcgtaggctgctaagcgttcagggcgctcggacacacttcgtccaacacttacatcaccttggtgttttcaaggttgcggataacccaatcgttgaagcgaattaccggcttgcgcaacataagtcccaacagcaatgaggggacaaggaacagtgccagtttgcccatggaaacccagtattccatgccgaatgagcctgccatggccgaatgcatcgcatccaccgcataggggaacagtagccatttagaaacgacctggaagaacgtcggcagtgtttcaatggggaatgtgccgccggaaccggctacctgcataaccagcagtactacggcaatggctttgccgatatcaccgaacgacagggtcagcgtatacacaatattcgagaacaccagtgcagacaaccacccgaccatcaagaactgaatcggatgctcacactgcacgccgagatagaacatatcgcccaggcacaccagcgtaccttgcagcaaagcaaggaaaccgaaaatcatgtatcggccgaaatattcgtggtgcaagcgtaaaccgaactgccgcgcattgccgggagcctcggcacgcggcttcttcagcacatccaacgcggcggccggtccggcaatccgcccggcaatcatggcctcgcgaagacccacttccgaaccgagcggcagatcattgcccaaccctaagatacgagccttctcatggtcggaaatcgatactttcaacatggcgaccagaatgatcgcaccgacccaaatagacaaaatcgtgtagaacggagccatcgcggaaccatagttggcaacgggatagagcgcgatgcggtcgaccgctacgggtgccgccagcatggaagcaatggcatcgggcttcgcagaggaaatcacagacaggtcgatggtgccgccattggtgatagaggcgagttgggaagacaagttgtcgagtttcttcgccgaacgggtcaaagcgctagctgcgtcagttaaggccgactggatgtccgtcaggctgtctgaaacgccgccagaaagacctgacacgctgcttacggtcgatgcaagcccgtcgattacggaacttgcctgcgtggtcacttcgtccatggacgaggtcagattgttcagttgcggtttcagcgtgctcttgtacgtgtctgaagcctgagtaatcgattgtttggcggcagcgatttgtgatttcagatctcgacgcgctgtatcggcatcggcagtaccgtttgctatgtgcgtggccgcatcgcccaacgcggtggcggcttgctgcatgctctgctgcgcctttgtggcttggtctgcagccgcgttcagttgagcggcaacggtatctccgcccacgggcagtgaagccgcttgtttggcgagatctcgtaaagcggcggcatactttccaaagctgtcggcctgagcctccactttggattgcatatcggttagtttgtttgatatctgtgaggattgtgagcccacatcggcaaaagcggcatcgatttgcttggcaatggtgtcgtaggatgaaccggcctgctgcaatgccgtaccgacgccatcggtggctccggacaatgccttgtcgaggctggagacgccgttgcgggtctgtttcaacgcctttttggttgtggccgcagctgagcctgttgaccccagcagcttatcggtggaatcaatgatgctgttggcggccccgagcagattggcataggaatccatctgcgacgcagtgccggtcaaacgagacgacatggtggcaatatgactggtggcgttgttgacgtactgctccatttgcgggctttgcgcgtaatcggccacgttggaaaccaaatccagcgccacgctcgccaaggtcttcacgaatgtctggtcgatggtcgtggccacggtggtagcaccctggtcggtgatatgcggagcgatcggattgattttctcattgagatagtattcgagcttggcgtgcttgatcttcggtgaaaacagcgtcatcatatcggagctgaagctctttggaataatcagcgcggcatagtattcgcctgagttcacgccatcgatggccttagcacgatccacaaactgccagtcaaggtcatgattggccctgagcgtattggtcacggtttcgccgacgttgatggtgatcggcatcagatcggacttatagcccttatccacgttcgccacagcgaccttcaaggccttggtgttgccgtacgggtcccagctggcggcgatgttgtaccaggcgtacagtgccggcacaatcgccaatcccatagccacgattacggcgatcacattgcgggtggcttggcgcacgtcacgtacgaatattttccagataagcttcatcgtgcgcctccctgcccaggctgcccggactgaccggactgtgcggtgtgcgcagtcggctcggtggcctgatcactgaacggtgtgagtcgttcagtggtttcgccgatattcggattgctgtccatcgccgcttcgtgacgtccgtggccgtggaaacgccgccacacatatccgttgagcatcacattgcggaactcgtcggcactcatggcgctgacgccaagctgcatggcgtaggcttcgcgtgcgtattcaaccacaatgagataggcgtcgataagaataatcgacagaatccaagaggtcagcatggcgattttctcttgggtgacgaacagcagcaccaggaatacgaacgggagtacggtcagcaatgccagaccggcaacgatcatctttggataccgtgcgaagaaccggtgcgcgcgatgggcgatgatatcgcgcagttccttgctgtcggacaccgtgcggaatacggagttcaagctcacctgttcgttcaccatgctgttgtgctcggtgatcatcaggtcggtatctcccaaacgacggtcgaacagcgcgttcaggttcatcgcataccggcgtatgacaagtcccacgaagagtgccgccggcagataccagaacaggtgcagcatgtcgagccagtaatggttcgcgtacaggccggcaatcgggccgcgcatcgcgttgatgccgtaggtaaagggcagccacgggtgcagttcgcggaagaagttcggcatcatttcaatcggatacaggccggaggcgccgggtatctgcacaatgaccagaattacggcgatggctttgccgatatggcggaacgccacggccagtgcgtaaataatgttgatgtatacgaacgaacagaagatcccggccaagatgaacagcagcggatgctcgcattggatgccaagcaccagatcgccgatggtggcgatgacggcttgcaggaatccgatggtgaccagcagcagccagcggccaagatatgcttgcgtagcggtgatacggcgaatgccctcgcggtcgacctcaagcttgtagatggcgattagcacgaaaccgcctacccacagtgccagattcgtgtagaacggggtgactgcggacccgtaattgtcggtggcatacacgactttcgtggtcagggtgacgggattgcccatgaagtcgccgaatcccttgtcatccagatgcagcgtatcccggattatctggtaagcggcggaactatcgagcgtggcgatatcggtgcgtacggtggcgacatcgctggccacctggcgcagcgaatcctgcgtgctgctgatggtggtttttgtttggttcagggtatcgacaagctggtcgaacagcccgtcggcctgatccaaggtgccggacaacgaagtcaacgtgccatccagcgtgccgttcagggcggcgaaactgttcaatgatgaggtgagcgacggcatcacggtgccggtcagcgagccgcgcgcggtattcagcgccgcgatgccgccggtggtggtgttggtcatggctccggaaaggttcgtggtggcgtctttgccggagttgatgaactgtgtggtgtcggtatggaaggtgttgagctgtgtctgctgtttgctgatcaatgagtcgagcgcatcgatttgtttccagatgttctggccgaccgggtcggtggtgtctttgccgatgccggctttggtcagcgcgtctttcagatcgctgattgacgtttgggtggcgttcagtggggccgaaagtgtgttggtgatggtgtcgacggagttctgcgcgctgttgaaggaaccggtgatgctgccggcggcgttgttgacgtggacggccagtccggagagttgtgctgaactgctgtcgagcgcgccgaccagtgtggtggagaaggcttgtgacccggcctgtgtttccgccaacagtatgccggactggcgggaggcattctgcgcggccgcgacggtctgcttgagtgaggcggtggtctgtttggcgtcggcgagaatcgtgtctgattgggccagcgtgtcctgtaagtcggtgagtgaatcctgaacggtgttcagcgtggacatcaccgtattgagatcatcgatcgtatcgtgctggactttgccggtgacttggtcgagatcgtctcccgcttcggaaacggccgaggcaacggtggcggctaccgtggtgacgaaggcggagttgatctgctcatcgatggtggtggcgccggtgtcggtgattttcggcgcgatcgcgttcttcttctcgttgacgtaatacttgattttcggctgtttggaggttccggtcaccgattcgaccaagctggcgctgaaatccttgggcagcacgatggctgcatagtatccgccggtctccacgccgtggacggcctgttcctcattgtctacgaagcgccagccgagttcgtcgttctgcttgagtttcttgacgacctgccggcccgcatcgagatggccgaccagatcgttggtggtgccttggtcttcattggctacggccacttgcagattgccggtggctgaatagggatcccagttggcgagaatgttgaaccatgcgtacagcgagggcagcattgctacgccgagcgtcaccacaacggcaacgggattgcgtaagatacgtctgcaatcgcgtagaaagacttgccaaactgtccgcatccagtccctcttttccggttcgtagtcattgcggccacatgcagtctattcccaccactggtgcgaatactgctggtttggcgggttttcttgcaaaactggccgttggttgtccgcataatgggactgatatgtgaacgtttgttgatggtgcggcaccggcgggatggttgtgcaattttgccggtatccggtgatgaaatgttgaggtgttggaactgagtcgtcgcagtgctgagaccgagacgactcagtgacgagcctatccgaggctatctcgttggttctggtctcactgatccagacggaagccctgagcggcggccttgtcgagcagtgtctgatggctgacatcctgccgactgatcgtggcgacctgatcgctgaaagcgtccaccggacggtcggcttggcgcagatcgtagtaccggtgaacttcctcgtcgaaggcgggcagctggtcgagtacgccatcggcgtcagccgggtaggtgttctcgaagaactgcatcgtgcgcggcatgcgcggcttgacggtcgggttctgatcgggcttgccgatggccagacccagcaccggatacgtgtattccggcagattcagcacgtcgataaggccggggatgttgttgagcagagagccgagaatcacgcagcccagtcccagcgaataggcggcggtctccatggcgtgcagggccagcactgcgtcgttctgagcttgggtgaagcgatagctgtacttgagatggaattcgtcggaagcgggatcgatacccttgcgttcggcgatgcgtgcgttgcggtgctcgtcgatgacgaacacgtacagcaacggcgcggtggcgatatacggctgatggccgaattcggcgagcttggctttggtggccgggtcggtgatacggatggcggaccagtcgttaaggaactggctggacgcggcatgttgggcgacggtttcgagcgtggcgcgggtatcgtcgtcgatggcctcgtccttgaacttacggatggagcggcggcccagaagagcctcgattgttgcgttggtaaccatggctttattgtcgcacggcagacgccggacgtcacggtggattacctcacagtgaaatgccgatattgtgtggcggaactgtgctggactgatggttcctgtcgattgactgatggttccttgacgaaattccagcgatgagtcatcagtcagccaacagaaaccatcatccaaccgggggattagcggctgggcttgcgatggcggtggtcgacgaacgccttggagccccgatccgacagctgcgaaaccactgcgccgagtgcggccgaaacggcggcgaatgccagactcattgccagactttgcggcgcgtctgccgccagtcccttgcgcagattgcgtttgcttgtgcccttgtcccatatcatctggaatgctttgccggcaaccaagcctgccagcgctgggactgccgacttgatgagcttgtcgcccagagaatcagggtcgttgagccggtcctcgcgcagcctgttgaccttctcgtcgatgcggtgcaggctgtcgaccgcgcggtcggcgctggaggggaagtcggtgttcgtttcgtcgctcatgactctcagtctaatagcatctcaatcatctcagcgcaaaagatgggcgttaatggtggagtcatgaacgagcgcagactagagtggaggcatgagcgaacagaacgtgaacggcaccgttgccgtcgagaactctcgtggcggcaacggatttttggtgttgctgcgccacggccagaccgtgtggagcgaatccgggcagcataccgggcgcacggacatcccgttgaccgcggtcggcgagcagcaggcagcggatgccggaaggcgcctgcgcgaggccttccccgaaggattcagccagagctgtgtgttttccagtccgctgaagcgggcgtgccaaaccgctgaactggccggttttgcggaccacggtgtgttggacggcatcgctgaatgggattacggccgagccgaggggcgtacgcgccagcaggtgagtgaggccagcggttttgaatgggatgtgtggcgtgacgggccgcgctcgctgacgcccacgctggagggcgactgggtcgagaccttaccttcgggcgagcaggtgccggtccatgccgggcctggcgagacgctggaagaagcagcggtacgcgccaagagcgccatcgacgagattacgccgctgctgaaagacggccataatgtgctgttggtggctcatgcgcacatcctgcgcatcctcacctcgcaatggctgggcgtggacccgcatttcgcacggttgctgcgtttggatacggcgcactactcggtgctcagcgtctataagggagataacgtcatcgaacggtggaacgcctagccccggttgcgctgcgattgcgctggcctgcccgctactgcgggcgggcctttattgtttgtggcgggaattgcggtatgtcgataaatgatttgcaaacgatagcgtcggcgtgttgttttttttgatgggtataagtggcaatcgattgccatgaaagatatgttagcgctctcatgattgcgaacgcttgcattgcgataatgaggcaaaaatgactgaattaatgggatatttgttgacaatggcctgaaaatgatgatttatgacgcgctgatattgctatcgtttgcaaaaagaagcaaaccgttgcacaatagtgcatgtcgatagtcgtaaaggtgcgtgctagcgtacctgtcctgaccggggacggccgggtcgacgatgaaagagaaaggttcgatgatgaatcgtacagtcaagtcagcagtcgcgatggcggccatcgctgcaatgtccctcggaacccttgccgcttgtggaagctccacttccggcgacgactccaagggcaaggtctactacctgaatttcaagccggaagcggctgatcagtggaccgctctggccaaggaatacaccaaggaaaagggcgttgaggtcaaggtgcagaccgcggcctccggtacctacgagcagaccctgaagtccgaaatcgccaaaaccgaagccccgaccttgttccaggtcaacggcccggtcggctaccagaactggaagaagtacaccgccgatatgtccaatacggatgtgtacaaggagctcgccaaccaggacgtggccctgaaagacggcgacaaggtggtcggtgtgccgtacgtgatggaaacctacggcctgatctacaacaaggacatccttaacaaatacttcgcgctggatggtgccaaagccacgtccatggacgaaatcgacaacttcgacaccctgaaggccgtggccgacgacatgcaggcccgcaaggacgagctcggcatcaagggcgcgttcacctccgccggcttcgactccagctccgactggcgcttcaagacccacctggccaatctgccgctttactacgagttcaaggatgacaacgtcaccgagcagccggccaagatcaagggcacctacctgccgaactacaagaagatcttcgacctgtacatcaccgactccaccaccgaccccacccagctgagcgccaagaccggagatgatgcgaactccgagttcgcgctcggcgaggccgccttctaccagaacggtacctgggcctggaccgacctgcagaaggccggcatgaaggccgaatccgtgggcatgatgccaatctacaccggtgtcaagggtgaagagaagcagggcttggccactggttccgagaactactggtgcatcaacgacaaggcctccgacgccgacaagaaggccaccgaggacttcctgtcttgggtgatcacctccgacaccggcaagaaggccatctctcaggacatgggcttcaccaccccgttcaagaccttcgatgatgtcaagtttgacaacccgctgactgaagccgctgttgaggatcagaagtccggcaagacccaggtttcttggaacttcaccatgatgccgtccgaagagtggaagaacaaggtcggccaggcactgctcgagtacgcgcagggcaccggcaagtgggatgccgtcaagaccgccttcgtggacggttgggcttccgaatacgaggcttcgcactgagtctcatagagtcccatagccgataagcaacaatccgcggcgcccctgccatttccttctccgggggcgccgctttgtattgctgagtctcgcacaaaatcgtccgccgcagaaaagtgtgaggcacgcacccgctcaatcgcacgctgtggggccatgaatcggcgatttttcgccattctccacaatgtgcgattgagcgttattgtgcggttgcctcacactttttctatggtgggctttgttgtgtgagcctacttaacgcgggaggtggaggagcggaccttcagctgggccgggaacacgatgtagggttgctcaatcggcttttcgtcaatgagatcgagcgtcatgcgggctgccacgcgggccatttccaccggatcctggcggatggtggtcaggccgatatcgccggtgtagaaactatcgtcgtagccgatcaacgagacgtcgccgggcacggagaatccattgcgctccagctggaacataagcggcaaagcaatgccatcctcttggcatgcgatggcggtgggcatctcgtcttggcttatgagttggttgaccacgtcgctgatttcataacgtccatcgtcatcgaccttgcagacgataacctgcggctcgatgccttccctgcggcagcaggcggtgaatgagtcgaatcggctttgcacggagaagctcagcgacacctcgcgattggtgctgatgtaggtgatgcggcgatgtccgagattgataagatggcgggcggccagcgtggagccctgcacatcgtcgatattgacggcggcggtaaagccgcgggcttcgggttcgactgaattgatgccgacgatcggcacgccgaccgaagccagttgcgcgatttcgttgttgtcgatatcgaaagacgccacaatcacggcatcggcgttacggcgtaccggcaacatctcgaagaattccttgcgctcctcgatgctggaaatctggaataccgaaatatcgtagccctgcgtgtgcagcacctcgttgagcccctcgatgaccgaggcggtgaaccacaggcggatatggccgctcatcagtactgcgatgcgcagggagcggccggatttcagggccgcagccgagcgggagagtgagaaattgagtttgtcggcgatggcgagcacgcgctcgcgggtcttggccgacaccagatccggcctggtgaaggaacgtgagacggtggagatggagacgccggcctcgcgggcgacatcctgaatgctcgtagccattgcagcccccttgcgttgaatggaaaatcgcaatacacatgcacaactgactccagtgtacatgctgattgattgatctgcggcgatgacaacgattgtattacaaacgtttgcaaagtgtctatgttggcgttagattggctttatatagccattatcttaggtgaaagaagattgctggagccggagtgtgctcgaacttgaaacgcctaaaatgacaacgtttgacatataatgattcgacgtttactatgaacataggcttgaacgagaacaggccgtgcatgcggttctcgatcggcaagctcgcattgagttgaactccgcagccggcgcacgatgcagtgtcacaacgcagcggactcaaggaggaggaaaagtcatgatcagcatggctggcaaggcgatacgcagatggtgggcgctgttcgcgctccccacattcgccgcattcatcatcgggttcctggtgcccttcatcatgggcgtctacttaagcttctgcgaattcaccaccgttaccgacggtgaatgggtggggcttaagaactatggcaaagcgttgaaagacaaggaattcctgcacgcgctcggcttctccaccgcgttcaccatcgtgaccaccatcgtgatcaacgtgatcgccttcgccatcgcctacatgctgaccaaggcgatcaagggctccacgctgttccgctcggtattcttcatgccgaaccttatcggcggcatcatcctgggctacatctggctgctgctcctgaacggcgtactagcccactggggccgcgccctgacctataaggcgtcctacgggttctggggcttggtcatcctggtgtgctggcagcagatcggctacatgatgatcatctacatcgccggcctgcaagccctgcccaccgatgtgctggaggccgcggccgtggacggcgccaacggacggcagaccatgttccgcatcatcatcccgctgatgatgccgtccatcaccgtgtgctccttcctgaccgtgaccaacggtttcaagctctacgatcagaacctcgcattgaccaacggtgcgccgagcaacatgtctgaaggtctggcgctgaacatcacccgcaccttctacggccgtatgggctgggaaggcgtcggccaggcgaaggccgtgctgttcttcatcctggtcgcggtcatcgccctgattcagaacaagctcaccacgagcaaggaggtggcagcctgatgaacgagaacaagcctgtgaagcatggcgcattatggaccgtgctgtttgccgttgtctccctgttctggattttcccgatcgtcctggtgctgatcaactccttcaagcagaaggcgtacatctccaagaacgcgttctccctgcctgccggcaaggcgttcgtgggacttgagaactatgtgcgcggcatcgagaccacgcagttcttcgcctccttcggctggacgttgcttatcaccgtcggctcggtggcgctgattctggtgtgcacctcgatgtgcgcatggtggatcgtgcgcgtgaacaactgggccgcgaagctgctctacaccctgttcctgttcaatatgatcgtgccgttccagatggtgatgttcaccctctccaagatcgccgacatgctgaagctcaataccccgtggggcctgtgcatcgtgtacctcggtttcggtgccggtctggccgtgttcatcttcactggcgtgatcaagggcatcccgcaggagcttgaggagtccgccatgatcgacggcgcgtcagtgccgcgcatcttcttccagatcgtggtgccgattatgaagccgtcgatcgtctcggtggccatcctcgaagccatgtggatctggaacgactacctgctgccgtacctgacgctcgacctcggcaagtacaagaccgtctcggtcgccgtgcaatacctcaagggcggctacggttccgtggatatgggcgccatgatggcctgcctggtgctggccatcatccccatcatcgtcttctacttggtatgccagaagtatatagtctctggtgtcatggcgggcgcggtcaagggttgagcccgacaatttggctcccctccctgaggggagccaaaagctgtacaaggagtagttgatgaactggctggcaccggactcgaaattcatgcgcgcgtggagcaatcttgttgacggcgtatggatcaacattctgatgctggtcacttcgattccgatcatcaccatcggtgcggccctgactgccggccatgatgcttgccgccgctccatcgagggcgagggcaaaggcgtaacctccaactacttcaagtcattcaaaaccaacttcatcaaagccacactgctgtggctgccgttcttggtggcgctgattgcactggtctggtcatggatcgtcctgcagatcacgccgctgctcatcatcaaattcgcgctgaccatcctctggcttatcggtttcgaatgggtgttcgcgcttcaggcacgcttcgagaacaccgtggccggcaccttgaagaacgccttcatcttcggcatctcccacatcgcgatgaccgtggccctggtcatcgtggatgccgtgttcgtggcactgctggcggccagctggttccacatgcccggtggactgttcctgctggtgatccttggttacggcaccatgctgatgctccatatccccgtcgccgagcgtgtcttcaagccatatctcattgactaggcgggttctcacgaatatgcggcgatcttcgaggtctgagcgctctctgtccacgcaagcgcggtaaagataacaaattaataacagtttggggcggctggcggagcggggtgccgattgaggggtattagtgattggcttggaagggggcttttggcatacggggagtgttcgggctgggcggttgccccccgtaagtgcttatatacataaggaatctggcacactgagtctcagtgccgtaatggtatcatcgcaaataatgtttgcgttcacgtagaggcgaacgagacactcgacaagtgggtcgaggcaaaggacaaggagagatgcggtgaagcattggaagaagatggcagcatcgttgattgcaatatcaacgatggtggcagtagttccgacgacgtatgccatggaatcggaagattcccaaccacagacaaccgataccgcgacagtgcagactactaaggctgctgaaccgacgctgctcgccagctgggacttcacgggcaaaaacggcaccacgaacagcgcgattgccgattcgaccggcaagtacaacctgacgctgaaggacggcgccaagatcgaacagtacggtgaccgcagcaacaacgaggcgctctcactgcgcggcgatggccagtacgcccagatcgatgaccagctgttcaaggatgcgggcgactccttcactctggagttcgcgtccaagactcgtcacgacgacagcggcaagttcttctcgttcatcgtcggcaaggacggctcgaacgacgccaacaccaccgatcaggccaacgccaacaagtacctgatgttctacaacagcaagaccgccatcaagggcgttatctccaacaacaactggggtaacgaacagggatccaaggtcaccgtttccggcaacgacaacagctgggccgattacaagattgtcgtggacggcaccaaccttgccgtgttccgcaacaatgccctgatcattttcaaggccaacaccggcatcaagatgagcgatctcggcgcgaccaccgcctacatcggcaagtcgttctactccgtcgatgagtactggaatggtgcaatggatgacatcaaggtctacaggggcgctgacctgaccatgccgaccgccgttgcgatttccggcaccggtgtggtgaacaacaagctcaccctgattgagaaggactccaccaagctcaccgccaccgtcactccggacgacgccgtgagcaagaacgtcacctggtcctcctccgatgagtccgtggccaaggtcgccgcagacggtactgtaaccggcgtcaaggctggtactgccaccatcaccgccaccactgagctgggtggtgtgaaggccgaactgcccgtcaccgttgagccgatgaacgcccagaacgccgccgcagccgacctcgatgccgcgattgctgcgctgaaagttccggcggccgagaatctgccgctagtcgccaagggcaccaagaacggctcggcgattacgtggaagtcctcggacgagaagctcattacgtccactaacgagaagtacgaaaacaagaccactggtgccgatgacccgtatcgtggtgctggcatcatcaatcgtccggcctacggcgacggtgattccaagccggttacgctgaccgccaccgcttcctacaacggcggtgagaaggtcaccaagaccatcgaggtcactgtcaaggagaagacccgcatcgcgcctgacaccggctatgcggccgtcacttttgagagcgacagcaacggtggagaaaaggcctgggtggcttccactgagaagaacgatttcttcacgtttaagactcgcaacaatggccaggcggtacttaccaatgatgcagacacgggtggcttgcgtgacatgttcgtgctgcgttcccacgaaggcgacaagtactacctgattgccactgatctcaaggtctcgtcaatgggctggagccagaaccaggttaacggttctcggaaagttgaggtctacgagtccaccgatatgatgaactggacccgtaccaacggcgacggcaacggcggcatcaccatcaacacgccgaacgccggtatgacctgggcgccggaagcttactgggatgatgacctgaacgcttacgtggtgttcttctcttcccgcatgttcactgatgacacccgtaccactccggtcaagaacgacaaaaccggcaatagctcctatgctcaggtgcgttacgccatcacccgcgacttcgtgaacttcaccgagccgcagatgtggcaggacaccggctactcgcgcattgattccaccgtgcgtaagatcggtggctactactaccgattcaccaagaatgagcagggcggtgccgctggcgattacatcaccactggtaagagcatcttccttgagcgttccaaggtgctgactgcaccgaccaccgaggcatctccgggtcaggacccgaacaccggttggcagctgctcgagcaggcgttgctgccgttcgaaggaccagagaccatcaagctcaacaaggatgacgaactcaacacgaaggacgacgacggctacattctgctgtccgacaacttcgcctaccgtgcatttatgaccacgggtgccgagctttccaagaccacgtgggacaacccgatgaccaagcgttacccggacttcaacaacgaaaagaagccggtcaaagccgagccgggcgctcagggctacatcactcagggtgctaacggcggtctgccggacaaggtgcgtcacggtgcgttcgtgaacgtgcctgagtctgtgctcaaggtgacgaagtcctggaccgctgccaacccgacgcacatcgaggctgttgactccaccaccaaggccgagtacaacgccggcacccgcgagctcaccgccacggtgaccgccgccgataagggcacgctcgccggttcggtgaagttctctgctggcgactggtccaagaccgtgaagctcgacgccgaaggcaaggccactgtgaccctcccggccagcgtctctggcactgttgcggttgcttacgacggctacaccgatggtttggtcaatccatccgatactacggttgacggcattgaacagggcaaggtcgatttggttgagctcaacaagcagatcgccgctgccgaagcgctcaaggaatccgattacacggctgattcctgggctgcgctcgccaaggcactgcaggccgccaaggctgcgctcgcttcctccgaccaggctgtggttgacaaggccgccgctgatctgagcgccgccatcgcagcattgcagaaggcggaaacgcccaccaagccggataccggcgatggtggcaacaagggcgataacgcaggcgacaagaccgatgacaccaagtctgacggcaagttgccggccaccggtgccgccgtatatggcgtgagcggtgccatggtgctgctcgccgctgccggcattgcgttgtccatctggcgcaagcgccgcgcataactgagtagctgctcactgcaacgcacagaaaatcgcacagtatatatgtgattttctgtgcgttttaatgtataacagcacatgcgtcattttttattgtattggtgtggtcatgctaaatgtatgtgctgtagagcctgtgtaccgtaccagtgaacgctaacactaaacttataagtgcttgcatttgggcgtgctatagcgcatcggtgttgtccccggaaaacggcgttgttcgtaggggcggattggtgggcaagtgcagtcaaatgtaatgcgaatcggcaaacgaggaagtgctgattcgtacaaggagacgcaaaagtggccgataaaggagcggccaagcgccatagcgataacaatttgataacaatctagcaaggatgcgaggaaggaaactcggtgaggagagttactcgattggcggcctgcttggctgcggtatcaacgctgagcgtgggactggttacgccggtcaccgcgttggctgacgatacgacacctcaggtgcagcaatccgttcagacgagcgatgctcaggctgctgcggctgtagacccgcttgccggcttcgatttcaatagcgacccggacgatggtgcattcgccagtgctcagggtaacgctaaggccaccgtgcaaggcacggtggatctcgtcaacggaaaagatgacgacaacggcaaggccgcccagctcggcagcggtttctggctgaacgtgaccaagtccgatggcagtgcactgctcaacggtcttgatgatgtgacgatcagctacgacagcaaggcggctgcgaccggtggccagtggactgtgtttgccgcgccgaccgccggtgcggtgaacggcagcgcccccacctacgtcggtgtgctcgaccgcaccgacaagacccgcgtggaacgctatctcaacggccgcgcatccgacatcgccaccatcgacaagaacaccggtacgaaggatgcttggaagcatgtcgatctcgtcatctccggcaagaccgcgaagctctatgtcgataagaagttcgtggcgagcaacgtgaacggcgaggatcttaagagtattcttggcggctcaggtggtgtgctgcaaatcggcaaaggcaactggggcaacggtgaatacttcaccggtttgctcgacaatctcacgatttatggctccgcgctttccgcagccgatctcggcatcgcatcgcctactgcaatcgagatttccggttccaatgtgaaggacggcaagctgagtctcaaggaaggcaactccgcatccctgtccgcaaccgtcacccctgaaggtgccgatcccacagtgacgtgggaatccaacaatcctgctgtggctactgtggatgccaacggcaaggtcaccggcgtgaaggccggcaccgccaccattacagcggcttccgaagctgacgccgccaagaccgccgagctcaaggtcaccgtcaccgaggtcaaggccgatgacgcctacggctacgtgatggtccacttcatcgaaaacaacaagggctacgccgagaagatctacctcgacatctcacgcggtgatgacgccacccagtgggacacgctcaacggcggcgagccgattctggtgagcaacgaatccaccaccggcgtgcgcgatccgttcatcgcctacaaccccgagtcgaagacctactacgtgctggccaccgatttgcgtgtgttcggcgcggacaacgccgagtgggccgcatggaccactgattacagcaccaagctgcatgtgtggtcgtccaaggatctcattcacttcagcgacatgaacgagcttgagaccgccaccgcagacacgtacaccgccaatccgaccaagagccagacgctcaccgattccgtgaccggcaagaccgtatccggcatcggcatggcgtgggctcccgaggctacgtgggtgccggacttctacgatctcaacgacgacggtgaactcaacggttccgacaagggcaatcctgagaaccagcagggcggtgcatttgtgctgtactggtctgtacaggccaagtatgatggcggcgaccgtgccgaagcctgcaagcatgtgttgtgggcggccaccaaggacttcaccaacgagacttacatgtttggcggcgtcttcgtgcctaacagcaagtacaaccgtggcaacaccatcgacaccacgatgctgcagaacggttcccgcacataccgcaccaccggttccggcgtgatcttcatggaatacaccgatcgtgccgattggtggcgtgccaacgaccagggccagtacgcgaccgacccggccaagggctgggtgttgcgccagaccaacatcggacacacgctcggcagcgcgcaggaaggtgccaacggtttcaaggtcaacggcgaaaacaagtggtacatgttcgtcgacaactatggatctgtcgcctccggtgcccgctacggctacaacctactcgaagccgacaacctcgattccgagaatccgtggagcgtcctgaaggccgacgattacttcctcaccgccaacaccaagcacggtggcgtggtctcgctcaccaaggcccagtacgacgcgatccgcgcggctgacgccaaggcttccgacaacgccgacctgaaggccgaggatgtgacggtggataagggtgctgccgatacggacatcactgccaagctgccgaagacgcagcaggtcactcttgccaacggttacggcactgccaagcgcgacgtgacgtgggacgtttccaacgtcgacacctccaagcccggcgaatacaccgtcaccggcacggtcgacaccatcggtgccaacgagaaccattggaagtggacgaacgccgccggcgagtcgaagaccgacgaggacgacctcatcaacaccggtgcgaacgcgaacaacaactggaagcagaccggtggctttgtggacaacgaaaccgccaacaagaaccgcacgctatacagctccaccgccatcaccgtgaccgccaaggtgaccgtgaccggcgaaaccgagccgaccgacccggatctgctcgccgacttcaccttcgagaacgccggcgagaccttcgacggcggcaatgcgacgggcaccacgcagggcaccgccacgctcgccgacggcaaggacggcaaggccgcgaagctcagcaagaacttctggctcaacgtcaccgccaagaacggcgacgctctgctcaagggcaagaacgacgtgaccatcagctacgacgtcaagcccgatgcctccggcaacactggctggaccttcttcgccgcctccaacgccaccaagcaggagtacggcaaggaacactacgtcggcgtgctcgacaagaccaccggtattaccgtcgaacgctacaacaacaacgacggcaagcgcgattcctccggcaacgtctcatacaccaagacgaacgccgactggaagcacgtcgatatcgtgatttccggcgcaaccgccaagctgtacatcgactccaagctggtagccgtgaacaacaacggccagaagctcgccgacatcctcggtgctgatggcggcgtgctgcagatcggcaaggccaactggagcaacggcgagtacttctccggtctgctcgacaacttcaagatctggggcaaggccctgagcgacgacgagcttggcgtggaaagcgcgaagaccgactacgccgccgcgctcgccatcccggcgcaaatcaccggcgacctgccgagcactgtgctgggcaagacggttacttggtccgcgaccggcgacggtgcgaagctcgtagccgcagacggcaaggtcacgcagccgaagtccggcgagaaggccgtgaaggtcaagctcaccgccaccatcgacggcgtggataaggccatcaccgccgaatccgaaatcctcaacaacggcggcgaaatcgcttcctacgtcaaggatgtcgatcgctccgaccagaacggtgccaagtacgacccgctcgcctacaacgacgatcgtcgcgccgactcgctgtacgtggccgccaaggccgccgatggcagcaaatgggagaccctgaaccgttcgcagtcgattctgtcggtcaagtgggacggctcgcagtctgccaagccgaatgcgcagatgggctcacccgctttcttccgtgcggaggacggtacccttggtgtggtttcctcgcagaacaacgccaccggtgcgatttacgtgtgggatggcaagggcgacggtgccacgttcaccaacgagcgcgccatcaccgtgaccgacaactccatcgtcaccaacccgcgcatcgtctatgatgccgcctccaagggctacaaagtcttctggaccgatggcctgagcggcgaaggccgtatggccacgctctccgacctgactgccaaagcaacggtcggcgagacgctcaaggccgacgcggttgcgatgggtgtgggcgacgtgaccgaaggtctgcccgcatgggccggcgaaggccagacccgcgcattcgctgtgagctcctctgaattcgatgcgttctacaagaactatgtcgatctgcaaaacaccggcgtcaaggctctgggcggcgcaaccgtggagaacggcgcttccgccgaggacgtcaccgcagcggtttccggaacgcaggccacaatgacctacaacgacggctccacgaagaccttcaacgtcgactggaacgccgatgatctggccgccgtggacacctcaaaggccggcacgtatgaggtcaagggcactgttcagcagaccaccgaggccatgtacaacgacgctcgcgccgatccggacatcttctacaacgaagacgatggctactactacctcaccggttccacctatgaggtgaagtccactgattcgaccaacaaccagaaggacggctaccgttccatcggtctcaagcgcgccaagaccatcaacggtctgaaggatgctgaggaacacatcatcatcaagccggagaacggcactccgggccacgaagaccagtaccccgactcgttctacggttggagcgcgttcatttgggcccaggagttccacaagatcaacggcaagtggtggattgtggccggcttccacaagggtgcctcgtccacgaacggtggctggtgcaacaacaccatcctcatcccgtacaccggcgacgagcagtccatcaaggatggcggattcctcgaggccgaaaactggggcgagccgaccgtgctggaaggcgccgcattcgacgtgacgtacttcgagcgcgaggagaacggcaaggcccaaggctactggctcttcccgaagagtgcaggcctgtaccttgccaaggcaaagatgggcgatggcgtcactccgctggtggatggcagccttgagcacatctatcaggccagccagcagttcgagtacggcaagtatgcgcctacccccggagacaactctgaaggttctgatcaggcaatcgtagaggcaccgttcatgttcgagcatggcgactacgtctacattgcctatgcgggtgccacggtggataagtattacaacaccaacgtgatgcgtgccgccaagaatgccgacctgcaggatctgtcgagctggaccacggccgacttcccgtcgttcgacaccaacgacacctacaccggtacctacggtgcggatgaggcctcgtacgagcgcaagcaggccggccccggccacatctcgcttgcacatgatgaggccggcaacatcgtcatggcctaccacgcacgcccctacccggaaattcactccggttccgcggcgggtggcctgttcgatcaggaccgcaatacgtggggcaaggccgtgaacgtgcgcgccaacggcatgctcgacatgtcgctgaccaaggatcaggaggtcgctccggccaaccgcacggtgaccattacggtgaccgtaggcgagcccgatacgccggttgagccgtccatcaccggcatccgcgtcaagagcgagccgacaaagaccaagtacacggtgggcgagcagttctccgccgatggtcttgtgatcgaggcgacgatgtccgacggcacggtgaagacgctcgatgctgccgactacacggtcggcgacgtggacatgtccgctgtgggcaccaagaccgtcaccgtcgcgctcaaggccaacgatcagctcaccacgtcgttcgtggtgaccgtgagtgccaagaccgagcccggtaagcccggttcgggcgacggttccggcgatggtgcaggcggcgataacggtaacgctggtacgggggcggactccggtctgccgtcctctggtgccgccgtgctagccctcggcgcagccatggtcgctctcaccgcagctggtgccggtctgggagtctggcgcaggcgcaaggactgagcaggcctagtctgcacaactcccctcagtccgcctcagatggactgaggggagcccaacaaacgtggtttcccaataaacacacttcacaactcaacaaccaactcagccacccccaccattcaatgaggagaaatatatgggcaagtggaagaaaacggtagcggcgatagcggcgctaccggtcatgattgcgggactggcctcaggtccagtcaccgcgatggcggcagacaacgacggaggtctgacggacgctaatctcgtcgcatcctacgattttgaggatgccaacgataaagggaaggacatctccggcaacaataacgacctgaccgtcaagggcgagaatgtcgaatacggcgtacccggagaccatcagtcaggcggcaacgccatccagttgcgaggcaacgatggtcaatacctcgaactgccgaacggtctgctcaatggcaccgactccttcaccgtgcagttcgactcgaagtcccgcatggctgcgaacgacaacttcttctcgttcaccataggctccgacaaccagaagtacttcttctcccgtctgcgcccaaccagcgtgtacactgccatcaccaaggactccaacggtaacgagcagggcgtgaccgctacgcagtccgcgaacgtgtggcacacgtaccgcatttccgtgagcccgaccttcatcgccacgttcatcgacggcaaccttgccgccatcaacaagaacgtgaccacgaagctctccgagctcggcaccgacctgccgatgaacttcggcaagtccacatgggccggcgacaagtactacaacggcggtcttgataacatcaagatttggaaggctgcctacgtttccgacggcatggtgtgggatggcgtgaccctgcccggctccaccgaaggcagcgtgactctgcctgccaaggatgcgctcggcaacacgatcacatggtcttcgtccaacaccgcagtgctcggcaacgacggcacactcgtcaaagccccggcccaagacaccgatgtgacgttcaccgccaagtccacggtcaacggcatcgaatacacgaagacattcacggtgaacgtggctgcggccatcaccgccgccgacgcagccgccgaacgactgctggtcgactaccagctcactgccggcgcaacgctgccgactgcaattgctgcggcccctgatgcgaaggtgacgtggaagtcctccgacacgagcctcgtcaaagacgatggcacagtcgttggcgcagacggcgacgctgagaagaccgtcgaccttactgcgacggttacgctcggcaccaccagcaccacaaagaagttcaccggcgtgcgcgttatgccgaagagcgcccagaagctctcctcctacactcgcgacaggtccatcaacggtggctcccgcgtgggcaatgccttgcatctggcgctgaacaacggcactacgaccactgcgctcaacaccaactacggtgtggcttttgccgaggcgaagatcaacgcaaccgcaaacactgaatccactgaagttcgtggtctcgtagacccgtacttgttccagttgaaggatggcaagtacgcctatgtggcagtgttcactgatgtgaacggcaatcgcgtagatggcggccaggttgctttctctacctccagcaatctgacggactggtccggcaagccgaatgaggacgagcgtggcgacatggttacggtcacctctgacgctactctgtttgatgccggttccatcgcagctggatacgacgcttccgcaggcgaataccgtatctcgtggaaggtgaacggcgttgccaagtacgtgacgaccaaggactttaagaccttctctgaagtcaagaacggcgtaggcttcgagcgcgcgcaagctgacttgaccggtatcgataatgcggttgctggtagcggcaacgccatcgcgcttaccaaggatgttgctgacagcctgaccgagaggcttggccgcgtgcacaacactggtgtggaagtcccgacagacatcaccgtgcaggccaacaagaccaccaaggatgacctgctcgcgcagatcaacggcggcgcagagctcgacaacggcaacctctccaagggtgccacggcaaccgccacttactccgatggctccaccttcgacttccgcgtcaactggaatcaggacgatctgaacaagatcgacctgaccgaggccggtacttacgaaatcagcggcaccatcaaccagcagaactactccgagcagttcccgatgatgagcaaccgcgccgatccgaacatcgtgtactacaacggtaagtactacgccatgggcacctccgacaccggcggtatgaagacactgttcatccgatcctccgatacgctcgccgggctgaaggatcagaaggccggcaccgcaactgaaggcggctacaaggtcgaaggtcaggatgtgtacctgtttggcgagaacgatggtttggggcacaagggttaccactgggcacctgagctgcacgttatcaacggcaagctatactgcttctacgctaccttcccggccggtaaggctggtgatgaaaacatcactaattctcccaactgggccggtccatctgcttacgtgatggagctcaaggatggcggcgatcccaccaagaccgccgactggcttgagcatcgcgtgcaggccaaggatggcggcgtgctgtccccgcacggtctgtccatcgacatgacctacttcgaggctggcggcaagtcgtacattgcttggagccaaggcgatcaggagcgtaagggtgccaaggccaacgtgtccattgccgaggtcaactcggacaagccgtggcaggccatcaccgagccgcagcgtctcatgcgccccgaatggggttgggagctggacggcgtgaatgagggcccgaacgtcctcgtctccggcggcaaggtgtacatggtgttctccgcgcagctggtcactccgcagtatgccaccggtatgctcatcgcaaatgtcggtgacgacttgaccgatccggccagctggacgaagtccaactacccgtggttgcacaacggtactttcgccggtcagtttggcttgggccacaactcctacttcactgacccgtacggtgatacgtacaacgtgtatcacgcgatgaccagtggcaccaacaacacggctcgccatgccggtgttgttccggtgcacttccgtgccgatggcacgccgattatcgacatgaccactagcgaggagctcgaccagtcgaagaaaaacgtgacgctgaaggtcgtggtgaccgaggaccaggtgtcttctgatgccacgctgaagtcgctgaacgttgtcggttccgatatcgacctcgacacggctgcctctactgagggtgccgcgcttgaagtcgacgatccgagcaaggtgaccgatgccgatgtgcaggctgtggcaaacgatgccaacgccaaggccactgtggccgtggcaaacaacgtggtgacggtgaccgtgaccacgcaggatggcacgaccgtcaaggtctacagggtcgtgctcaccaagaaggccgtcgctcctgaccctgaagacccgaccgatcctgattccggcaaggataacggtgacaagaacaccggcaaggatcctgacaagggcgacaacaagggcgacaagcccggcgctgacctgtccgagactggtgcagccgtgctcagccttggtggtgccgtggtggcgctcgccgtcgccggcatctccctcactatctggcgcaagcgccgcgcttgagcggattcaaatgcttcctctcagtcggcttctgacggacggagaggaagcacctagtatcaccataacttgaacaatttcaaaactgtgcctcataactggaggcgcaaccacaatcaaccctatcaatgaggagaaacatgagaaagctgatacgaaaggcaaccggacttacggtcggcgtggcaacactgctcgctggtctggtgctgccgatgacggccagtgccgagagcgcatcgccaatcgacgccagtccgatcatccactattcattcgataacgcactgacgtccaagaccatcgccaacgagggcagcgcggccaacagcgatgccaccctatccggcgacgccacggtggccaatggccagatcaacctgaccggctcgcaaaccattagcgtgccgaccacggccatcgccggtaagaaggacgttaccgtctccatctggctcaagaacaattacggcaacggcaataccgccgccgcgtacatcggcgcggccaagaccggcaattatccggccaacggctactggctgctcaacccggccaacccgagtggctacgcgaaatccgtaatgaccaatgccactgcggccgacccgaataacagcccgtggggcaccgaagtcggccctggatcgacgaacgccgccaccatcggcaccaaggccaccagcgatttggctctgtacaccaccgtcatcagcggcaccaacagcaccatgagcttctacctcaacggcaagcaggttggagacgccacctacaccattccggccggtggcctgaccaattacggcgacctcgtcgcctacattggcaagtcctcctacgctgacccgaactccaagctcgacgtggacgattacgccgtatacgacactgccatcagcgccgcagacgtgaccaagctgtatgacgctcaggtgctcgacaaggccgaggccgctgtcaaggccgctgtgcccgcatccgctaccgaggacttcgcgctgccgaccagcgccgctggcgtgagcattgcgtggaagtcgggcaacgcagccatcgccgttgacaacgctaccggcaaggccacagtcactcgtccggccgcaaccgcagctgatgccgaggtaaccctcaccgccacgttcggcaacaacgccaaaaccgccgcctacacggtcctcgtgccgaagcagttctccgatgccgagcaagccaaggccgaccttgacgccgtcaccatcgaggactccgacgacatccgtagcaacttctccgtgcccaccaagggcaacaatggttcgaccatctcgtgggaagtgaccggtgacaaggatatcgccacactaggcgaaggcgtgaacgacaaatctcgaacggtcactgttaagcgccctgccgccggaagcgatgccgccactgtgacgctcaaagccactgccaagtacggtaccgccaccgaaacgaagaccttcaccgtcaccattcagccgatgcctgccgccgaagagaaggacgaggcctacgtgtgggcgttcttcaccggcgagggcgtgggcggcgagaaaatcagcctcgcggcttccaagggcaacgatgcgctcgactggaacacgctgaacaatggcactccgctgttcacttccgagtttggcgagaagggtttgcgcgatccgttcatcatgaagtccaaggatggtgacaagttctacatgcttgctaccgatctgaagattgacggtcgtgcccccctcaacgggctgaatggctttgctggtgcacaggctaacggttccaagtacattgagatttggaagtccgacgatctggtcaactggtccaggcaaagccacgtcaaggtgagctctgattacgcaggcaacacttgggcgcctgaggcctactacgacgaggaaatcggcaagtacgtggtctattgggcctcgaacctgtacgacaacaccgacgagaacagccgcaagcagctgacctacaaccgcatggtgtacgtcaccaccgatgacttcgtcaacttctccgacccggtagtgtggattgacgttgatcgccgaggcggtgcaggcagtggatccatcgatgtgaccgtgcaaaaggtaggggatacctactaccgcatctacaaagatgaaaacacgatgtctttgcgtcaggagaagtccacagatttgactgccgcaattggtggcgccggcgtgaagaactacgccgatgcgcttaaggatagtgcatggagcgaagttgccacgaacatcggtaaaggccaggctaacggttacggtaaaaccttcacttccggcgaaggtccatcgctattcaaggccaacgatggcgatgtgaacggctaccagtactacctgttcgccgaccagccgagctatcatcaaggtccaaaccactatgtgccgatggcgactgaggatatcgccagcggtcagtggaccgttatcggcaataagatgcctgaggcgaacttcccgaccaactccgatggcggcaagccgcgccacggaaccgtgctgcccgtgacccgcgcccagtaccagaaggtgctggaggcatacgctccggctgtggctgtgaagtccgttgacgcgctgtctgccgagacgacggttggtgtggctccgacgctgccggagaccgcgcatctgactcatgcggacggttccgtttctgacgttgcagttgagtgggatgccattgacgcatcttcctacgccaagaccggcaccttcaccgtcaagggcatcgcccaagacgattcccgtatgccggtcgaggctaccgtcattgtgaacggcatcgacctctccaaggcgaccgtcaccgtcgaacccaacgagttcaccgcagacggcgctgccaaggagccggccgtgaccgttgtactcgatggcgcgacgctcaaggaaggcgccgactacacggtggcctatacgaacaacgtcgaacccggcaccgccacggtgaccgtgaccggcgttggcaagtactccggtactgtctcggcaacgttcaccatcaaggccgccgagcccggctccacgctggacaagtccaagttgcaggcgcttgtcgataaggtgaagggctataacaaggctgattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtccaagttgcaggcgcttgtcgataaggtgaagggctataacaaggctgattaccagtctggttgggatgccttcgccgccgcgctcgccaatgcgcagcaggtgttgcagaactccaccgaccagcaggaagtggacaaggcgctgtcgcagctccagtccgccgccgacaagctggtcaagaagtccggcgactccggcaagaccgacggcaaggacgacggtgcccaaaagcccgccaccaagccggacagcgctctgtccaacaccggcgcctcggtgttcggtgcgggtatcaccgcggtcacactgctcgccgccgccggcgccgcctacatcctccgcaagcgccaggcctgagctgcttgcagcgtagaccaagccccctctgacgggccgagccgtacagcaagcagcctactggattgttcgcttcatggcgcggtcccatcagagggggcgtattgcacgttcgtccgacgacgctgtcggacgcataggctctatggccccatagctccaatagccattaccgaacttcaccactcaatatctagatctgttgcgcggcaagcagtatcaccgcgcgcaagaaggagaagcaatgacaaccaaaccatcgataggcaagcgcctgctcggtgtgatgctggcagtgccgatggcgcttgccggcatgggaatcggtgcgaccacggcggtcgcggccgataccgttccgaccgataatctcatcgccgcctacgacttcaccacgaagccaagtgacggcaagaccgtggccaacagtgcgccgaacgctacgcttggcgcggccgaagtacagaactccgccgactcgctttgggccgatgatgccctcaccctttccggcggtgccaagaccggcaccggcgactgggtcaagttgccctcgaatctgctgtccggcaaggacgccgccacggtgcagttggaggtcaaagcggattccagcatgctcaatgctttccatttcctgtggaacatcggtaacgacagctccgatacggagtatttcttcgccacgctcaactgcggcagttcgcgtaacccgctcgtcggcctgaaatcgggcggtacggagacgctcgtgcagtccagctcctgcgtggccaaggccgaccaatggttgtcggtgaccgccaccattgatggcaccgccgcgaaactgtacatcgacggcacgcaggtggcatccggcaccgtgccggccaaactgtccagcgtcaaggaccagtcgctcaacaccatcggccgttcgccgtggcccgacaacctgttcaagggcgcggtctcgaacttccgcgtatacgatgccgcgctcaccgccgatcaggtcgccgcgatcagcactgccgatgcctcaattcatgccagtgaactcaccggttccgtgctgaacggcatcatcatccccacgacggtcgacgatccgttcatttcgctgcccactgcgaacggcgtgacgtgggcgtcctccgatagcagcgtcatcgcgactgacggcacagtcaaccagcccgccaagggcgaggcagccaagactgtcacgctgaccgccgccgtcacagtccgtggccagaccgctacgaaggaattcacggtcacggtcaacccgaccacgaaaactgccgctgaacagctcaaggaagccgcggccggctacgtgatcccgtccgtcgtgcgttccggagacgccctcccggcggctgtgaatggcactaccgccacggttacgtccactaaggacgtagccgtcgaggatggcaagatcaccatcgatggcgacgaggccacgaccggtaccatcaccgtcgagttctccaagaacggtctcgccggcatcgagcccattaccaaggccttcaccgtaaaggtgctgcccgccgcgaagtccgcgaccatcgccgcctacgatcgcaacgccaccggcgagaatgaggccaacaacggcgacgtcgcctacagcatgcacctcgcgttgcagaacgctgacggttcgtacaccccgtacaacgagaactatggtatcttcttcgcacgttcgccgaaggcgcagaagctcaacgagaaccttgacggcaatgactatcgcagtctcaaggatccgagcctgttccgcatggccgacggcacctatggtgtgatttccgtgcgcactaaccgtggcaccgccaccggtgattccaccgcgaagtccagcgtgctcatcgccacttccgaagacctgctcacctatagcgaacaggagaactccggttccatcatcgatcttggcgagaccaacggcgtcaacgctccgtacgccgtgtacgacaccgccgccaagcagtatgtcgtcggctgggccgatgacaacggcgtggccaagtacaccacgttcgattcgctcaagggctccacatccaagcacggtagcgtactgtacggttccgtcgccaagtccggcgtactcgccgccgacggtgtgcagggcatcgcgaacttccgctccggtgccaccatcgcggtggacgaggccacggtgaaggcgctcaacacccgttacggccgctctgagaacaccggcacgagcaatctcactgacatcaccgtcaagaagggcacctcaatcgatgaggtgaccgcgcaactgccgaagaacgtggacctcacttactccgacggttctaccggctccctgccgatttcctcatggaacactgagggcatagatctgacgaaggtgggtgattacactgtcaccggcaccgtcaagcagaccgaataccagattccgttcgccgaggaccgcgccgatccatcggtgtataagtggcagtggacgcatgaggtcgacggtaaggaagccaccgaaaccaagttcctgatgatcgcttccaacgacatccaaggtgacgtcacttggcagcatggttcgccccacatgccgttccgcatggccgacacgatttccggtctcgccgacgagccgggcaacccgaatgccctgattcagtcgaacggctacaacaacaaggaggtgtcgctgctcaaggctggcgacaaggactccgagggtaatgccatcatgcacagcttctgggctccagaaattcatgagatcgatggtaggctcacgattctgttcatggccggatacggcaacacatggtccaacggcaagtcggtgtacatgcagctcaagcaggatgtcgacggtcacgacctcgatccgaccgaccccgataactggactgtgccgacaccgatctaccgcaatgacgcctcgctgctcaacggtaacaagcagctcgcggccaccgcgtccggcggagtgggcatgtcgctcgacatgacctatttccaggatgccgacggcaggtcctactacgcctggcagcagctcggcgccacctacattgccaagatggacccgaaggacccggcccatgtgaccagctccccggtgcgcatcgtcaccccggagtacgcgtggaacgccgccatagccgaaggtccgaacgtgaccctgcgcgacggcaagctgtacctcatgttctccggttccggcgtaggcaagacctacaccaccggtttggccgtggctgatgccgccggctccgacctgaccgacccggccagctggacggcgctcaactacccgattcagaagtccggtccgttcaacggcgagatgcagcttggcaccggtcacggcatgtggagcgaggacgaggacggcaaccaggtctacgtgttccacgcctatgctacgaagaatctcggatccgtgaatgctaccggccgcgacatgttcgtgcgccgtgtgcactgggccgccgacggtatgccggtgtttgacatgagctcttccgaggagctggcctccaagaccgtttccgtgacagtgaaggtggctgacgacacggttacggtcgacaagaccgacctgtccaaggcgctcgcgtccgccaagcagctgcgcgagtccgactacaccgccgcctcgtggaaggcgttcgccgcagcgttggcctccgccgagaaggtttatgccgacgagaacgcttcgcagaaggacgtcgacgacgcaaccgccgcgttgaacaaggcgcaggccgcgttggtgaaggtcgacggttccgattcgggcgatggctcgagcgattcgactaagccgggcgacggctcgagcgttgacactggtgctgtggacgataagacgggtaacaaggtcggtctatccaagaccggtgcggccgtgctcggtctgagtggtgtggccgtggcgctcgctgccgccggcatcgccctgaccctccagcgcaagcgccagaggcgtttgtaggtgaacgaaggccgacagtcccacgggcggaaagtcggcctcagtccgtccgcaattgcggacggactgtcctcgtagcggactgagaggaaccctcctgcctgccaactaggggcacccatcctcaatatgggtggagacaccgcatctcatgaattcaacggtgtgacgttcgcgggagaggctttctctaactcctttccatatacgctggggaacggagataccgtaacctacacggactacggatatcgccacgcttccgataatcaaattggggcgtggaatggttatgcctcttgcggtactggggcttgcgcttcgctgaccaaggaatacggggacttgctgggaagcgcatggttcaacgaatcgaatggtgatgcttcgtgaaccattccgaactctgccggggagcgtgccggcattgtgctgacgcttaataatctgactccgggtgagcgttatgagattcagctctggaccaatgattgccgcatcgcgacgagtggcaagaactacaatcccggcaaaaccacgaatatcgccgatcttggtggcatggtgaagcttgaacagaacagtcaaaaagccgctggcggaaccggacaatacgtcactggcatgttcatcgcgtcgggaaccagcaagaccctcacgcttgcgggaagcaaccccgatgattcagccgatagccgggaagccatcttgcccgcgtaccagttgcggaagatcggcgctgacaagacggcgctaagcgatttggttgccaaggcagagggatcgaaggcatctgactatgaggcgacttcttgggagtcgttggaagcggcccttggtgcggtccgtacggttctgaacgatgacgcagctctgcagaaggatgtcgatgccgcagcccaacagttggagtcggccatgagtgccctgaagcctgctgagccagacgttcccactgagggttcccttgacgagtccaagttgcaggcgcttgtcgataaggtgaagggctataacaaggctgattaccagtctggttgggatgccttcgccgccgcgctcgccaatgcgcagcaggtgttgcagagctccgccgaccagcaggaagtggacggggagctgtccgcgcagcggactgaggggagctccctcgtcttgcacaaaaagtgaacgttaacactaaaattgtaagtacttacaactaaaaaaagcggccttgcatcgccccagtccctcaaaacggtgtcgttcgaggggcaaggcgtcgcatggccgtatgagaacacagttcgcgctgacaaacaaagcagctccattagtgcgaaaaaggtgcgaaacccgaccgataaaggagtggtcgattatcgcacgataacaatttgataacaaaatcgatgtttgtttcctgttcaggaagctgaacaccgttggtcaataacttcgatccataactcaacacaaaaccaaaacccacaatcagaggagacacatgggtaggtggaagaaagcggtggcagctcttgcagctgtcccgatgctgatggcgttggcgccagcagcgaatgcggttgaatcggataccaccgattcatcggccgcgcagcgggcgctggcagcagccctgaaatcaaatgccaaggcagcggcagacagtgatctgctcgccagtcttgatttcgataacgtcgctgcaggcgctactggcactattgtcgatgacaccaccggcaccaaggcgaccatcaacggtgctgccgcagtgactgccagcaaggacggcactgctgcagttcagctcggttctggattctggctgaatgtgactaagtcggacgattctgccgtgctcaagggccaggatgcggtcacgatttcgtacgattccaagtccgccagcactaatcagggctggtcggtattcgctgcgccgaatgcgaatgcgcaaacctaccagcaggagcattacctcggcgtgatggatcgcaccacctcggtgaacgtagagcgttacaacaacgccggcaagcgcgacaccactggcaatgtgggcaaggatggcctcgccagccagtggcgtcacgtcgatttggtcatcgacaaggccgcttccacgctgtacattgatggtgagcaggccgcaaccgtagccccagctgatggcgtgagcttcgctcaactcaccgatattctcggcgcagacggcggcgtgctgcagattggcaaggccaattgggtgaacggcgaatactataccggtgcactcgacaacctcaagatttacggctctgcgcacactgctgaccaaatcaaggaggtctacgattccacgaagtccgatgccgccaaggccgacgctaatgcgctgaccctcaacaacggcgctgaggacgtgtattccagcatcacacttccggccaagggctcggttaacggttccgcgattacgtggaaatccagcaacgcaaaggtcattaccgatacagcagatggtgacatcgcagccggtgttgtcacccgccagaaaaccgacaccaaggtgacgctcactgccaccattaccgatgctgacggcaacacggaaaccaaggaattcgagctgaccgtcaaggccgccgtcgaacagccgaagaccacggactatctgttcgcgcacttcaccggcaccgaaggcagcactaccgacgagcagatgtacttcgccaccagcaaggatggcctgagctggcatgacacccgcgagtccggcgatccagtactcagctggaacaacagccagaccggcaactctcgtggtaaggacaacggtgtgcgcgacccgtatctggtccgctctccggaaggcgacaccgtctacctcatcgccaccgaactgagcatccacaaccgtggcggttggggcgcggccaccgctaccaccaatggcagcaccaacctaatcgtgtgggagtcgcatgacttcgtcaactggagcgaaccgcgcgccgttgacgttgcctctcagattccgggagccggcatggcttgggctccggaagcctactgggatgatgtgaacaagcagtacatggtgtactgggccactgcttccgacgcggacaacaagtccggcgatcgcaccaatatgtactactccaccacgcgtgatttcgtgaacttcacgacgcctgtcaagtggatcgaccgagtcaagtccgttatcgataccacgatgattaaggccgatgacggctattactatcgtgtgtccggtgacacgtacctcggtgttgagcgtagcaaggatccgtatgccacaacgctcaccactggtgacacaattgcgaatggttactacaacactgacagtgatccgaaccagtggacgcttgtcggtacattcggtgacctgactggtaccggtctgaccggtgcgcagctggaaggcccggagctgttcttctacaatgaagatgacgtgcagaccagtgatgcgggcaagaagatgctctacggtctgatgtgggaccagtactcagccggtaagggttacaccccataccgttctgccgatttaggcagcactgataaggctgattggggctttgcctctgatgtgaacttcggttcgctcaagaagcgtcacggcaccatcctgcctgtcactgaaaccgagtacaacgcaatcctgaaggcattcgataagaacaaggacaccgagccagtcacacccgatgaagacggctccggtccgattgccgagtatgacttcgaagacagcaagggtaccgacaccactgagaacagcaacgacttgaccttcaacggcaacgccaaggtctccgaggatgccgaaaagggcaaggtgcttaagctcgacggctctgacggcacctacgccgagttcccgaagggcctgttcgatggccgtaacaagctgactgtgcagatggatgtcaagtcggagatcaataaaaaccagttcacgttcgctttcggccagaactccaccaagtactacttcctgaagtacaacaactccggcgagctcgccagccgcatcaccaccaactcgtatggtgcggaggacgcggctaacgctacgttgtctggcaacggcgcatggcatcgtgtcacggtcacgttggacgacaacgtgatgaccgtgtactctgacggtgcgcaggtggctcagaacaaggcgaccaagaacaaggtcaccgatttgggtaacgatctgctggcctacttgggcaagtccttctacaacgacccatacttcaagggttcgttcgacaatgtgaacgtgtggaaccgcgcgctcactgctcaggaggtcgagaagaccagcccgattgctctgcagggtatttctgtgggcactgtgccgtctgacccgaactcgctgcgtggcactgacgaccactctcaggtgcgttccaccctcgactggtccgcgaagaccgtcaccaccgtgctcaaccgccgtggcgacgcggccaaggtgcccgtcaaggtgaccgtcaaccgtggcgacgactccatcaagctcacccttgatggtcaggcgttcaccaatggtggtacggccgacctgactaaggaccgtactttggttgtcgatttgggtgacggtaatacggaaacctggacgctgaagaaggtcaccgtgggcaacaacccggtgctgcccggccagtacgccgacccggacatcgactacttcgacggcaagttctggatttacccgaccaccgacggcttctccggctggagcggcaattacttccatgcgttcagctccaccgacttggtgaactggaccgacgagggcgtgatcctcgatgtcaacaaggaccaccagccgaccaccgatggcgatgagaacaccgccatctccccgtggtccgtgggctccgcgtgggcaccgaccatcgagaagaagaacggcaagtactacttctactactgcgcgaagttgccgaacggtcagtccgccatcggcgtggccgtggccgacaatccggccggtccgttcaaggccgccgatcagccgctggtcactcgcacgatggaaggcgtcaccgttggacaggccatcgacccgtccatcttcaccgacccgaacaccggcaagtcgtacatcctgtacggcaacggttcgcccgccatcgccgaactcaacgacgacatggtgagcatcaaggccggtacggtgaagaagctcaacggtctgaacgacttccgcgagtccgtggtcgtcgcctaccgcgacggcaagtaccactggacctggtcatgcgacgatgccaactccccgaactaccatgtgaggtacggcgtctccgattccatcgacggcaccatcacctacaagggtgtgctgctgcagaaggattcctccaagaacctgcaaggtgccgcgcaccagtccgacgtgcatgtgaccgacgcggacggcaacgaccgttggctcatggcctaccatcgccactacacgccgctcggcgtgttcacctccggccttggttaccaccgtgagaccgccatcgacgagatcaccttcgacgcggacggcctgatgcagaccattcacccgaccgacgaaggcgtgtccattgagatggccgatacgacggcgcttgatggcgcgattggagcggccgacaagctcggcaccgatggctctgcttacaccgaggccagctggaaggcattcgaggatgcgctcgccgcagccaagacggccaagcagaccttccttgactccggcctgtctcaggctgatgtcgatgccgccgccaaggccctgaccgacgcgcagaatgcgttggaggagagccagcccgagccagagcacccggccgcaggcacgatcctctccatcgccgtgaccgcgcagcccgccaaggccgagtacaaggtcggtgaagcgctcgacactgccggtctggtcgtcaccgcgaccgtggccgatggcaacggcggctccgccacccgcgagctcgccgccgatgagtacgagctgctcggcttcgactcctcgaaggcctccgacaagatgaccgtgaccgtgcagtctgtggccgattcgaccaagaccgccacgttcaccgtgaaggtcgttgccgacgagacgccgactccggatcccgatctggccactgaggaagagctcaagcagctcgaagatgccattgccaaggccgaagccgagaatctgaaccaggacgattacaccgccgattcgtggaaggcttacgccgatgcgctggcccaagcgaagaaggtgctcgccaaggagaacgccacctccaccgaggtccaggatgcgattcgtcacctgaccgaggcccgcaaggccctcgtgaaggtctccgctgatggcaagaagccgggtgccgtcatctccgacactggtgccgccgtcttcggcgtggctggtaccgtggtggtcctcgccgccgccggtatcgccctgaccatctggcgcaagcgccgtatctgacccctcatttgcaaaaaactctcactgacgttgagtcagtgagagttttttgcaataggggggggcttatctcttcgcctgagtgatctggtaggcggcgaagaggatggcgagccaaatcacgccggcgatgacggcgacgcggtagctggcggagaagcacatcagcaccacgaccagtgccaggaacgccaataccacccacggggttactttggcgaacggcagcttgaagtgaatcgcgtcgagcgcttccttgccggacttgccggccagttcggaatcctcgggagcgccgcccgcggcgaccaccttacggaacttcatttcggtgaacatgatcatcgtccagttgatgatgccggcgatggtggcaatcgacatcagatagttgaacgcgaactcaggccacacgaacaccacgaccacggcgatggcggtgatcacgacggacgtcagcacgccggccaccggcacgcccttagcgttgagcttgcccagatacgcgggtgcattgccttgtttggccagcgaatacagcatgcgggagttggcgtacaggccggagttgtagacgctcatcacagcggtcaggcacacgaagttgaggatgccggcggccgcgtggatgcccacggaatcgaagatttgcacgaacgggctgggaacatcgtctccgccgatggtgttccacggtattacggccatgattacgccgagcgcgccaatgtagaacacgagaattcgccagataatgtcattggtggcgcggggaatcgtacgacgagggtcctcggtttcgccggcggtgatgccgatgagctcggtgccgccgaagctgaacatcaccacgacaagcgccatcaacaggccggtccaggtgccgtccttagtctgctccatgagaccgttcgggaagaagcccccttccaaggtgaaccagttggcaaagctcgctttgatgccggatgcggtgggcagagcgaagatgatgacggccaggccgccgacgatcatggcgatcacggccacaatcttgataatggcgaaccagaactcgaactcaccgaacttggagacgcccagcaggttggcggcgcagataatcaccaagaacacggccgccgacacccatgtcggaatcgccgggaaccagtagtttacgaatttgcccaccacggacagctcaaccatcgagacgaggatgtaattgaaccagtagttccaaccggagatgaagccggcgcgcttggaccagtagcgagtggcgtagtagctgaacgcgcccgccttcggatcctcaacggacatttcgctcagcgcgcgcacgatcatgaagattgcgaagccgccaaccaagtaggcgagcagaatcgaggggccggccagcgcgatggattcgctggaaccatagaacaggccggttccgatggcgccgcccagcgcaatcagctggatgtggcggtttttcaatgacttgcgcagcgtggccggcaccggcacgtcgtcggtttcgcgcggcttcttaggcgcatcagtggtactcattgtgctcttctctcacatttcttgggtttggcgcacgcggggcttgccgtgatgcgcaacgttcgttattctatgccgccgtatcgtctcagaaatggtcaatcgtctatttgtgcgctattgcaagcgcgggcgtgggcgcggccggtgagcaggcgaagctatagcgagcgatgcttatgaaaccgcacgcttcactgagttcactgaattcactgtgctcactgcgtggcaggcgtacacatggtgaagatggtgtgggacaccgattcgggagaggccgcgagatcggtggcgagccagtattgcaaaagcccaatgctgccggacacggcgaatcgcatacgcatctgcgcctcggctgggtaacccgccgaagattgcaactgttcgcctacaccgcgctggctgtaaatcaatcccagcagctgctgctggaaaccgatatccgctttcgggctcatcagcacttggagatgattgcgattgtcggcaatgtactggcagatgcgctcaataacatgctcgatgccggcaggatctggctgggcgagtagctgttcgagtgcggtggtgacccaggccatggtttcgtcttcaatgtcgtgcagcagttcctcgatgctcgcataatgcgcgtaaaacgtggaacgattcacatcggcccgctcgcacaacgctttaacggtgatggagccgagcggctgatcgcgcagcaactcgataagcgcgtcctgcatggcacgtctcgtgtaacgggtgcggcggctttccgtcaattctttggacatggccttctccccaagttccgacaacccacaatccaactgttggttgcagaaccgacacagtgttgttttacttgagtatagcaggaagttctggcggggcctatggggctaggtggctgccacgagcgcgttggaggtgtgcgatggcgtatatcgaattcgaccatgtggtcaaggaatatccttctggcagcagtgtgattcgcgcgctcgacgaggccagcttcaccgccgaacaaggcgaattaagcgtgattctggggcagtccggtgccggcaaaaccacggcattgaacattctgggcggcatggataccgccacaaccggccgcgtagtggtcggcggacgcgatattacgggtctgcggaaaaaggaactggtgacctaccggcgcaacgatatcggcttcgtcttccagttctacaatctggtgcctaaccttaccgcgctcgaaaacgtggagctcgcctcgcaaatctgccctgaccatttcgatccaggggaaacgctgcgcaaagtcggactgggggagaggatggacaacttccccgcgcaactgtccggcggcgaacaacagcgtgtatccatcgcccgcgcgattgccaaaaagccgaagctgttgttgtgcgatgagccgaccggtgcgctcgattacgagaccggcaaggaagtgctgcagttgctgcaggatatttgccaaacacaaggcatgaccgtaatgatcatcacgcataattccgcgcttgcaccgatggctcacaaagtgattcgcttccgctccggcaaggtgaccagcgaggaggtcaacgcaacgccgcggcccatcgccgatatcgaatggtaggtgattggcgatgctcactgcaagacactctgtgaaacgccccgtgaaacaagcgaggcgattcgtgaaacaacctgtgaaacattctgtgaaacggcggaacctcgacgatagcggcggtcgaggagcgggcgtttctgcggtatttgccaaagatacgttgcgttgctggctgcgcagctggaagaggttcgtctcgatcgccgtcatcacgctgcttggcgtggccgtgctgaccggcatctacgccggatgccgcgatgcttttctggcggccggtcgtttttacgatcagcagggactgcatgacctgcaggtgctatccacatacggcctgaccgatgatgatgcaacggcactgcgccgaatcgacggtgtgcaaaccgtgcagcccgaacgttctcagacggtgaccacgttggtggacggcaccaagaaaaccgtgaccatgcaggaaatcggtaccgaagggcttgatcagccgtacatacggcagggcaaactgccgaacaaggccggcgaagtggcggttacgcagcaattcctgaacgatagcggactcaagattggcggcaccattactgtgacgccacaagacacttcttcatccgtcatatcggtagcggccacggagactgacgattccaataatgccgatacggtaggtgtcgccgccaatgcctcggcatccgatgcgaagtccgccgccaatacggacgccgacgccgagcaatccccgcagttccccacgaaactcaccatcaccggcgtcgtacttgacccgcgcgacctcaacaatccagacggctattcgggcatgacctccttccggtccacctcatccgaggactatacgttctttgcacccagcgacggcgtgaccggcaatatatacactgcgatatcggttgccgtcactggtgcgtccgattttgacacgttttccgatgcctacgatgaagccgtcaaaaccgtggccgaccgtatcgaacatcagatacagaccacacgccagaaagcccgtcgtcaacagatcgtctccagcgcgcagcgcaaactggatgatgccaaagacgaggccaacgagcagctggacgaagcccagaagcagatcgacgacaactgggccgagctggaagccaacaaaacgacattgcaagatagccgtaccgaattggagaacaacaggacaaccattaccgatggcgaacggcagctcgccgatggacgtgcgcagattgcatcggcccgtcaacagatcgcgcaaggtcgccagcagatagccgaagcgcgcacccagctcgaatcgggcaaagcgcagctcacctcggctcgcaaacagctcgatgcggcgcaaacggaactgactgccaatcgcacgaaaatcgaacagggcattacccaaatcgaccaaggcgtggcacaaattgatcagatgctgtccatgattcaacaggccgacaatctactggcgcaacttgacccgaatatcgacttcaactcacccacatggcaggccatcaagcaactgctcgcgcgccttggcattaccctgcctgaagtgccgtcaatcagtgagctgcggcaacagctggccgccaagcaaacggaactgcaaacgcagcgagacagtctgacccagcagaaagccgatttgcagcgcacattaaacgaaaccattgcccccgcacaatccaccttggaccagcagaacgcgcaactgaccgccaaggaacaggaagcggctgcaggagaggcacagctcaataccaaatccgcggaactcgaagcgaatgccgcaaccctcgaaacccagtcggcgcaacttgaagcgcaggccgcccaactggccagcggcaagcagcagctcgaagaaggcgagcggcagctggaagaaggcgaacaacagctcgcggacggcaaggcgaaactggatgatgcgcagtctgcactcgatgcgaagcgaagcgaagcggaaagcgaattcgccaagcagcaacggcgcatcgacgatgtggccaacgcacgttggtatgtgcagacacgcgcttcgatcgacggattcagctcgctcaaatcagacgtcagttccatcgaatccatcggccgcgcattcccgattgtgttcctgctggtcgccgtgctcatgagcctgaccaccatgacccgcatggtcgaggaagaccgcggacttatcggcacctaccttggactcggctatggcggactcgccgtgtccagccggtatctgctgttcgcgttgctcgcctgcttggtcggcggcggcatcggtctgctggtcggattcctcggcatcccggcattcctgatggtggtgattgagggactgtatatattgcccggtgtgcgacttgaatacgactggctgtacggctcggccggcatcgtgctgttcgtggtcggtgtgggcgtggtcaccgcgctcgcctgccgcgaggagatacggcacacgcccgccgcgctgatgcgcccgaaggcgccgaaggcgggcgctcgcatattgttggagcggattcgcccggtatggagccggctgaacttcctcggcaaagtcactgcgcgcaatatcttccgattcaagtcgcgtttgattatgaccgtgggcggcgtggctggttgcacagcgctgattatctgcggatttgcgattaacgacaccgtcgacacgactggcgtcaagcaatatgagcagatctaccagtatgacttgatggtggtggccaatgacgatgacgccgccgcgatgcgcaagcaggtggcacaagatggccgggccaccgaaacgctgaatctgcgcgtggatagcggcgagatgagcaatgcggcgcaggaaagcgaaaccgtgcagctgatgacggtgcccaacaattcgttgaacaaactgaacgacatggtcacgctggaagaggccggtgacgatgggtggttcgagctgcccaatatcttcggcaaagcgggtggcggcactgtagcgctggacgatagtggtgtgattgtggcgaagtccgcagccaattcgttggatattcatgcgggcgacaccgtcacgttgagcaatggcggcagcgggcgggccaaggtgaaggttgcggcggtgacgcgcaacctcatcggctctgatgtgtacatcagtgagcgactgtacgaccagaagtttgcggccgacggtgtgacgtcttcggcttcgggagatggcactgcctcgaccttgacgtggaacgcgatgctcgccaagctgaaaggttccgagaccgaacaggccgaatatgcggatcggttgggcgaggaatcgtcggtgctcaaggccgtgagctgtgcgcatctggccgccacgtttaagttcgatttgatgggtgccgtggtggcgctgattgtggggctcgccggcggcctggcgctggtggtgctgtttacgttggccaatacgaacgtgtccgaacgcatccgcgagatggccacactgaaggtgctgggcttctatgaccgcgaggtgcacaactacgtgaaccgcgagatgatgatattgaccggtatgggtgtggtggttggtctgccgcttggcaggtggataggcggattactgactgctgcgttgaatatgccgtcgctgtatttcgaagtggaagtgcactggtacagctatgcgattgccgtggtggcgacgctggcgttcgcgctgctggtgcagctgttcaccaacccagtgctcgatcgcgtagacccggtcagctcgctcaagtccgtggaatagaggtagaagttcaatttggtgttgatgaattgaactttttggcggaatatttacagtatcatcgcatgtattcttgagctgagcggttttcgtgacatatttcggtgatacagtttgaacttgttttgaacgagtatcgcgtctggtgcgtaacaatcgggcggcagagaagagaaatgaaatcagtatggccgatacgaatgtgaatggtggtacacagcaggctacgggcaaactcaagtctgtcgaaagcctggaccagaccaacgagatggagcgtggcctgagcaatcgccacgtacagttcatcgccattggcggcaccatcggcaccggcctgttcctgggctcgggcaagtcaatctcgctaaccggcccctcgatcatcttcgtgtacattctggtcggtgtcatcatgttcttcctgatgcgcgccatcggcgaaatgatgtaccgtgaccccagccagcacaccttcatcaatttcatcacccgttaccttggcaacgggtgggggcatttcgccggctggacgtattgggccgcgctcgtgctgctgggcatgaccgagatcacggccgtctccacgtacttcatcaccttcttcgacacgttcggcatcgacctgacccattggaaatggctgatcgagctgtgtttcctggtgtcgctggtctccatcaacctgattgccgtcaaggtgttcggcgaggtggaattctggttctcgatgatcaagatcacgctgatttgcgcgatgatcgccaccgccgtggtcatgatcgtgatcggctaccattacccagccgtgcagattcacggcgtggaccacgtgagcccggccggccacgccggattcgacaacctgttcgccaacttctcgttcgcgccgaacggttggatggccttcctcatgagcttccagatggtgttcttcgcctacgagatgattgaattcgtgggcgtcaccgtctccgagaccaagaatccgcgcaaggtgctgcccaaggccatcaacgagattatcgtgcgcgtgctcatcttctatgtgggcgcactggtggccatcatgtgcatcgtgccgtggacctcgttcaagccgaacgaggacggctcctttgcctccccgttcattatggtgttccagtacgccgggctgaattgggcgtccgcgctggtgttcttcgtggtgatcaccgccgcatcttccgcgctgaactcgctgctgtactcggctggccgccacctgtaccagctgtccgaggtgtcgccgaacccgatgctgaacaagctcggcaaggtgtccgatcgcaaggtgccggcccgcgccatcctggtgtccgcggcgctgatactgctgtcgccgatcgtcaacgccatccccggtgtgtccggagcgttcgtgctgttctcgtccgccagctccgcggtgttcctgttcatctacatcctgacgctgctggcgcatcgcaggtaccgccgttccgctgatttcattccggacgggttcgtcatgcccgcgtggaaggtgctcaatacggtggcaatcgtgttcttcgtgttcatctacctgacgttgttccttgcggacgatacgcgcaattccgcgattgccggcctggtgtggcttgtgggcttcggtggattctctatgctgcgcgaacgctaccgtagccgcgatttgaaggccgcactggaacacaaggagtgattggacgggctgattggctggcggctattggttgggtggctgttggctgttggcggctgactggctagcggccgatagccaatgactgggctgatcgtcagccaatcggctgcctataggtctcattgatacattcggtcatccgattagtgcatttgtgcggacaattagtgcattcgatcatcggattagtacatcagtgtgcaattattagtacaattagccgcctaattagtacattaggacataaaacaatgtcctaatgtactaattagatgctaaaatacgataagtgccatgtcctaatgtatgaattatcgctatgaagggcggaatgcgatgacgcaggatgaacttatgcaagtgctgcaggccggtgaatcatctatggtcgagttcaagcgctgcagcgaattgcctcatacggatacttttgagactgtatgctcattcgccaatcgttctggtggcagcatttatcttggcgttgacgatgacggtcaagtgctcggcgtcgattctaagcgcgttagtgagatagagcgcaacgttgtcaacgtagtgtctaatcgtaagatgttcgaaccggctccaatggtggaaacggaacatatcgagtacgacgaacggattattgttcgtatttgggtagctccgagttcttcggttgtgcggttcaagggcgcagtgtttgatcgcattgctgatgtggatacacacatcgaaagcgatatccagattagtcaaatgtatattcgcaagcagaactactattccgaacggcgaattttccgttacgtgactccgtttgatttgcgtcctgagctgattgcgcgaatgcggcagctggcggtcgctcagcgagctgggcacccttggggaactatgtctgacgaagaactgttccgcagcgccaagctatacgatcgtgattacacgaccggcgaagagggctttaatcttgctgcagtgctgctcttgggcaaggatgaagtcatttcctcggtttgcccagcgtatattactgatgccgtggttcggcgagacaatattgaccgatacgatgaccgacttatggtgcggaccaacttgttcgattcgtacgagcaactccgtgaatttactgagcggaatctgcctgaccgctttgtgttaaagggcgataagcgagtgagcccgcgtacgatgatcgcccgtgaattggtggcaaacagcctcatgcatcgggagtattccagtccggtggtggcgcgtgtcaccattgataatgaatccatccggacggttaatgcttcgcgctcattctttgaaggtcgaatgaagctgggcgagttcacgccaatgccaaagaatccgattatcgctaatgtgtttgtgcagaccggcatagccgagcagctgggtagcggactgcggaatctgataagagcgtcccggcaatatactgagcgagagcctgagttccgcgatggtgacatattcgaggcgacgattcctattgttcctgcgctgaagaccgtggatggttctggttttgctagcgtgagatctgtagttgagaaagatgccgaagagggtgcgaggctcattggcggggaacgtgtggatggtaagaaagcagatgcaaccgcatcgggtgaaattgattcgcgggcagcgatgctgtcggcgatgaatcgacgcttgacagaggttgactatgtgactgtacctgaactcgccaagataacagagctcgataacagaacagtccgcaaattcctaaacggtttagttgcgcaaggaaagctgattgctgaaggcaacacgcgtggtcggcgttatcggaagggatagcgggcgcgatatctcgatgcagtgggattcacttaagggctacggcaaatatgattcgtagcgattgggccagcgcaattcgaatggctcatgactttgtgcgtcgtttgtggtctctgaagttgtttgctgggtgacggttttgtgataaaatcgctcatatcaaaatgtttgcgtaaacattttggctgcgccgaaagaaggagtcgacgtaggtcatgtatcaggcaaagaggccggcgcagtgaagcaaaggccgatttttccggtataaggcggatagcaggaacactaaggagaccaatgaaggtactgagcaaatcgcttgctgcaatggttgcggcggcaacactagtgggaggaggggcgtttgcggttgccggcactgcgtatgcggctgataacgatgccattaccgtgaccccgaacccgtggtatgccaacagtttcgatggctggggcacctcgctggcttggttcgccaacgccaccggcagcctcggcgaggaatcggccatcaccaccaatctcggcgatgacgcttccaaggctaaggctgtggaatacggcaagcagctgcgcgaacagttctaccagtccatcttcggtgatgaaggactggacctgaacatggcccgctacaacgtgggcggcggcaatgcctccgatgttgcctacggctacccattcatgcgccaaggcgctgccgtgcctggcacgtggaaagatgacgccaccggctccggcacgtatggcaatggcgtaaccaccaagcaggccgacaaagacaagctggctgcggcattcgacccgactgacgacaaccagtatgacttctccaagtccgccgcccaagactggtggattgagcgcggtgccaccggcgataaccctgacatcaccgacgtagaggccttcgccaactccgctccgtggttcctgaccaacagcggttacgccactggtggacgcaactccggtagcaataatcttgcaaaccctgagaaattcgctcagtacatggccaagaacgtcgagcacctcgaaagccttggcgcaaacgttgacacggtcgagccgttcaacgagtccgagaccagttactggggcactccgggcgacatggcttcgaagtacaccgatgagagcgatgacaacaccaagctcattaacaactactgggataagtactactccgacaaagataagtccgtcaccccatactccaacgcgttgaagaagccgcaggagggtatgcatgtcaataacgcccagcagcagcagacgattaccgcactcgctgaggcgctcaaggacaatgatgacaccatcatcgcagccaccgatgccacgaactccgccgacttcgtcaagtcgtacaaccagtacccgcaggcgatcaaggaccttatcggccagtacaacgttcacgcctactccgacagcaaccagatgcagtcgcgcgatatcgctcaggcagacggcaagaagctgtcgatgagcgaggtggacggctcctggcagtctggctcctacaacccgtacggtttcgacaacgcgctgggcatgatgagcaagatcagctccaacgtcacccgcctgcagtccaaggacttcaccttctggcaggtggtcgaggacctctacaacatgcagatggggtcgaatgtgaatccggccggtgagaacaccaactggggcaccgtgctcatcgacttcgactgcaccgtggctggcatggacggcaagctctactccgagcgccgcgtgaacaacaacggcggtaccaccgatggacttgaaccgtgcacggttattgcaaacgccaagtacaacggcgtcaaggccatcacccacttcatccacgcgggcgacaaggtcatcgccaacaacgatgaagacaacaacatgactgccacctccgacgatggcaagacgcagaccgtcatccaccgcaactccggcacctctgaccagaccttcgtcatcgacctgtcgaagtacggcgagattgccgacaacgcttacggtgagctctacctgaccaccgaaacctctgccgaagacaagaacgcgggtgtcgattccgccactccggaagtcttcgccaagaccagcaacgtcaagcaagctgaaggctctgtgatgattgacaaggctgccaagaccgctacggtcactgtgcccgcccgttctatcgcctccatccagctcactggcgtgaccggctacgctaaggatgctgccgtcgagaccggcgacacttaccagctcgttggtaagcagtccggcaaggccgtggctgataccacttctggtgattccgcgctgtccctggccaacgtcgcttccgatgccgagaacgccaagaagcagacttggacctttacccagatcgagcagcccgccgactccgagcgccctgatctcaaggcttatgtgattactaacgccgaaggcaaggtgctggtgtccaaggatggcacgaacgcgctttccaacgaaacggttgaggccgctaagtccgacccggctgccaagtggattctcaacacttccgatggttcgacctaccagctgctcaatgccgcgactaagacgaacctcgatgtggataactctggtaccacagtcggcacgaaggttggcttgtggcagtcaccgagcggcacttcgccgtccgccaaccagacatggactctacgcaatgtaacgccgaccagccagaagaccgtgaacgtgcagaccgccgttaacgagaaggccgcgctgccgaccgaagtcacgctctactacacctggggcgaaggcaaggccacggttgccaactgggatacttccaaggtcgatgtggccaaggaaggcacctacgaagccaccgctaccgccaccgatgtgtacggcaacgagttcaacgtcaccgctacggtctacgttggcgcgctcaccgtttccgatccggtatcggctacagtgctggccggcaccagtgcgagcgaggcgaaggccgcgcttgaggctgcgccggtgtacctacacgtcaaggcatcgcctgcattcgagggcgatgcggctaaggttacgtggaacttcgatgggcttgataccaagctcgccgatgccaaggctggcgacaacattgccgtgaccggtacttaccagctggacgacgcgaccacgattgcactgaagggcgcgatctatgtcaccgccgccacgcctgagaatgtggccgacactgcttccaacctgaccgtgaccaaccagcagacggaatacagcaagggcgatcagtggaagaagctcaccgatggtgacacgtcagctgaagcctgggtgacgtggaactctgctggtgactattccgccagcccgaccgccacgattgacttcggctctgagtgtgagcttagcagcgtgaccattacgtatggtgacaaggctccggcttccgccaaggccgagtacaccactgatggcgagacgtggatgcaattcggtagcgatgttaagcctgccgcaggccagacggtgacgttcaaggccgataagggcacagtgaatgccacgaagatgcgcattgtgaacaccgtgaacaacgactacatgaacgccaccgaaattcaggcattcgtgacgccggttcagggtgctgcgaagaacatcgccgcggcctctggcacgaacttctcggtgaacttccaggagggtgcctccgcttccaaggccatcgatggtgacactacgtcaaagggttggtccacttgggcttccaccgcctcgacggtggacccggtcgccacgttcaccttcgacgaagctcagaccatcaccgaagtgaagaccttcttctactacgatggtcgtgcgtcttggccgaagagccagacgctggaataccaggatgaggctggcgaatggcatggagtcggtaccaaggatggctggaagatacaggccggcgatgccggctctggctccgacggcatcaccgccgccgacaccccgaccgttgacttcgtgctcggcaccccggtaaaggccaaggccatccgcctgactaacacattgcaggacaccaaggtgtacatcaacgtggctgagatccaggtgttcgcacaagacagcacggtactcaccccgcagccagcatccgatgccacgctgggcgacctgcgtcttgacggcgaaaccgttgaaggcttcgacccgtccaagaccgactacacggttgatctgccggtcgacgccgaggcaaacccggtgctgcaggccttcgccaccgacaatgccgccgccgtcaaggtgactggcgacgcggttgagaacggcaagcttggcggcaaggccgccattacggtgacctcagccgacgagtctgagacgaagacctacacggtgaccttcaacgccttcactttggcttcgctcaaggtgatcggacccacgaagaccgagtacgccatcggcgacaagctcgataccgccggtctgaaggtgactgccgtctaccagagtgtcgacaagaccaaggaagtgccggtcgctcttgacgacccgcagcttgcgattggctcgttcgactccaccaccgcaggcaagaaggcgattaccgtctcctaccgtggtgtgaccgcgaccttcaacgtcacggtcaaggccaacgcagtcgcccctggccctgaagaacagaagcccggcaacaccaacaagcccggtgccaccggcaacggcaacaagaacacggtggccaacaccggttccagtgttgccgccatcgctggcgctgtcgctctgctggccgctgccgcgggtgcactgttcatgctgcgcaagcgtgcatagcaccctcgcgcagtaatgggtgaaggaacaagccggcaatattgactattgccggccggttcctccgctctttgaccataattggtccgacaagttgaatactgaattttcagtatcggtatattgatttgtcgaaccttttctggcttcgcggatagcgacataactgtttgttcaaaaaaccgttatcatcaatcaaggaaccaaatcaatgaagataaacgataagggcaagggcgctcttatcgcggcaattaccgccgcggcaacgctattgtcatgcgggctggccgctgcaagtgccagtgcggcaggtgtggattacctgcctaccatcggccaagtgccgacatacaccaagttccagcccacagccgatccgggcaagaacgctagcgattacttccagccatattggtatgccaagaacgccaatgataatggcggcacacacatccaagcgcacggtggccaagtggtcaaggtcggcgacgcctactactggtatggcgaagaccgttctaacggttacgacaacagccccggtgtccatgcttatatgtcgacagatctatacaactggaccgatcttggtgtggcgctgcgtgcggtgaccagcaaatctcagttgacggataagagcaatgccgattacgcctacttcgacaaggcctacaacctgaccaagtccgacggcagtgtggacgctgccaaggccgacgcaatcttcccgtacctcaacaccaaccccgatcaggatggtgatggcgcggttgattccgtacagggcattttcgagcgtccgaagatcatctacaacaagaagaacaagcaatacgtgctgtggtggcattccgatggaagcaccacgccgggcggttccaactatgcacgtgcacttgcgggcgtggctgtttccgacaatccggcgggcccgttcactatggtgggtgcctatcgtttgcctaaccagaacaattggaaagaagccgcaggtaaccccagctggggtgagaacggtgacagccgcgatatgactgtgttcgtggatccgaaggacgacagtgcctatgtactgtattcttccgaagccaatgccacgctgtatatcgccaagcttaacgatgattacaccaatgtagtcaagaccacgaatgtggaccagtccgagggacaaaagcagtactctgctgacgggcagtacccatacattcttgcagacggtactacggatgccccggtgcgtggcgaagatttccaaatcgtcaaacaaaatggttcgctggaagctcctgccgtattccaatatgacgggcgttacaacatcatcgcatctggtgcaaccggctgggacccgaacaagcagacctactacaccgccgactccatgctgggaagctggacccgtggcgtggaaaaggacgatgccaacgagaacacgtggtacaacaacatgccggaaggcgcggatggtctgttgtctgtgggcgatacccgcggcaccacattcggttcgcagtcggctagtgtgctcgcagtagaccaggagaaaggtcacttcatctaccttggtgaccgttgggattccggtaaagccgattccacctatgtttggctgccgctgaccatcggtgagaacggcaccatcgaaatgcataatcctgctcaagaaggcgagcccgacggctgggatctgaactattgggacaaccatggtagcgccaagggcaagctggtcaactggactgtggaaaccggcgatgatctcccgaagaccgtgaacacgggcggaaccgttactctgccggacaccgtcaacgtcaaggaaggcgacgataccattgctaccaaggtgacatggaatgtggaaggcggtacggcagtcagcaagtcgaccaaggctgccggcagcacctacgcattcaatgtgccgggaacctacaccattacaggcactcttgccgagagcagcaacttcaacccgggccgcacattccgcagaaccatcgacgtttcctgctccaacccgatttccggaagttggaaggaagcccattggaagggcggcagcgcgtgccaggtttctgcgtccggcggtgcttatgacttcacgattacggacaacgccaatcgtggcgtctggacggatcgcaacgagggcagtgcggtgtaccagcctgatgctctggacgtgaacgaaacgctggaaaccacggtcaagccgctcgacttgggcggtaatggcgatccgcgcgccggtctggtggtccgtaacggtcttgctgacgctaacggcggcaagggatatgccacgttacttgccagcccaagcggcatttacatgcagtacgattccaatgccgatggctacatcgataaggaaacatcgcatgttggtgccggcttcggcgaccaagtgcaactcaagctggagcgcgccgcaaccgataccctgaaaggctactggcgtgcttccgcgaacgatgaatggcaggatgtcgctacggtaacgctgaccggtgcggacgcaaccgggctcgatgccggtgtcttcgccacgtcgaacagcaatgccggcgcattcaccgtggccttcaacggcactgcgttcggttcgcagactgctgctgtggagtccatcgcggctaaggaccctgaagccactatcgccaaggggcagatgctcgcgcttcgggacgtgacggttaccgccacgctcaccaatggcaaaacgcgtgtgctggagccaagcgaatacacgctggaaggcttcgacaccaccaaattgggcgagcaaaccgtgacggtgcgtcttgtcgctgattcttcagtaaccgccacgttcaccgtgactgtggaaagcaaccttgcccggttgttctgctcgtccgctgcggcctcgaagtatgagccggccagtagctgggcctccgcttctacggccgacctgacttgcgacaacaacctgagcaccaactggtcgaactggggcaccggcgacacctcgccgtggctcagctacaccttcgataaggcatatcagctgggcaagctcagcgttgcggtggataaggccaagggcgaggccgctccgaagagcttcactgtatcgtacctagctgaagacagcgccacgtggactgatgccacgctgccggcagtcactgtgaatggtgctgctggagccgtgacggaagccgatgtgagcgctctgcccgccaccaagggcattcgcctcaacttcacctacgccgatggcaatgactatgccaagatcgctgaagtacgcatcgccgaaggtgaagcgacaccagagccgcagccgtctagtaacgccaatcttgctgatctgactgtggatggcaagacggttgacggattctccgcggataccactaaatatgccggtgcgctggctggagatgctgcttcctacccgacggtggaggcgactgctgctgacgcaaaggctacggtgcaagtggagcaggcttcggccgagaacaacggcgtggccacggtgactgtaactgctgaggatggcacggcgaaaacctacgcagtgacattcggcgaactgcctcagttggctgagcttgctgtggaagtgaccaaggattcctatcaggtaggcgataagttcaacgctgccgatgtgaaggtatccgccatttacaaagtcggcgatactgaaacgctgcgcaagctgattgatccaactgatggtgatctgaagttcactggctttgattctgccaccgcaggcacgaggaccatcaccgtctcttatcgtggcgtgaacgcgacgttcgaagtcacggtcacggccacggaggtcactcccggccctggagagcagaagcccggcgataccaacaatcctggcaacactgctaagcccggtagcactgccacgaataagccggctgctaatggcgctgcgcccctttcgaatacgggtgctgccgtggctgccattgcggtcgtggttgtggtgctggcagctgcggctggtgccttgctcgtcatccgcaaacgccgcgcataaccatggcaactgctgagtagcgtggattgcgttgctattgagcaatctgcgattcacgccactcagcgagtgcacccgagtgcgcccgagcttgcgcaatgcaggcgcaatacagtgcaaacagtacaaagcaacaataatggccggtctgagccagctgctccatgcgagggcagttggctcagaccggccattgtgtctgcaagtacatgcaattagagcatgaacatgtggaagccgttgagcgttactggttgttttgctttgttgttgcgctcagcagtgcgacggacgtccgcccgcagtgtagtgcagcgctccgtgaaccagcgccgatgtgaaatgcatgttgcacatgcccgcttcttctgcttcgtgcgtgcagccggcgatgctgcataggttcataccccgaatcatggtcataccccctctttgggatggcatccgtgccgccatctgccttcagagcatagcggacaattgttgcattgcctaggcggtacaacgctttctgtggcctgtatcacatccttgccggcgttctgcggcgtggttgggcgtgtacatgtgcacttgtgcggttttgttgtgtgtgatttgggtatacggatagagtttcttctctgcagtggcaagggcctctcgaccggcgagccggctgatttctcccatgcgttgctcaatgatttccgttttgcgagtctgaacggcaaaatagctctggagaagtgccacttcttctttcttcggatcaccgttttgagcaatgagatagcaggcgtatcgggagtgctgagttcgctggttttgcgtgtgatttcgtcgcggttcatgggtgtgtccttatgtttttcatgaccattttcgtgactccacgaaaatggtcaaagcgaataattgcaatggttttgaggtatgggcgcgctccgcccaactggtctgtcttcgtccgccttttcgaccagatacctcatggagcacaatgccaacgtcgctaccgttggcccagcaaatattcttagacgacgccccgaagtgaatatctatgcggctttcagaatatcaaagagcgtggagtgtgtgcattatgcgttccaaaaatagtttctagtagcgaattgtttacggtgtgagatattcttggggtgtttgcggcgctctgccgtgtggcgaatgggaatggatggtgctcttatgggatttgagcaggaagcagttagtgaactgtatgccagcgtgtggggcaatcgttcgacaatgcagagggaattcactcgtggagcccatggtgagcagttcgtgctccgggagctgtccatgaaggggacgcaaacgccatcgcaattggcatcggcgctgcaggccagttccggccgcatctccactgtgctgtcgtctctggagaaaaaaggctgggtcacgcgtgacattgattccaaggatcggcgcattattcgcgtgaatctcactgattccgggcgcgagcagtctcatcggatgatagaggaaatgcgttccgcgatttgctggattttctcgcaaatgggggagcggcgcacgcgcgaattcgttgacctggtgtctgagttcaccatatatatgtcgatttgccatccggggcggcctcggccgacggctgaacaagtgcgtgaggcattcgtggagcgggacaagcgcgtggctgaacacatggcagctaagcgcgcggagaactaatcggcaaggctaattgaggacgctcacagcgaacatacagaagtgcgtataatatctcacagtgtaagtaatcaaacaatggaaactattaagacatcgtgaaccgataatcaccgataacccagccaacttaagaaccaatcgtcaataaccaataaccaacccaaccaacacaaggggaaaccaatgcttcgcatcatgaaatacctctccaaagcggagatcggtcagatgctcatcgccctggtgaccatcgtcgggcaggtctacttcgacctgaaactgcccgactatatgtcagacatcaccacgctggtcgagacgccgggcagcgacatgaaggacatctggatcgcgggcggcaagatgctgctcatctcgctcggatccgtggcgtgtgccatcatcaccggctacatcgctgcgcgcgtggccgcctcgttcacccagcgtctgcgctcgctcgaattccgcaaggtcgagtccttcggcccggccgagatgagcaagttctccaccgccagcctcatcacccgttccaccaacgacgtcacgcaggtgcagatgttcatcaccatgggcctgcagctcatcgtcaagtcgccgatcatggccgtatgggccgtgtgcaagatcgccggcgaaggcttcgaatggacgctcgccaccggcatcgccgtggcggtcctgctggtgtccatcaccgtcatgatggccatggtcatgccgaagttcaaggtcatgcagaccctgaccgacaacatcaacctcgtggcccgcgagaacctcaccggcctgcgcgtggtgcgcgcctacaatgccgaggactaccaggaagccaaattcaccaaggccaacaaggacctcaccgagacccagctgttcaccaaccgcgtcatggcgttcatgatgccgttgatgaacaccgtcctgaacggcctgatgctcgccgtctactggatcggcgcttacctcatcgacgccgccgggctcaaggacaagctcaccgtgttctccaacatggtcgtgttctccaactactccgtgcaggtcatcatgagcttcctgctcatgagcatggtgttcgtgctctggccgcgcgccgacgtgtccgcgcagcgcatcatggaggtgctcgacactgagccaatcgtcgagaacggcaccaaaaccgccgccgacgtggccaaaaccggccagaggggcaccgtggaattccgcaacgtcagcttcacctacccggattcgcgcgaggcgatgctggaaggcatcaacttcaccgccgagcagggccagacggtggcgttcatcggctccaccggctccggcaagtcgtctcttatcaatctcgtgccgcgcttctatgacaccagccaaggccaggtgttggtcgacggcgtggacgtgcgcgactacgacctgaaggccctgcgcgacaagatcggctacgtgccgcagcagtccgtgctgttcaggggcaccgtggcctccaacgtgagctacggcgatcagccgggcgacccggcggaggtcgagatggccgatacctccaccccggccgggcgcaagcgcgaggccgcgttgatcgccgctggcgaggccgcggaaggtgccgatataccggccgagcagctgaatcgcgtcagggccgccgccgacgtggcgcaggccagcgagttcgtggcgcgcatggacggcgggtattccgccgcgatcgcccaaggcggatcgaacgtgtccggcggccagaagcagcgcctgtcgattgcgcgcgcggtgtaccgtcacccggaaatcctgattttcgacgactcgttctccgcgctcgacttcaagaccgaccgcgaagtgcgcgacgcgctcgcccgcgaggccaaggattccaccaagctcatcgtggcccagcgcatcggcaccatcatgaacgccgaccgcatcgtcgtgctcgacgacggcaaggttgtgggtcagggcacgcacaaggaactgctcgacaactgcgacgtataccgccagatcgccgaatcccagctcagccagtcggagcttacggcgtaggggggggcggcagcggtagctccccatgtcaggggctgagccgtaaagggaacagcccagtgggctgttcccaggcgaagacgagctgataagcgagcgaataaaacagcacagctgactgaggggtagtcgcgtacggcttctctccctccggcgcttcgcgccacctccttcatcagagggaggtcaatacggacttttaaggagtaaaacaaatgccaagaggaccaatgggcggcaggcgtgccgtcgaagagccccatgatttcggcaaagtcatgggcaaactcgtgaactactgccgcaactatcttcccgtcatcatcatcgcgctcatcctgggcgcggccggcaccgtctgccagatcgtcggcccggacaagctcaaggacatgaccaacgagatcgtcaaaggtctgcccgccatcgttaacggcagaccggtgatgaactcggtagatttcggcacggtgggccacatcgcctggactttggtggccctgtacgtgggctacgccgtgctcggctacgtgcaaagctggatgatggccaacgtcacccagcgcaccgcccagcgactgcgcgaatcgatctcggtcaaaatcaacaaactgccgctcaaatacttcgacaaggtcagctacggcgacgtgctgtcccgcatcaccaacgatgtggacgccatcggccagacgctggggcagtcgctcggctcgctgattacctcggtgacgctgttcgtgggcgcgctggtgatgatgttctacaacaacgtgatcatgaccctgtgcgccatcggtgccagcctcatcggcctgatcatcatgatggccatcatgaagtcctcccagaagtacttcgcccggcagcagatggcgctaggtgacgtcaacggccacgtggaggagatgtacgccggccacctcatcgtcaaggcatacaacggcgaggccgattcgatccgccgcttcgagaagtacaactcggacctctacgagtccggctggaagtcgcagttcctctccggcctgatgatgccgctcatgaatttcgtgggcaacttcggctacgtggtggtgtgcgtggtgggcgcggcgctcgcgctcgacgggcagatcgagttcggcgtgattgtggcgttcatgatgtacatccgcctgttcactcagccgctttcgcagtttgcgcaggccttccagaacctgcagcgctgcgcggccgccgccgagcgcgtgttcggcttccttgaagagccggagatggaagacgaatccggcaagcaggccctactcggcaagaactacatgggcggccacgaagtgaagggcgacgtggaattcagccacgtgcagttcggctacgagccgggcaagccgatcatccacgacttctccgcctccgtcaaggccgggcagaaggtcgccatcgtcggcccgaccggtgccggcaagaccaccatggtcaacctgctcatgcgcttctatgagatttccggcggctcgatcgcgattgacggcgtggacaccaagtccgtgccgcgctggaacgtgcacgaccagttctccatggtgctgcaggatacgtgggtgttccgcggcactgtgcgcgagaacatcgcctactccaagcccggcgtgaccgacaagcagatcgaggatgcgtgcaaggccgtgggcctcgaccacttcatccgctcgctgccggacggctatgacaccgtgctcgacgacaagtcgtcgctctcccagggccagaagcagctgctcaccatcgcccgtgcgatggtgcaggacgcgccgattctgattctcgacgaggccacctcatcggtcgatacccgcaccgaagagctgatccagaaggccatggacgcgctgaccgtggggcgtacgagctttgtgatcgcgcaccgcctctccacgattcgcgacgccgacatgattctcgtcatgaaccacggcgacgtgatcgagcgcggcacgcacgacgagctgctggcggcgggcggcttctacgccgacctgtacaacagccagttcgcactcgctgactgacggattgtttcctgcgttagcggattagcggattagctatactcggctcccctctccgaggggagccgtcagcgtagctgactgaggggagcaacccatcggtccacccgagggatgtgatactgatgatttcgtacattagtgtgtgaaaaagccgccgggaaaattgggggattgggcggcggtgcggttggcgttgagaatggcgcattcgaaggggaagtgagcgcgcagctgggtggccggggtggtgaacagggcggtggcgaggccgtcggccagtgtgacagggacgtgtgccgcaacggtgttcgacgaatcgtcggtatcgcggtttgccgttgtcgaggcattgctgccatgcgtcgatgtcttcgtggttatggcgctcgatggcggcgtgacggccacccatgtggcggctacatcgtcaaccggtagtccgtcgatggcgttgagcagatggtgaagttggtgacctgcggcgtcagaccagtggcggcggctgggggagctcgcgcagaatgcgccgtggctgatttcgaccgtacctacggcgttggccggatcggcaggatcttcaagggcgatggtgattggttcgtccgtgtgcactagcaaatcacccccggcgtcgatgacgtattgaatgggttgagggtgacccgcgccatcacccaacatccccgcaagcaaatccaccaaataccccttaccgcacgcgccgaaatcgagcgcgaccggtccgcgcgtcaccagtgttgtgccatgccgctcaacgtcggctgaccaaatggctcgtccgtggatcgcgcctgcatgttcagcggcatctggcgcaggcgtaaacgaatacgactcgtcatagccaagccgaatcaaatcctcgcccacgcacgggtcggtcgccccatcggttgccgcaaacaggcggtcgtacaggccaaacagacccgatgcccagtcgggaaaatcgaacgtgccgccatgtgcggccgtgcgcatccggccgacgatggaatcatcgcggaatcgagataatacaacctcatattcatggatgaacgagccaatacgatcgcgtatctcatcgtccaatacgctctcggtgtgcaccagtaatccggtccccaacgcatcaggaaaagcgtatacgtatggcagttgctcggtcagacttgtcatgcccactatcgtagagcgcatggtgtgccggtgtatactggattttgacactgtgtcaatgttgattcggaggttgtgagaatgggcaatgcgactacagcaagtgtaacgggtgtgcaagttgcaccggcgaagtcagccatcagagatctccccatcgccaaagtgtgggcgtttgcggtcggccagttcgggtgggcgctgctttccggcatcatctccaactggctcgtgtatttctaccaacctgaccaggagaccatctcccaaggtcagaccgtattcgtgccgcagggcctggtcgttctcggcatcgtgaccgtggtgggcggcatcaccgccttcgcccgattcttcgacgcgttcgtggacccggccgtggcgtctctctccgaccgttgcgacgccaaatccggccgccgtatgccgttcctgaaattcgccgccctgccgctcgcggtggtcaccgtactcgtgttctggagtccgatcaacggcaccggctgggtgaacgcggcgttcctgttcgtcaccgtgatcggctactacatcgccctcacgttctactgcacgccgtacaacgcgctcatcgccgaactcggccacgactccaagcagcaactcaccatctccaccgccatctccttcacttgggtggccggcacggccatcgcgtacgtggcgccggtgatttggggcgcgttcgtgccgatgatgggccgtatcaccgccatccgcgtgaccttcaccatcatggccgccgtggcgttcgtgtgcatgctggtgcctccgctggccatccgcgagaaggactacgtcaactcccagcccacctccgaatcggccatcgaatccctgaagcagacgttcggcgacggcgaattccgcaagttcgtatgctccgacgtggtctactgggtggccatcaccaccttccagaccggtctgccgttcttcgtgaccagcctgctcaagctgccggaaaccaccacgaccatctacttcgtgctcatgaccggcgtctctgtgctgttctatctgccggtcaatattctggccaataaggtcggcaagaagaggctgctgctggttgccttcgtgatcttcacctgtgcgttcgcatttgccggcgcccttggttcggccgtgctcggcttcattccggcgatggcccagggtttggtgctctcggtggtcggcgcgattccgatggccgcgttcggcatcctgccgcaggccatcgtggcgaatatcgccgacgccagttccaagaccaccggccaggaccgtcagggcatgttctacgcggcccgcacctttgcgatgaagatgggccagtccgtggccatgctgctgttcaccggcgtctccaccatcggcatggcgtccggcgcgggctaccgcatcgccgccgtgtgcgcggccgtgctgtgcggtctgggcggcatcgtgttcgcgttctacaacgaaaagaaggtgctgggcgtgctggagacgtgatgacgttgccgggtgccgccgcggtatccatgcggagcggtgtgggtgacttgccccgtctgcgacaccgaaacgttaccgtgtcgacacgcgtgcgacacttcggcgtcaaattgcgtttgaccgtactccgtactatattgttgcgagttgctttgcggagcaaagtaacatccaaggggctgtagctcagttggtagagcgcttcgttcgcatcgaagaggtcgcggtttcgactaccgtcagctccacgagaccctctgcattcattccaccgcagagggtcttttcatttgttttcgttgaaattctgccatctcgcgtttcaaggggctgatttggggtttgccggaggtctacttgcgtttcgaggggctgatggtcaagtagatacgccgccaaaatggcggaatagcgttgcgtcaaagccgtttgtatcggtgcttcaccggatgaggagccccttgaaacggaagtagacctccggaacatgtgaaatcagcccctgcaaagggagaatgcctcgatttcgccatggattgtcgtggattgctctgtggcatgggcaatactgggagtatgacaagcgcagatgagttgaatgagcagtatgacgctgacggtagcgtgacgcaagtgcctgaacgcaatgatgaagttcatgccggcgaatccgccgtcgcccaatcccgcgaatcggccgtgaccatccccgccggcaccgtggtgctcgccgccaccccgatcggcaatgtcggcgacgcttcagcccgtctggtggccctcttggaacgggccgatatcgtggccgccgaagacacgcgccgcctctacgatctcgcccgtcgcctcggcgtctatgtgaacggtcgcgtcatcgcctatcacgaccacaacgagcgcgacaaggccgacggcctgctcgaccaggtcgaaaccggcgccaccgtgctcgtcgtatccgacgccggcatgcccaccatcaacgaccccggcttggccatcgtgcgccgtgccattgaacgcggtctgcccgtcacctgcgcgcccggcccctccgctgtgctcgacgcgctcgccctctccggcctgcccaccgaccgcttctgctacgaaggcttcctaccgcgaaagcattccgagcgcgtgcagtatctgcgcacgctgttgcccgaacgccgcaccatcgtgttctacgagacgcctcatcgcattgccgattcgatggacgatctgctggacgcgttcggcccgaatcgcccgatggccctgtgccgcgaactcaccaaggattatgagcagattcgtcgcggcccgattgacgagattcgccaaagtgtgattgatgatccgccccgtggcgagatggtgctggtcatcggcggcgcgtccaacgaggaggccgaagcggccgcgcccagcacgttgagcgtggatgacatggccgtgctctccatcgaccgtgctttggaggacggcctgcgtatcaaggacgccatcgcgcaagtggtgcaggagcatccactggctgacggatcgttggccaatcgcaagcaggtgtatgcggctgtgctgaaaatcaagggatagcgcagcagccggcgattatctccccgttacgtttccatcgactcgaacaatatttccaacgcctgccggaccccgggcccaccacgctgcgagaccaattccagcaaaggtgcgtcggctttgggattggcaaccagccatttacgcagttcgggcacgtgatatgcgatgtgccagagcacggcaacatccgtatcgggcgaacatgccaccgcgggcgtaagtctgatgggcggttcaggcggcgcggtcatatccgagattgcgcgcgatgcggattcggatgagtgtgccgccgcctcgtggcgaggcaaccgttgcgcctgccgcaaatgccgtaaacggtgagcggcatggcggcctctgcgatggcctctgacaatgaaccccctcgtcatgcgcattgctccaaagccggttcgtccatctcctgctgtaccgattcaaaaaacatgcgtgcgcgtccggcgtacttgtgatgccgatgctccttgacgatttgcagacagtcgtttggccgaaactggtacgcggacatcagctggcacaccagtgcgttgacggtggaaggatcggggatgtcttcaggactcatcaccaggtcgcaagccgtacgggctggcgtggtgacaggcagcccgccgagcttgatgatttgctccggcaacgtcaatcttttgaatacgcggatacggcggctgacggatgccgagcggaagtgcgatgtggaaatcacgtctatggtactcggaaagtcggggcctcccagccatacccaagcggcggtcatcgaacacaccacagtgccaaacggggcgacctccgcgacgattttcgcgcgaccatacagtgtgcccgaatgctcgatccagtagccggcggaatcgtcgagcttatgtaacgtgccgaaggcggccagacggttaaggctgagcggtcccggcagatccttggtaaacagtatcggcggcaccgcaggctgcgcggttgccggcgaggcgactgttgtgatgtccgtcatcggacctgctgtgatatccatgaccgaacaatatgcagaaatgcggcttgcgcgccaccggataggcgaaaacggtggataagtgcataactttactaggtgtgcaaatgatgtggataactcggtggatattggcaggcggaagtgtgtgcggatgtgcgtgggcgtgcgtacggatgggtgcgcggatacgtgtgcgaatgcgtatgtggataagcgcgcaagaggtgtacagataagtatgtggggaagttgcgggtggataggtgagtgggatgaggatggcggcgcggcggctatccgggcgtgtccccgccgcgccggataatcaagccttatgagtcatgttttggtgaatgttgcttggccgtatgcaaacggcccccgtcatatcggccacgtcgcgggatttggtgtgccctccgacgtctacgcgcgctacgagcgcatgaagggcaatgatgtgctcatggtgtccggcaccgacgagcacggcaccccgattctcgtcgaggcggagaaggaaggtctcactgcccaggaactggccaaccgttacaaccgcgtgatcgccaaggatctgtgcgacctcggcctgagctacgacctgttcacccgcaccaccaccggtaaccacgagcacgtggtgcaggagatgttcaagcagtgcttggagaacggctacatctacaagggcacccagcaggtggcgattagcccgtccaccggccgcactctgcccgaccgctacatcgagggcgagtgcccgatttgccacgccgaaggtgcgcgtggcgaccagtgcgacgcctgcggcaacgagctcgacccggacgagctcatcaaccccgtctccaagattaacggcgaaaccccgcgcttcgagcagaccgagcactacttcctcgacctgccggcgctcgccgaagccaacaaggcatggctggagacccgcaagggctggcgtaccaacgtcatcaacttctcgctcggcctgttcaaggaagtcaagccgcgcgccatcacccgtgacatcgactggggtatcccggtgccggtgaagggctggattgacaacccgaacaagaagctgtacgtgtggttcgacgccgtgatcggctacctgtcggcctccatcgaatgggcccgccgccagggcgacccggagaagtggcgcgaatggtggaacgacccgagctgcccggcctactacttcatgggaaaggacaacatcaccttccactcccagatctggccgtccgaaatgctggcgtacaacggcaagggctccaagggcggcgaaaccggcccgatgggtccgctcaacctgcctgagcaggtggtggccagcgagttcatgaccatggaaggcaagaagttcagctcctcccgcggcatcgtgatctacgtcaaggacatcctcgcccgctaccccgtggacgccgtgcgctactacatttccgtggccggccccgaatcctcggattccgacttcacgtgggccgagttcgtgcgccacaacaacgaggagctcgcctcctcgtggggcaacctggtgaaccgcgtggccaacctcatcaacaagaacttcggcgagattccgccgctggacgaggattcgatgaccaacgaagaccgtggccttctggaagagagttccgccgcgttcgacgtggtcggctcctccatcgaaacccaccaccagaagcacgccctgtccgaggcgatgcgtgtggtcggcgacatcaacaagtacatttccgccaccgaaccgtggaagattaaggacgaccaggctcgtctcggcaccgtgctgcacgtggccgctcaggccgtgtctgacgcgaaccacctgctcgcgccgttcctgccgcactccgcacagagggtgtgggaggcgctcggcggcaccggcaccttctcgccgctgcctgagctcaaggaagtcgaggatctcgacaagcccggcttcacgtatccgatcatcaccggcgattacgagctcggtgtgaacgtgcacccgtggaagagcgaggcaatcgaggtcggcgccgtggtgcctaagcccgcgccgatcttcgccaagattccgaccgaggccgtggaagaggagctggctcgcttcgatgaagcgttggctgctcgccgtgccgccgaagccgagcgtctggccgccgagaaggccaagctcgccgccgaatgattcggcattgctagctcgtagctgacgggccacctcgcacatgaagtgctgcggggtggcctgttgccgtatgtgcggccaagccccgacagagcgaggccggttgtcggcgggcgtcacaaattcgtcacactccgccaagacttttcccagacaagcacatcaattcgccaagcatggagcggttatatagaagatgtcaacggaatgaagttcataccggtggcgaggttcttcgaaccccataactgaacccttcttctctcttctctctcacccggcggccccctccgccgggtttcttttttttaatgctgggaatgccatgggccgcatattgaaaaaaggattatggcagagtgctgtctgtttacaataaggcattgctgttctagaaaataacaaagaaggggggactgatgatgtataccgtcacattttcgggcaacctgactcaagcggaatcggccttggtcaagcgaggcgccatacagatcgccgcgttgctggccgcaaaaatcactggccgcgggctcatcatcaacgacggtgacaccgaatactcatgggatttcatcctggtcgatgccagcagcgatgagcggcacacctttgacgagaggctattgcggatgctgtccgactacatccacgccggtttccccgatgccgtgatccgccacatccagcacgaggcaccaaagctcagtaaataatattggtcgcgtggtgagtcccatacttccgtcggaatatcgctatcgcggtatggtcgcatgcctgttgagcattgaagcgttcgatctatgcgcagttgatgttccggtgatgacggcaaccgattgacgcgattaccgggacagatttcgctgtcccggttcgtgatttcggcttctttttgggaaccgggacagcccccccccttgtaaacgcccattatccgtaatcccaaaaccccggaattccgccgatgtacgatggcgaatattgcacggtggggtgataggtgaatgaaattttgtcttggttgctcaaaaaggggcgaaatggagaaccgggacagcgaaatctggcccggtccacacataaatcgattgacatcgctaccgggacatcggacacggacaccgagtcgcgcagcgtcggcgcaacatggatactgtacgactttcgcgataaacgttatattcttcgtcgcctcctccgggcgatctcatcgagtggcgttgccgtcaaagtgaaatcgaatacggcacctcgcaatgccaactgccgcccgacccggtaggcgagttcggcttgggatggctcatcggccatgttcgtggcagtggcgatgatgacgatccaatgatgatgtcgcagcagttcgcgcttgtcgttgtcccgccgccactggtttttgtcggtgcgatgatgatcgccgtcatattcgatggcgacgcgaaaatcgggccaagcgagatcgagcgttatcggcgcaccgttgctgaatgtcgcgccgggcaccgtgtaatttgtcacggctggcggaagcccgtatttcgtcgtcgcgatgcgggtctttgattccatcggagagtccacgcggggcgtaatgaatgcaagagcgatcatgcacttggattttgcgttgaatttcgggagtccagtgacttgccgcacgaagtcctgataaatgccgtcagcagtgcggccgttcgccagacccggcttgcgggcgattgccgtaaggattgcgtcgccaagtatgaccagcgattcgagcgatatatgagcggcgagttgtgcccaagtgtgtatcagatccagtgcgtacacatgtttgttgatacgcacattgtgcgcatcgctcagcggcttccagatgtgtggtgtcgttggcggcacgatggcacgtattcgtgtgcggtgtgagtcggagacggtatggagctcggcggggtcgatatcgcaatccttgggaagcggcacggattgcagtatcagcgatgtggtcatgccgaagagcaccggttgcccgagctgttgcgcggcgtccgtgcatcgtttaagcatttcccgcttacgttgggtgagggtttcgctcatagcgggcgcagtgggggttgccatacgcggtggtgagtatggctcgggcttgacggcgtgcgtggacgcagcactcggtgccgcggcattgttggtccagccgggtggttcatcgtcgaatacgccgggtggcggggtgggaaatccgctgttcataacgccaccgtagcgtagcggtcgcgtgttcgccatgaaaaacggggtatgtggttctagcttgctgaggatgtggataactctgtggataactaaagtgctcctatgttttgctcactctgtgaggagtcggcaaaacataggagcacttcagccgcggccaatagacggaatatatcagcggcagcgacgggtgaggggctgccagggatcgagctcgactggttcggcggcgagcagggcgcgggtggcgtcatcgaggtattccttgcggatgatgagctcggtaacgtagcggtcgaaccaggcgtcggacatgacgtagtagccgtccttgccggcgtccttgccccagctgttctccaccttccagcggttcggcttgccgtcctcgccgaggttcacgccggtgaaggtcatggcgtggttgctcgggctgtcgccgtattcgaggccgtgggccttgtcgccagtgaattcagtgccgaacagctggtcgacgcgcaccacggactggtcgaagaaaccgtccttgcgcagggcgaactgcgtgcagtcgcaggcgaaccagatcgggtggccggcggtgagctggtcaagcgcggccttcttgaacacgtccagcggcacgttgacgaactccatatcgccagcctcgaccacgttcgcgctgaagcggatgcggtagcgccggttgaacgggcggttcttgagtggggcgttggccagcgtcgcgaaatcgttgacgtccaccggcacgtacttcttgtagaactcaagcggggtgatgccgatctcgcgaatctgcgggcgctcgtccttgccggtcttgtccttgttcttatcgcacttgcacgccttggcgtcggacttgtcctcgcacttgcaggattcggccttgccgtctgcgtcggcctcggcgtcatccttggtgcgcgcgaagaagtcgaacttctccggcggctcgccaagcgacacggcgcagatgcggtacacggtgcccatgtactcgtccttcagcgtgcgcagctcgtcctcgccagcgcccgcagccgaacggcggcgcagctcggccgcgaactcgcgcagcttggagttgaggtactgcttgaaatcatcggaattacgggagttctcggactccgggtaggcgctcttgggcaccagaccgtacttgttcaccagcgcggcgaacatctgccaccagccgccgtcgtcggacgggccccagttgatggcttcgaacagacgcgaatcggtcgcctcgtcgagcgtgcgcagcacgttctccagataagtgttcgacttctccatcgcgtcccagaagaacaggtaggtctcggagaactcgaagtcctcaagattccagcgatgcataagctcgtagcgcagcgtgttcagggaggcgaacatccagcagcggccggaacgctcctgattggtgatcgaaccttgcttaagttcgatggagaagtcgcgcggcagcgcacgtacgccgcgatagtcggtggccgccttgagcacgccggccgaaaccgccgcgtccgccgcgatcaggttggcgcggtctttgttgaagtcttcggtgtacgtacgcagaagttcgggtttgatggcccgtgcgctggcgtttgctgtcatgatgattgatcttccattcatgtaggcgacgtttgtggtccgtcggtagtataagtcgccgtgtattcgtcgggcgattcaccgggcgaaatcgtacgggcggatatgcgccggcgattccaccccgccaacgatttgtccaccttgctgctcgcgcgggcgcacgtatcatatgtaccgatacatattgttgacgaatgtcgcatagtccaaaggagtacgtcatgacttcgctgcatagcaagccgctggccctgaaaaacgtcaccgtcaccgattcgttctggcgcaccgagcaggaactcgtgcgcacggctgtgattccctatcagtggaacgccctgaacgataacgtccccggcgcggcccccagctactgcatgcacaacttcaaggccgctgccgcgcaaaacaagcgtaaggatacccagggcaaggcgttcgtgccgccgaagtacacgttccgcggatttgaggcgctccccgaagacccggccaatcccgacccagacaagttctacggcttcgtgttccaagacaccgacttctccaagtgggtggaggcagtcggctattccctcgcccattacccggaccccgcactggaacagaccgccgaccaagccatcgacgtcgtgtgtgccgcccaactcgacaacggctatctggacacctgctacattctgaacgacatggatcgcgcgttcaccaatttgcgtgatcatcacgaactgtactgcctcggtcacctcgttgagggtgcggtggcctactaccagggcaccggcaaagacaagttgctcaaggccgcctgccgtttcgccgattacgtagacgagcgcttcggtcgcaagccgggccagctgcgtggttaccccggtcatgagattgccgagatggctttggtgaggctgtacgaggtcaccggtgagcaacagtaccttgatctggccgaatatttcgtgaccgagcgcggccggcagccgtacatcttcgatattcaggcagacgagaacgcaaagcgcgacgccgacgccaactacaaacccaacacggaccccaaccggtacgcctatcaccaggcgaacaagccggtcaccgaacaaggcgaagccgtaggccatgccgtgcgcgccggctacttctactccggtctggcggacgtggcccgactgaccgacgaccaggacctcgccgatgcggccgagcggctctggcgcaatatcgtcgataagaaactgtacgttaccggcggcatcggcggcacggtggacggcgaggcattctcctacaactacgacctgcccaacgactccgcctactccgagacctgcgccgcgatttcgctggcgttcttcgcccgtcgcatgctcgagctcgcgccaaaggccgaatacgcggacgttatggaatccgcgctgtacaacaccacgctggccggcatggcgctggacggcaagagcttcttctacgtgaacccgctggaagtcaatccgtatgcctgccataaagacagccgcctgcgccacgtcaagccggtgcgtcagaagtggttcggctgcgcatgctgcccgccgaacatcgcccgcatcgttgagtcggtgcaggaatatgcctacacggttgccgaggatggcggtacgctgttcacgcacttgtatatgggcggcgtggccaaagctgagctgaatggtacggctgtggagctggatgttacggcgaacctgccgtggcagggcgatggcaaggctgtcgtgcgcttgggcggtgacgctgctggcacctcggctcaggctcctgctcgctttacgctggccttccgtctgcccggttgggtgggcgatgagtccgctgctgccgccgcgattacggccacgggcgagtctgagtctggggccgatggttcccgcgtgacccgcgaaatccgcgacggctacctgtatctgaccggcgaatggcgcgacggcgacaccgtgacgttcgacttcccgatgccggtacgtatgctggccgccaacccgctggtgcgcgaggacgccggcaaggtggcgttcgtgcgcggcccgatcaccttctgcgccgaggaaaaagacaacggcgccaacctgcacctgctgcacgcggatacggaggcactattggccgacccgagcgcggccaaggtcgaggagttcgacttccacgccggcgccaagggcatcgacgacaagggccagggcgaggtggaagatgtgacccgccgcatggtgaagcttgaggtgccggcttggcgcgagccgttgccggctgctgtggccgccgcgggtgagggcgcggccgacgtttcggcgttcgcgccgctctacgccgtgtacgcgccggtcaagcgcgagcccgccaccgccacgctcatcccgtacttcgcctgggccaaccgcggcgaaaacgaaatgaccgtctggctgcgcggctgatatttgctctcggctactctggtagccatgggcatcacgacatgtcggctcgaagggccggtggacttttactcggtcgggcagtttgtgtccggaccgggctggcgccatctgcggcgcatcatcgacaccttcgagctgatgttcgtgcgtcggggcgtcctgccgatgcgggtgggggagcggaccctgcatatcgaggccggccaaatcgcactcttgccgccgaatgtggagcatgcgggcgccgacatcatcacgtctgacgtggacttctactggatgcatttcaaattgccggatgcgcgcatgctccccgatgacgcgggtctgccgcaggacgaccattgcctgttgctgcccgatgaacgcaccctgcccgaccccgaccggctggcggtgatgtgtgggcagctcatcgacatctatgcgcgattcggcccgtattccaacgcttactgcgattacttcgccaccggcctgctgctggaagtcagcgcgcaggagcggctgaaggcggacttcgccacccatcgtacgctcgccggctaccggggcgacggcaagcccatcaccagtgccgaccgcgtccggcagcaacaggaatgggccatgcatgtcgattcggccggtgccgctggcgatccgtccggcctggcgccgatgctggccatccgctcgtggattatggccaatgccttcgacgacatcaccgtggccaaagtggccgcgcgcttccactattcacccagctatctgaccgcgatgtaccggcgcgtgttcggcgtgggtgtggccgagcagatcatcgaatatcgcatcgaccgcgcgcgcgaactgctcagctccggcacttccagcgtggcggatattgcgcgagaagtgggctacgccgactcgaagtacttcatgcgcgttttcaagcgccgcactggcctgacccctggccaataccgcgacgccttccccgctcgcctctacaacaccgtgtgattagggaaggtcatggtcctaaccctaggaaaagtgcgcatgggcgccaccgccacatgggagcgctgggaacggtttgatgcatgccgaaacctcgcacgtcacgccgcacggcacttgggcagtgggcgcggcagtcgggaatcgccgccctatttcagcgtttcagcgttacctgtttgctgaaccgacggtggactcgcgcggaaccagtgcgtatccaatggtggcgcgcgtggccggcatgccagcgtattcgtcggacctgccgtcgccctggtcgcgctgctccacgcggcgggtgatcatatcgagcgcgaattgggcgagctgatcgagatccacttggacggtgctcagcgtcggtgtggtgtacgagccggccgtggcgccgtcgaagccgatgactctcacatcgtcgggcacgcggatgccgtagtcggcaaggcctcggattactccgaatgcggcatagtcgttaatgcagaagatgccatcgatggccggggtgcctcccgttgcccgcgtggtgcccggggaacgggactcagcagtgtcatcagccgattgcgcacgagcctcgagcatcgcctcggcgatggcatgaccggcttcgatgccgctgtcgctaccgtaaccaatgaagttcgtcgattcgtcatacggcagcccggcgtcaagcagtgcgccgctggccccgcgtagacgcaaaccgctggaactttccacgtgcgccagttcggttcgtggcgaatacccgtcgccgacaatggcgatgcggtggcatccgcattcgatgagatgctgcactgccgcccgcgcgccgtcttcgttcgggaaattcactgtatcgaacgtgggcgtttcctcgcaggcgtcaatcagaaccagcggtcggccgtggttgatcgcggaaagcggcacaccggcattcaggcccgaagcgtggataatctcgccgtcgaacaactgcccggagaacgggttgttggccagcgcgtgtttggcggcatccggagagtaccgggtttgctccacgaacggcgtcagcccgcgcgcggtggtttcggtgacgagcgattcgacgagtttggagtagaacggcgaatcgaattcgttgacgatgatgtggatgatgttgctgcggccggacttcagcatgctggccgtcagattgatgcggtaatcgagcttttcggccactgccagcactttggcgcgagtggaatccttaacacccggcttgccgtgcagcgcattcgaggcggtcatgggggagaacccggcggccttcgctacgtcgcgcaatgttggtttgccgctcggcataacgtcacctcatgtttcgcctgtgatgggcattggacaatgcccgtaatgcttccaatggttgtaacggtattcacaacatcgtgttttggcaaatggtggctgtgcgccggaatcgctgaaaatgctgcgcttaggcgatgacgcgccgagcgtaacatgcgcttgcttgatatcgttccggtggaagaatatgtaacggtacatacgtcggtgtgccaagaggccatgaagttcgtcgtacgttgggatgggactctccgggggagtggcgtcactcttcacctatccgtacgtgcgcgatgccgattggtttgcggctggcgtaccgccgtatggcaacttatgcgaatatcaacgaaagcaggatacgatgacggatcttccgcagagccttcctcaggcatggcgtccgccgatgggctggaacagctgggattcgtacggcacgactctcaccgaagacgagctgctggccaacgcgcggttcatggctgaacacctgaaaaacgccggctgggatacgttggtcatcgacatcgactggtacgacccgaccgcccgcgcacatggttacaacgacaacgcgccgctgattctcgacgaatacggccgtcagctgcctgacccggtgcgtttcccgagtgctgccggcggcaagggattcggcccgctcgccgccgccgtccacgaactgggcttgaagcttggcatgcacatgatgcgcggcatcccgcgtattgccgtggacaagaacctgcccgtatacggcaccaactacaccgccaaggacgtggccgacctcgaccacgtgtgcaagtggaatccggacaactacggcctgaaccaatcccacccgggcgcgcaggcctggtatgacgcgcagctcgacctgttcgcctcctggggcctcggcttcctcaaggtcgacgacatgcagaccccgttccactccgacgaaatcgccgcctatcatcgcgccatcgccaaagccgaagccaaatacggccgttcgattgacctgtctctctcgcccggcggctgggtggcgacgagctacgtcgacttcctgcgcgagaacgcccaaatgtggcgtatttccgacgatctgtgggaccgttgggaagacatctaccagcagttcgcccgcctggcccgctgggcgccgttccagaccaccggccactgggccgacgccgacatggtgccgttcgggcacataggcctgcgcgccgaacgcggcgacgaccgccaatcccgccttacgctggacgagcagaagacactgctggccctatggtgcatggggcgtagcccgcttatggtcggcggcgatctgcccaccagcaacagcgacgccatcgcgctgctgcagaatcccgcgttgcgtgaggtgcttgccggctccaccaataaccgcgagaccgtgcgcgaacggatttttggcaaatggtgggatgagagcacctaccgtggcgagttcatcgtctggtccgccgacgcagccgattgggctgatggcacacgttccgcgcatcacggcggccattacgccgcgctgttctggaccggcagcgacacatacgagatcggccgcaacatccagctccaatccattgtggggcttgacgcccgtaatgacgattggacgctatccgatctgtatgccgacgcgccgggcgagcccgccgacgtgcgtcttgaaggcgtgggtgccgaccgcgtcatcaccggcacgattccgccgcacggcgtgctctgggtggccctggaccgacgctgaaaccgaacctgcctccgccaaccaacctcctgaaccgaccgcccgaatcgtatggagaaacctgccatgaatgcgaacatcgcaaacgaacaatccccggtagctgttccgcccgcaagttggttcctacgtgcgttcgctggcgttctgacctgtagtctgtctgtctctgtctgttcgttgcttcgccttgcttgcgttttgtacgttttatctgtttcgtgagtttcgtgcgttctgcggatttcacgcgtttcgcgcagtgccgcacgctgatcaccattcagcgtgcggcacttttgcatatctcacgtgttgcgggagatgccgattccgtcgcacaatacgtaaaacgtgaatgaaccactcactatgctgggttgtttgagcgtgatatgacatgcgccactttcccgggaatgcgttgcgaattggacctgttcggaggtgtgcagcgacgcattccggggaatgttgcgcttagagagccgcgtatcgttgctaatgcggggaacacgcagagttgcgggccgttgcgattagacgcaggtcgcctagactagtacgcgtttgcgaaagtcgaacgtgcttcgaccgatgaaggagagcttcggtcatgcggccaatgacaggcgcagtgcgaagcacggctgatcgtgaatcgcggcggcagcgattgccgcgtgcggcgcaggagcatgccgcaccataccacaagcaaacaatccccaagaaacggtgatctcctcacatgtacgtcgatccgggaatcaataccagcgcaagcaatctcaaatgggtgctgccatactgcaaaccagacctgccccgcgtggtaggcgcgcttctactgttcatcgcaaataacacgatggccctgaccattccgattctgtccggtatcatcgtggaccgcgtcatcgtcggcggacatgccgacgaactgccacgtctgtgtggactgatgatcctcatgaccatcatccgcgtgggcgcgcgatacggctaccagatgtggatggagcgtttcggccagaactcggtctaccgcctcgtctccgacgaatacgagaagctgcacgagctcgacttcacgtatttcaaccacacacgcaccggcgacatcatgagccgcctgacctccgacaccgacgcgatccgccactgcctgagttgggtgagctatcagattgccgactgcgtggtcatgttcgtgggcgccctgtgcgtgatgttcgccatcgattggcgactcgcgctcgtcctggcctgcgtcacgccgttcatttttgtgctcacgcgcggcctgtccacgcacgcccacccgctgttcttcgccatccgcaactcgctggcctccctcaactccatggtcgaagagaacatcgagggcaaccgtgtggtcaaggcattcgtgcgcgaaccgtacgagaccgaaaagttcgacgagcacaacgacgattacatgcagtgcaacatggccttggcctacaactcgcgcaagtacatgccgtggctggacggcctcggcttctcgctgcagctcataaccctcggcctcggcggctttctggtcatcaagggctacatgaccctcggcaatctggtgagtttcaactccttcctgtggatgatcgacggcccggtgcgccagtccggctggctgatcaacgactggcagcgattcaacgccagctgcatcaaaatccgcaagctgctcaccgaacagccgcgcatcgtggagaagcccgacgcggtcgaagccgtcaagcaggcggtcacgatcgtcgagcaagtcaagcacgatgatgaggctaccggggctaccggagcgcccgtggcttccggaacatccggtgcccagcagtccaccgaacgcaagtcctgcccgctgcacatcaagggcgacatccgcttcgaccacgtcagcttcgccttcccggacgacccggagaccccgatcctcaaggacctcgacttcaccgtgcccgccggctccaagctcggcatcctcggcgaaaccggcgcgggcaagtccacgctcgtcagcctcatctcccgcttctacgacccgaccgttggccatgtgctcatcgacggcatcgacgcacgcgactggccgctggccaccttgcgctcgcaggtgtgcatcgtggcgcaggataccttcctgttctccgacaccatcggcggcaacatcggttttggtgccagcggtgatagcgacgaccgatatatccagaaaatggcccagatcgccggcgcggacaatttcatcaggtcgatgccacagggttatgacaccgtcgtgggcgaacgcggcgtgggcctgtccggcgggcagaagcagcgcctgtcgctggcccgcgcgctcgcggacaatccgtcgatcctgattatggacgatacgacctcggccgtcgatatggagaccgaggcggagatccagaagcacctcaaggagatggacggcggcaagaccatcgtcgccatcgcccaccgcatctcgtcggtcaaggattccgacctgattctggtgctcgagcacggacgtatcgtcgaacgcggcacccacgccgaactcgtggccgcacacggccgctactgggacatctaccacaagcagctcggactccagtccggcgtcgcacaaggtttttagaagaggacttatggcacaacgcaatacataccgcgaggatgaggaactcgaggagcagatcaacttccgggacatcctgcgcgtcggcaaatatctcaaaccgtatatggcacaggtggcgcgcattctcgtcgtcgtcatctcgatgagctgcatcgtcgtcgccgtgccgtacctgaccaagatcatgatcgacgaggcgatcccgaacaaggacctcggcaagctcggcatcctcgccgtgatcctcgccgcgctgatcgtgctgtacgagttcgggctgcgctaccgcacggtggcgatcacgcgcgtcggccagctcatgctcaaggacatgcgccgcgatatcttcacgcatatccagacgctgcccttcagctacttcgattcgcgcccgcacggcaagatcctgatccgcgtggtcaactatgtgaacacgctttcggacacgctgagctccggtctgatcaacgtgatctccgacgtgttcaccttcgtgatcacgctgatcgtgatgttcgtgatcgactggcagctggccctgtggagcctgatcctgttcccggtgctcatcatctgggtgcgcgtgctgcagatcttccagcggcgcgccttccagaagctctccaacaagcagagcaacctgaacgcctacatccacgagtcgatcgccggcgtgaagaccacgcagaccttcgcacaggagcaggcccagttcaggaccttccaggaacagcagggcgaggtgcgttccgcgtggatgcacgccgtgcacatccagttcctcatgtggccgggcgtgcagaccatctccgtgatgaccatctcgttcatctacttcgtcggcgtgatgggcttcgggggcgtgaacgtgaccaccggcgtgctcatcgcgttcgtcggctacgcgaacaacttctggaatccggtgatcaacatcggcaacttctacaaccagctcatcacctgctcggcgtacctcgagcgcatcttcgagacgctcgacgtcacgccggagatccgcaacaagcccgacgcggcggacctgccgcagatccgcgggcgcgtcgacttcaacgacgtggtgttccgctacgagaaggacggccgcaacatcctcaacctcgtggacttccacgtcgaaccggggcgcacaatcgcgctggtcggcccgacgggcgccggcaagacgacgatcatcaacctgctgtcgcgcttctacgacgtgtccgagggctcggtgacgatcgacggctacgacgtgcgcgacgtgacgctcgcatcgctgcgccggcagatgggcgtgatgctgcaggacaccttcatcttctccggcaacgtgcgcgagaacatccgctacggcaagctcgacgccaccgacgaggaaatcgaggcggcggcgaaggccgtgcacgcgcacgagttcatcatggaactgcccgacgggtacgacacggtggtggaggagcgcggatcgaccctgtcggccggccagcgccagctcatcgccttcgcgcgcgtgctgctcgccgacccgcgtatcctgatcctggacgaggcgacgagcaacatcgacacgcgcaccgaggaggcgctgcaggccggcctgcagcatctgctcaaggggcgcacgagcttcatcatcgcgcaccgcctgtcgacgatcgagaacgcggacgagatcttctacatcgatcacggccagatcgtcgagcacggctcgcacgcgcagctgctcgccgccaagggcgcgtactaccgcctctacgaatcccagtacgcgatgattcgcgtggccagtggagcgccggaagagtgacgagatgttgcgcacaaggatgcgtttagcggcgtttcacatagcgggtgctgcgaccggcaccgattttgatgatcgtaccggagtccaacagtgatttcagcgtgcgctcaatggtggtggtgctggtatcgggcatgcgagcgagaatatcggccttggagagtggaactagggattgatcaagcagtgcttcaatccgcgttcccttggtggctactcgcggtgctccctgcgctctgccgcctgccgtgagattgatgcgttcgtcgaattccttgcacgcggacagtatgatgccaagcaggtagttcgtgaatggcgcataatcattggcgttgtcgtcccagccttgagtgcttgcgtccagcgcctcataataagtgcttttactttgctcgataaggtgttcgatactgatgtatttgccgaccatatagccattgcggtacagcatcaggagcgtgagtagccgactcatgcggccgttgccgtcattgaacggatgtatgcagatgaaatcgagaatgaacatggcgatggcaagcaatggatcggtatgtccatctcggattgcttgcgtgtaggcggaacacgcgcgttcgatcagttccggtgtgacaagtgcggacggcggggcgaatcgcacggtgctggtcccgtgtgcatctcgttcgatgatgacgttgtcactgtccttgaaatgccccgcaaaggtcagtggtgtgtgtcggaagaggtcgcggtgcagttgaagaatgacgttcggggtaatcggaatatagtcgtggctttcgtgaataaccgatagcgcgtcacggtaaccggcaatttcttcttcattgcgattgcgcggtgtgactttctccgagacgagatcgttgagcctgctatcgctggtagaaataccttcgatgcggtttgaggcatctgtgctttggatgcgcgcgacggcaaccagcgtccccaatatatccggtctgatcgttgtctgtatgctttgacgcccttttgcctcgtgaatagcggcaagcaaactcgtggtgtgcggggtgagcaacgtcttacctgattctatgtagtcgaatgatctcatactgcctcattttctgcatcatacgaacttttctgcatcatattttatcaaaatgaggcagaaaatgggctgatgagacagaaaaggcggcaggatggcggccgtctcgcttgccggttgcgttactttcccgggaatgttgcgctcgtggcaagaaacggcaagttcaggcggacgcgaccgacgatacccgtcgtgtagtcgaacgtcttaccggactgccttacgagcgttgctggcggtagcctacactgagaaaccatgagcaagcatcaccatcgcgaccgtagctgggccccggcacctgaagcattgccggacgacgcccagaccattgacaaccacactcacgtggcctccgtaatccctttcgcgcgcgctatgagccatgaggcgcaggagaagggacagcccgaagtcccggtgtacgacgtcgaccaattgctggcgcaggcgcaatctgtcggcattgggggtattatcgactgcggttgcgagctgccgcacctgatgaccgccctccagatggccctcgatcatccgggtaatgtgcacgcggcgctcgcaatacaccccaatgagtccgtgctccacgggcatcgtggtgtgccggggccggatggtctgcccctcaaatacaagccttaccatgacacgtctttcgaggacgcgctcgccgaagtacatcgcctcgccaccacataccccgagcaagtggtggctatcggcgagaccggcatggacctcttccgcaccggcgaaggtgccaaggaactgcagcgcgaggctttccgcgcgcatattgccttggccaaggaactgggcctgcccatgcagattcacgaccgcgactcccatcgcgaggtcatcgaaaccctgctggccgacggcgcgcccgaacgcaccgtattccactcgtattccggcgaccgtgagatggccgagatcgcgcgcgaacatggctggtatctgagcttctccggcaccgtgagctacaaaggcaatgacggtatccgcgaatcgctacggattgtggggctggaccatgcgatggtcgaaaccgacgcgccgtatctgacgcccatgccgtatcgtggccgcaccaacgcgccgtacatgattccctacaccttgcgggccatggccgatacgctcgacttgcccatcgcggatgtggcgcgcggcacccgcgataccgcccgcgccgtatacggactgtgagggccgggtgtgcggccgtcgcggcgatgtgttgacttgtaaaatttgtcagaattgtgaacgaggtctaccatgatgtacctgacataagcgagggggatgatctccacctcaatggaggactgaacgtatggctgagtcgaaccaaaggaccgcacgcgcccaaaaagcctcaaaggcccagacagctcaggctggcgccgccaaagccaaggcccgacaggaagaagaagcactgctgagggccgacacctttaccaacgctcccaaggtgtcccgccgcactctcaccaaggaggagcgcgaggcactcgccaagcagagagaagctgaaaccaaagaagccgagaaaatcgccagcgcatggtcgaaaggcggcctcggtcgatggtgggcccgcctgcaatccagcccagacaaggtcacctggggcatggcgatcgtggcgctcggcgtggtgtacggcgacatcggcacctcgcccttgtacaccgcgcagaccttccttgccggtcagggagggcttggcagcgtagaccgagaggccgtgctcggcatgctgtcgctggtcttctggtcgattacgctgatcactaccgtcaaatatgtgctcatcgccatgcgcatcgacaacaatggcgaaggcggcatcttcgcactgtactcgttgattcgcaagtacggcgcatggctcgcgattcccgccatgctcggcggcgcggcattcctcgcggattcggtacttaccccggcggtttccatcagttccgcagtcgaaggcttgcagaccctgccgccattggaagggttgttcgacgaaaacccaagcctgaccctgatgatcaccgtcgtgatcatcgtgattctcttctccgtgcagtcgcgcggcaccgaaagcatcggcaaagtattcggctcgatggtgctggtctggttcggcttcctcgccatcgtgggcgtcacgaatctctctaacgactggtctgtgttcgaggccctgaacccggtgtacggcatcaaattcctgttcagcccgaacaatgctgccggcatcgcccttatgggcaccgtgttcctctcgaccaccggtgccgaggcgctgtactccgacatgggccacgtggggcgcggcaacatctacttcacttggccattcatcaaggttgcgctggtgctcaactacttcggccaaggtgcgtggatgctggccaatagcgataacccgcaatacactgcgatggagtcactcaacccgttcttccagatgatgtctccgaacgtacgttatctggccgtgattctgtctgtttcggccggcgtgatcgcttcccaggccctgattaccggcgcgttcaccatggtctccgaagccacccgcctcaattggatgcctcatctgcaggtgcggtacccggcccgcacgcgtggccagctgtacattccggtggtcaacggcgtgctgtgcgtctccacactggccgtactcgccatcttcaaggattcggaacacatctctgccgcatatggactggcgttgaccattacgatgatcaccaccaccgtgttgctcggcgtccacctatggcattccggcaagcgggtcggtgccatcgtgttcaccgtgctgttcttggcgattcaggctatgttcttcatcgcgtctatggccaaattcctgcatggtggttggttcaccatgttgctgaccgccgcgattctgttcgtcatgtacacgtggaatgagggcaccaagctcgaacgtgcgcaacgccgtcacatgcggcccaacgacttcctacccgcgctcgacaagctgcacagtgatttccgcatcccgtattttgcggacaacatcgtgtacctgacctccgactcggaaaccaagcgactcgacacggacatcttcttctccatcttcgccgaccaccccaagcgcgcccgtgcttggtgggcagtcagcgtggaaaccaccgacgagccgttcacccgtgaatactcggtggaggacttcggcacgaactacatctaccgcgtgcgcttccgtctgggattcaaggtttcgcagtccatcccggcgtacatccaccagatcatgcacgacctgtccaaaaccggcgaactgcctaagcagaagtcgatttaccccaaggtcgacgccgatccggacatcggcaccatccgttacgtgctgattcacaaggccctgatgccggaatccaaggtttctgcacgcggtgccctgtcgttgcaagccaagtacgcaatccgccacatggccggctcgccggttaagtggttcggtctggcaccttacaacccgttggtcgaggtgcagccgctgttcgtctccacccgccgcccaccgcgtctgaagcgcaccgatacggccaagaccatcccgacgcccacgccgactcgtgcagtggccgacccggccgccgtccctgacccgatggacaccacgtccgggcttgggcgattggtacaggagctcgatgccgccgtatcggccgaggcgcggaagaccgctgaggccgctgccgccgatgcgcccgctgagcagggcgataagggcgataagggcaaggccgagaacggcaaacccgccgccaagcctcagcgctccgccaaacagaagcgataacataccagtttgcagcggcgctgatgcgctctataaagaatgcctataacagtcgccgcacgtcgccacacggtttcggtaagttgaaataccatgtgcagattactgggatacgcgacggcaggcttcaacctgagtctcaacgctgtgttggggcaagacaatgtcgaggatttccgtgaactgtctgaaatccacaatgatggctggggtgtagcccagctttccgatcctgccgaagcaccgcacgtgcgcgacggtggcgcacccaccccggaaaccggcacccgaatctacaagtcgaccatcgcggcccgtcatgacagcacgtttgaggcgctggccgacgaaccgtctcgcggtgccatctggcacctgcgcttggcaagttccaatctgccgctcatcatggagaaccagcacccgttctatgcgaacggcctgagcttcatccacaacggcgatatctcggacgccaatggccgcaacatcgtcaccaaccgctcatacccggtgaaccacagcgtgttcctctccaccggcggccgttccgactccgccatcttcttcgcggtgattctggaatacatcggcttcggcttctcgctcgacgaggccgtggcccaggccgtgcgcgaactgcgccaagcctacccgaagtccagctacaactgcatgattcagtccgaggaccagctcatcgccctgtgtgccgccggtcgtgagaagaccagcccgcgcatcgtggaaatctacgatgagtacggccgtggcgagcaggccgccgactaccgtgtgatgcgctaccgtgagctgcgcgacgacaacggcgactccgccggtgtggtggtctcctcttccggctacgagcaggaaggctggaacgtgctggagaacgaccagatgatcatcgcctccaaccgcaacggcacctaccgtctccgttccatctgaaatagcttcataagccccctctgacgaaggggctgtcagtcgacaggctgacttgggggagagacccctagagcctcaaatcatccgcatcccatacttctccgccaacgccggaatatccggcacgccatacttggccaccagatccagccatcgctgtttgttctctccgccaaatcgctcggctcgggccgtatacgcctcgacctgcaggaacttcggcggcactgacttgctatggaacttgtcggcgtacatcaccacttcctgctcgagattcatcggcacatagtcggctggtggcaacggcagctcctggcgcaccacatcctcgcgcgtaagtcccacgccggtatggttgcggcagaactgggcgatggactcgtccacgccctcgtcgagcagatactcgtagcccttaagaccgtgcagaatgtagcgtttcttgctgaatttgagcggttcgccgtcagagccgtcatgcttgaacacgcggtaggtgccgatgtcatgcagcagtccgccgatgagtaccaaatgctcgtcgagcagacgcggcggcacatggccgccggtgacgcctgtggtgggcggtacctccgcgtccttcggtaatgtgcagcggcgcgtgaacagcgcgttctgccggcgcacgatctggcagccgatggtcgctacaatcacgcaatgcgtgtgcaccagctcgtacgccgccttggacggcgcgattttgcggtgcaattcgtcgatctgctccagtgtgggaatatatccggtcataattatcaggtttcgcctcgtacggtcagatttatcctcagattagcgcggcaatgagccgcagcattgaaaaacccctgcgattcggcaatacgaatcacaggggggctctatggtctgaacatcagatttcgaagagtgtgtcggctgcttcggcgatttcgcgcgacgcagtgagcacgataacgcagtgcttcgggtcaccggtgtgcgccagcttggccagcgcggcgaacacggtcacctcgtcatccgcgttcagccctcgtgtcggctcgtcgaggatcagcacctcggcctcggtgctgattgcacgggcgatggccaccaaacgctgctgcaccaaaggcaatgtgccgacagccacgccgctggtggcctcagagaagccgaccttggccagcagttcgcgggcgatcaccggcttgggcttcaggaagttgcggttggacgcattcatggcgtacagcacgttttgttcggcgtcgagcttcggctgcacggcgtgcagctgcggtacgatgcccagacggtggccgcgcagttccacgggctcgagctcaacaatgttggcgctcttgttcatcaccgtgccagacgccggcgtggtcaaaccgctcatcacgcccatcagcgcgcgacgcttggcgtcggcggtgatacccgaatcggggtcgtcgctgatcagcagcgcgtatgcgtgtccggaatagcagaagaaattcgcgccatcgaggatgttgaccttgcccttggggccggcgaccgtcaccttgttcagggcgaaggtcgggtaggtcttgagcagaatgtcgtcagaaccgccgcccaccaacacgcgatcgatacgcgaggccagcgtcatggtgggttcggacgctttgccctgaggctccgcatgctcggccaatgcgtctttgtgatcggttttggccagtcggagtgtttcgttgacgcgggcggcattgcgctcggtcacttcggcggatgcgttggccgaagcgatggcgtctgcttcggcctcgctggtctcgtcggtttctccggtctcggcagatgccagtgcgctgtaaataccatcgtcaacagtgccttcgtcatcaacgtcatcgaaggtcacgctgaactgcatggagtcagctggaacggattcaatggcgtcgttcgtctcagtctcagaagtcacttcgtcagccgttgcgtcagtggtcttctcgagttcctgatcgttgttcctgtcgctcatgcctgtgcctccgcatcgtcggttgtggtggtcgtcttgttggtctcgctcacggtgccccagtcgccatcggcggcaaacagcttgtccgcgctgaagaacgcaaggcgcagggcggcaagaatcgcaaggatcaggattgaacccagtccataccagaccatggtccaaatcaggcccgatgtcaccggggtggcatggccggatgccagggcagatccgatcggattggcggcgaacgcgcctccgaccagaccaatcacgtagaagggcagggtgacgatgaacacttccagcatgaactgccatcccaaacgcccgcgagtgacgccggacaccagtgccatgccgatctcgtcgtcacgcttgggcgcccacacgcccgacagcacgaggatgagcaacagcacgccgcccacggcaaccaacacaatggtgccggtcttcgcgcgcgaggatagcgtatccagcggctccagagaagcgttgtaggattccagcgaaggggaagagaactcgtaacccttggcgggcagcttggatttcttgagggtggacaccaaggacttgtatgtagcggaatcaccggcgtcgaacaccacgtccagatccggcatcgcccagccggaggcggtcttgtcgttggactgtgggtcgagtccggccttggcgaaggtctgatagttggtgaagatcgcgttctcgcggttgcgggcggccgtcaccggattggcgacggcggattcggatgtgtacttgtagatgccgcgcaccttgagctcggccgtggtctgggcgtccgaggcggccgccgccttgagcgtatcgcccaccttcaggttgttggcggaggcaaacgcttcagagaccagtgcgccggtggtgttcgggttggaggacttgttgtcgtagctcaggtccttgccgtccacgatttcgaaggtaccgaggtcgctggccttggcggcatcctcggtccagaaggctcgccaaatgagctggccgccggtctcgtcatcggaggccgagcccagcgatccgccgtccagggccttcaaatcaccgctcacgcgggccggcacggtttcggtaaccgtgaagttcaacgagttggtggccgactggacgagcgtggcgtattcggtgtatgaggtccacgtcatgtaatgcttggtggaagccgagtccgtagcggagaccttcttccacgtagccgcagtcgggcgaatggccaacgtggccttctgctgatcgtacgcggtggtgtgtgcgttggtatcttcttgaatgatggccagtccggcgactgtgccgaaggtgaccgccaaggtgatgaacgcggtcagggccgtacgtcctttagaacgtgtcagggcccgccaggcgttgctgaggacgaacatgtaattacctctcccgttctcctaagccgaacaaatcaatacggctctaactattgttgcgtttagtgaccgttttcttgcgcaatactgttatacccctcaatgaagtctgagaacattctgacagcgatgtggtggtcatgcggggatttgcacccggtatgggataaatcctcggtctatttcggtggcatcggtacactggcatgagatatgcgtggcgtcacgtgtgctccggcatgtctgcgattccggatttgcccggagtccggcatccggaagcgtggcctcgcgccgctggataagagtatgagctgagcagattttcgggcagggtaagtatgcgattcacttcagggcattcgagccataaggctgtggggcgtaggagaagacgtcatgccggtaacggaaaattcaatcgctccgcatctacgaatagcgctgtgaatcagcagacgggtcccgtaaacctgaagactccccagcacgtgggtggtaacggccgttcgctgatcagccgtacgccgatatgggcgcgagtggtggttgtactgctgctgacgttgctggccagcgtcacctgtgtgggcacgctctacgcggcatccgtctcgagaatggccacggatgcgcagcgcgtgctgacatccgccgaaagtctggccaattcggcacttggctgtggcagcgataagagtctgtcggacatctcccaagagctggtcaatgccaccaatgatctcaatgcggagctgaacggcccacagtgggacttcttccgcgaccattcgcgattcggaagcgacatcaccgccgcccgcgaaatgctggcttccgtggatacgctggtcaacggtccgttcactgatctgctgaacctgtccaaacgattgcagggcttctccctgaagaatggctcggtggacgtcagcgccctgatggatatgccggatatcgtcaagcaggcgcataaggatatctcgcagcagctcaccaagctcaacaaggtgccgactccgagcgtcgccaaggtggccaccgtgctcgaaaccgaaaaggctgcgctcaagaccgtggattcgatgctcggcgaatacgatggcctcattaacttgctaccgcaactgcttggcgaggacggcaagcgcacgtatttggtgatggtgcagaacccggccgagctacgttcggcgggcggcatggtaggcaccatcgccgcaatcacggcagataagggcacgattaccatcggtgatttcgccaccacttctggttgggacattcctgaggagccaatggatgatacggtgctgaaggagcgccaggtatttggtggcacttttgaccagtacccggccaccacgaccatcgaccccgaattccagcgtgtggcacagatgaacaaatacatgtggctgtatcagaaaggcaacgaagacgagaacgtagcgggtgtattgtcactcgatcccgtatttctccaggcattgctgggagccacaggcgaggtcaagctttcggacggccgagtgctggatggcaccaccacggtgccgttcttcgcttcagacctgtacacggattacccggacttcgagcagcagaacaacttcgtttccgaagcggctcaagcaattatgaaccatgtgcttggcaacgcgaatgcctctaccgcatccccgctgttgaaggcaattagagataccagcgctagcggtcatttcaagctatggatggctgatccggatgagcaggaggcgctgattgccaccggacttatcgacgataaggccagtggcgagttgtctgctgacagtcaggtgcccgaagccggcatctatctttcggagctgcagcaaggcaagcaggattggtatctgaagacctccaccacggtcacaaaaacctgcggcgacgcctcagccagccagaacgccctgtattctggcgtgctggataagcgcatcacgacagccgtgcgtaacacgcatctgggtcagtttacggaagatcagctcggtgacgaatacacggtcaccttcaccatgaagaacacgctgactaaggctaaggccgaatcgttgcctgatttcgttaatggcggctcggagaatccagtgctcggcggcatgttgtaccgcgtggtgcttaccgctccgtacggtggcgagatcaccgctgtgcaggctgatatagattcatggggtaccaacaccgcgagcctgtatgaccgtcagtacattatgttcaaccagcagtggatcgagcccggaaaagaattgacgattgcttataccgttcgggtcagcagcgatgccacacatccactgaacgtggtaaccacgccggtggtgaatgcggatggcgtcgagacgggctccaacggtaatgtgaccgatgagtgcacggcggatacgaacggcgccgatggtgcgaacggtgccgatggtgcgaacggcggcgcggacggcggcaagaacgacgcgcataagggcgcgtcctccgatccctcggccggcctggacaccttggacaagctgaagagccagatcagctgcccggtcgatctgaagtccctgacgggatccatgtgatgaccatgcccgattccgtttccggcgtcgccgtttccgacgccaccgtttccggcgtcgccggcaggccgcgcgacgtgaactacgatctgctgcgcgtggtggcgatgtgcctggtcatcggcgtccacgtgatcaacaactacatgcccgtcaagatgaccctcgccggcagcgcggaaacggtgcgatccgtgctgttcgcgttgttcatggtctgcaatccgctgttcattatggtgtcgggccggttcaacctgacattcgatgccgaccggccggtgagcacccactcagcgggccgtctgccgggctctggctctgatgcccgggcaggcggcggtgccggccaagccgatcccagcagcctcgcgccgtacgtgcgctactactacaaacgctttgtctcgctgattgtgccgtatctgctgtacgcgggcggcatgggattcgtcgcctacctggtgatcgatcatcgttcggttggcggcgctgtgtctggaacgttgtttgatctgttttccgggtatgacgattccgtctattggttcgtattcatgctcgccggtttcgtgttggcgacgccgtttctggccgcgatggtgcgcgcgataggccggtcgggtgcctggctgctgatcggtctggccgccgccgtggccgccgccgagcagatctgcaatcttgccggatacccgttgacgttcctgcagtcattcccctggcggggactgctggtctactatctgttgggattcgtgttggaatactatccgccgtccacgcgggcgcggcgcggcttgtatgcgttggcgccgttcgccctggcgtggaccgtcgccacgccgtacctgttcgccggccagcagatccaggtgggccgcacgctcacggttgcgttcgcgatggtggtaatggcgacgttcctgttcttccggtacgacgtgcacatcacgtcggcgcgggtgtgtaaggcgattatctggctggccggatattcctacacgatttacttggtgcactcaccgctgtccaaggtgctgattggcccgaggatgcctgtgcctacagatggatggtcgtatgcgggtatcagcgtgctgatgtttggcgctacgttgctggcggcgctgctattcgcggtgattgccgataccgtggtgcttaagcccgtgcagcgtctgctacggaaggtcgccccgccgcggaagggccgcccgtagcagacgtcgtttcactgcccttgcgcgcggtagcgggcctcggtggcttccttggccggcgcccaccagccgcggtgttccgtataccagtcgatgacgttacataatccgccggcgaagtcggtgtgcatcggcgaccagcccagttcggcgcgcagtttggatgcgtcgatcgcgtatcgcctgtcgtgcccgggcctgtcccgcacccagtcgaacgcatcctccggctgacccatcagatgcaggatcatgcgcagcacggcgatgttgctcatctcgccgtccgctccgatcagatacgtttcgccgatgcgcccacgggtgagaatcgcccacaccgcgcgagagtggtcttccgtatgtatccagagtcgcgcacgttctggccggtgccgtacagtttcggccgcgcgccctccatgatggaggtgatctgccgtggaatgaacttctccacatgctggtacgggccatagttgttggagcagttggagatggtggcgcgcagaccgtatgtacgcacccatgcgcgcaccagatggtcggacgccgccttcgaggcgctgtacgggcttgaaggacggtacggcgtgtcttccgtgaaacgcgccgaatcatccagcgccagatcgccgtatacctcgtcggtgctgatgtggtggaagcgcacatcgtgtttccgggcggcctccaacaaccgcattgtgccttccacattcgtgcggatgaacggttccggatcggcgatggaattgtcgttatgcgattccgcggcgaagtggactatggcgtcatgactgggcacgatacgctccaacagcgcgacgtcgccgatgtcccccacgacaagatcgacctgcgacgatggcagaccggcgatgttctccggattgccggcgtacgtcagcttgtcgagcacggtgatgtgcacatgcggatggttccgcgccacgtatcgcacgaagttcgcgccaatgaagccgcatccgccagtcaccagaatattacgcggctcgaacacgccgctgcccgccatgctgttcaccgttccagcataccgtcgcatgccaacggctgggggcgtttggcattgagatggcaggggcgaggtgcctcatttgaaaatgagcgcgaagcccggagtggtgcctcaccggtggtgagcgcgaaatcctagtcctcgtcggcttgcggggtttcgccttcttccggttcgacgcccgcgatgcgggcgagcgtcttgttcaagtatgccatgtcggggccgacgcgtctggcgagccgtgcggtgcgcggcgcggcgcatgactcgaccgcatccttgaccgctgccgggctgaccggctcacgggagaacacggccacgtgcgcggccaccggacggtaggcctgctcgcacgccatcgacgcgacgaacgccttcagcccgcggctggccttctccttgggcatgcagatgcccgtgtcctcgaacagcaggtagcgggggggccgccgtccggcccccggtaacggcgcacgcggaactcgaccgtccccgcgatcgccggcagccgcttcgtgctgcggcccgaagccttcagcgcgcggtcgcgcgatcggaagatctcgtcgtcgcgggccgtgagcctggctggattggcaacggtgtgttggactgtttctagagggtttttccttgttgtgtgaactccacggggctcaggtacccgagggtcgagtggatccgttggtggttgtaccaccacacgtaccggttgacgtccgagcgtagttgctccacgttcgtgtagacgttcctgtggatgagttccttcttgacgagccggttggtggattcgaccaccgcgttgtcgtatgggttgccgggtctggaaagggaacgtgtgatgccgaacacgtcgagcatgcgttcgatgcgttccccggtgaacccgccgccgcggtccgtgtggaacacctcgatctcatccagcgggaagcgcagcgcggcgaacgcggccagcacgagatcggcgtcgtgcccgacgccgaccgaatggccggcgatctgccggttggccaggtcgccgggcaggcagacgcacgcccacgaactgccgaccctcacgtaggccgggtcggaggccggatgggtgcgcggcgcatagccattgaactcgcgggcgaggatgttgggagccgggtcgtcgttcggcctggccgggcgtggcctgtaggcggccttggaataggagccggccatgccgttcctcttcatgatccggttgatgcggcggcgggacagcgtcacgccctcgtgccccagggcgtgcttgatctttctggccccgtacaccttgccgctgtccctccacacgcgctccgcatccttctcgtaagggtcggcgcgttcggcctcggggtgttcgagcatccagtagtaggtcgacctggcaacgcccaggatcccgcactgcgctgatatcgggcagcggccggcgtcggaccgtatcacgtctactttcgtgcgaataccggcgccgcttgttttaaaacgtcgaccttcatctccagccgcctgttgcgtttccgcaattcgatcagcccgttctcctcgggagtgcggttgtcggccgctttcgtggagccgctgttacgtatcccctgcacccaacgctgcagcgtggaacgcgggatgccgtactccgccctgacctgcgacgacggcttgccgttctcgtacagctgcacgatctgcctcttgaactcctcctcgtaatgacggggacgattcggatcggccatgatgatcaactccttcgttgtcatgtcccgcatgaaccagtccaatacattgtagccaatccaggcgcgcaccggttcaatcgtctgttccggtgtaccgtttgtataactccaatgccggtgaccaccattacacgctgaacagttatgagagggacatgcttgtctcgaaaggttggcgatatgaaggtatcggttggtattcctccgataccaatcggagctatccgctgtaccgccagtacaatccgaatgccaaagccggtgctcataattacacattgaacagcaatgagaaagacatgctggttcgcgcgggttggcatgatgaaggattggcctggtatggtgtcggtccaggtgaaggagcgccggctccgcaatatcagcgcccatccggtggcgtgtacccgaacctgagcgtaacgccgaacctgagtatcaatgtatcgattgccgatcaacgtgtatatgtcaaaagtggttcaaacgttatctacacgctgattgcttcaacgggcgtcaacaacgcaactcctaggggaactttccgtatcgggaatcgtggttcctccttctacaatgcacgcgagggtatgggggccaattactgggttgcatttgagcccactaacacgtatctcttccattcggttcctacgaattcgagtggtcaatacatcgtcagtgaaggctataagctaggttagcccgcctcacacggatgtgttcgattgagcatcccggacgctcagtggttctatcaacaattgccgagtgggaccgtggtgcatatttttttgatgtcgcgaatacgcggtgccgctgatgctgattaataggcagataccgttggactagtgcaaccgatgattgtcgttggcttgttgctggcagtaggctcactgaaattgcatcgtgaatagtcggcggatatacatccgtgtgttggcacgcgttacacatctatcatgggtggtgagaggaaaacttaatagaagtgaggagtggttatgcgaatcgcaataaagcgaatttgtgccgtaatcttgggattgatgatggtgctatcgatatcgatagcagtctccggccctacacatgtggcatatgcggatgagggctcccaagagatgtaccgtatgtacaatccgaattccggcgagcatttctatacggcgaatagctatgaacgggataatctgaaaagccttggctggcactatgaaggtgtcggatgggtggctccggtaaagtcctcggttccggtttaccgtctgtataattccaatgccggtgatcaccattacacgatgaacagctacgagagggacatgctcgtctcgaagggttggcggtatgagggtgtcggctggtactctgccgatacgacgaacgaattcccgctgtaccgtcaatataatccaaatgccaaagccggcgctcataactacacgttgaacagcaatgagagagatgcactggttcgtgctggctggcatgatgaaggtctggcttggtatgcattagggcttggtgggccagctcagtcgcagccgtctggccctgcaacggttcccggggccattacccctggtgcatggtgcaagaagattgaagcaggccaatacgggcgcagcgaagatggagatttgtaccagtgctcgtatcagcctggtgacaaaataccgcattggtatcgagtgcagtgagtgtgaccaatagacactgattacatattcatgagccgtccgcaacaagtcaatctagttgcggacggctcatcagtatataagagcgtttccatgctctattcagaacgttgacgcttagtgaagtgtcgcctgaggtatgcgaattggttggtgtcggtgatgtaggtcttgcggtcgttcttggcgatgacgtcgaggattattccggtgacgaacagcagcaggccgacgatgacgagcatgatggcgccgatgagtgtggggaagtgggccacggatccggtcgcggcgaactcgtaggtcacccctccgcagagcgcgatgccgacgatgccgatgagaaggccgatggtgccgaagaagggcaggggcttgtattcgcggatcatgcggaatatggtgctcatgaccttgatgccgtcgcccacggtgtcgagcttggataccgatccggcgggccggtcccggtactggacgggcatctcgtagagacgcaggttgttgttcagcgagtggatggtcatctcggtctcgacctcgaagccgtgtgaaagcacgggataggtcttgacgaacgtgaagctgaacgcccggtatccggtcatgatatcggtgacatgcgcattgaacaggccgttgatggaactgcggaccagccggttgccgaagttgtggaagggccgcttgttctcctggaagtaggtggaggaaagccggtcgccgatgaccatgtcgtagccgtcgagcaccttggcgaccatggccggggccgcgtcggccgggtaggtgtcgtcaccgtcggccatgacgtacacgtccgcgtcgatgtcctcgaacatggcgcggatcacgttgcccttgccctggcggggctcgcggcgcacgacggcacccgcgttccgggcgatctcggcggtgtggtcggtgctgttgttgtcgtacacgtagatggtcgcgcccggcagcgcggccctgaagtcgcgcaccacattgccgatcgtgacctcctcgttgtagcacggtagtagaaccgcaacggaatgggttgggcaattatcaaacatgtaaaatatcctaacgtttgggatagcccgaaaacattaagtaatcgttctcagagctgccaagggaatacaaaaaggtgagccagcaatagtccggaataagaccatccgatcaaggcagatatgaagatacggattttcttcctatcgataacgagtatgcctagattggggattagcagacagacaagggcataaatggggatgaagtacctactttggagaccgcttgcataactgccaagtgcgactcctccccaggatacgatgagacctgtgcaagttaaagtgtagaaaagaatgattattgctgcagtggctgtaatctcagctatgtggaactcagggagattcttgtttcgatatagaacaagtaaaacaacggcaaaaagaataggcatcatgaccgcaaatggtaactgtgtatattcagctccagtaaagaattggatgttgcggccggtatcgtgcttatcgttggttaaatccaaagggttaatgagagatattccaaggcttttaagaatctcaccgggatgatgcagcacagtcaattttgcctctttatattgttcgactgtacttactgcactgggaggcacgttttttgtagcctgcatccaacatatggctgaagacaaggaaattatgacgggaattacaaacctgtagtcgattttatgattcaactggtactgtcgaatcatgggaagcgcaatcagtagtatgagaattatgcaggtcattttaatttgacccaggaacaatgccaaaagacaagttgctaatatattatgccatgataatttctcttgctggtaaagatataaaatgaaagcaacccataatagtgaaattgaatttgtgatggcatctgccgttgggtatatagaggaaagaaagaaaatcggaagaattgcgattccgaatataatcgtgtcgtactgctttgctagtgatatagcaatacatacaaatagcgtggaaaataataatgtaagaaggcagctgattcttagatgtccaccaccgaatacacttggaaaataagtaaaaggtgaattgatggcagtattattgaaggcctcaaatactccatctttattgattgcaccatagttgccggttcctgatggatctgggattgccgtaaactggccagcggcaatttgctcagctctattccaatgatcaagaaaatcatttctcgatggagctttatcgaaaaaaatgagtataattccaacagggatggttaatgatgcataaagtacgctgagcttatattttctatatatagaagtggatatttgttgcattctagtagtagaacgagtcatctgttttttctccgcgtcactttctgacaaattaatattataccatggtgttcgtaatcaacctcgtggttaatcatgtcctatgtcaaccgtgtgcacaactagtttacacacggcgagaaccagcgttttttgtcggtgtttcgccgattattgaacatgaagggctatcgttcgtggtaactgatattgctgagagcgattgatgtggaataagggggcgcggatgtttttttggacggtcaggtagccagtccaaggtgtttgcggtattgcgcggggctcatccagtccagtgacttcttgatcctagtctcattgtaggtgggtcaggtaggtggataagcgttcgcggaactcctcgtagcccacgcccctccagtcccgcccgtagaagaactcgttcttgagcctgccgaagaacccctcggccgccgcattgtccgggctgcatcccttggcgctcatcgacctgtttttgttcaataggaagttgaggttttgggggtggtgacgttttgttggacttcgttgtctgtatggtcgttggtcagtgtaccggatggtttcaggcgacgagcccgagctggatgcgtttgtccatgatgctcatgccgtattcggtcttgatgcgcttgtcgcggtaccagaccatgtactcgtcgagcatcgcggtgaactcgtcgatcgtcacgccctggaagctcctcttgtggaagaactcctgcttgagacggccgaagaacccctccgcggccgcattgtccggcgaacagcccttcgcgctcatcgaccgggtcagcccgtgctcggcgcagatgcggatccattccggccaccggtaatggcaacccctgtccgagttaaaccgatgtcggtttaattccgattaagccggttttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggacggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctggccggcatacgcaggacccacgcgatcgcgggaacgttgcccgacgacgagcaccgccgcttgctggaggcgtgcgcctgtatttcgtcaagtcggtgtttcgtgtttagtcatgtatttttttcgggtttagcgttcaacgaacccaccaggccgtacttcgcgccatacacgaaaccccagatcaaagtcgacaccacagccggcaccgcgtacggcaggaaggtggagatacggaagaacttcgtgccatgcagcttcatcgaatccagcgccaacgccatcaaagccgacaggcacagcatgatcggcacctgcacgcacgtgaacaaagccacacgaccaacactgctccagaactggccatcgcccaacaggcgcacgtagttctcgaagccgacgaacttggtgccgccgatcatctgcttcttgaagaacgaaatataaacggcgtacacgatcggcacgatgaacacgaacacgaacaccaccgcaaaaggccacatgaatttccatccacgccaatcggccttgtgcttattcacacgagccttgcccgaatgcacgggcgcagctgcgatatcggctgaagccattcccaacccctctccttcgaaggttgaccaaaatgtttgcgttatcatcataacaccatttgtaacattgtccaatcgtgttgagtaccgtgttgaattaagggtttctcagtcactctgctacaatggtcacgaagacaacgatgttatcgttaccgtaagcgaccctaagataagcgttgcaaacgaaacaccgacattaatgagtcaagcgagggtgaaatgtcgaggccaacacaggtgtccatgcaagacatagcgaaagccgccggcgtttcgccacagacagtgtcccgcgtggcgaatggcagcgatgcggtgaaacccgaaacacgccagcgtgtcgaagccgcaatggaacgccttgggtatcgtccgaattatgcggcccgagccctaaagcacggccgcttccaggatatcggcgtggtgatgttcaacaccgccacgttcggcaacgcccgcatccttgattctattgtggccaacgcggccgatgacgattattcagtcaccatccagaccatgcgccacggtgcggaacgcacgctttccgccgccatcgatcgcatgcagcgtcagccggtggatggtgtcatcgtagtgctggaggaacgcatctccgatttcgtcggatacaagcctccgcgagaatttccagtcgtgctcatctgcgaatccgccgccgaccactgccccaccgttgacgccgaccagtatggctgctcgaccgctatcgtcgattacctgatgagcaaggggcacaagaccgtctaccacattgccggaccgtccacctcgcgcgccgccgaaagccgcgcccgcggttggcgagaagcgttggaacaaatgggagcacgcataccgagcatgtacatcggcgattggtgcgcggattcaggctaccaggccggcgtggcgttggcccacgaccccgactgcacggccatctacgccgccaacgaccaaatggcatacggcgcaatgctcgggttgcagtcagcgggcaagcgcgtgcccgaggatgtcagcatcgtgggcgtcgatgattcgctggtcgatatggtcccgcgcttgaacctgacgaccatgaagctgcgctttgacgacattggcgccaccgccttctccatggtccgccgtcaatgcgaaggcgagaagataccggtcggcgtcaaaaccgtaatcccgccggaactgattgaacgcggttccgtgctcgacatcagctgacgagcggcatgcgctggcatccactggtacctgccagtgatccacctgccagtgattcataggcaattccgcaccgaccaatcgactcggttgtgcaatattctgcacatttccaactatgtgcagaatattgcacactttactatactgtgatatattttgcacatgattgtcatggatatcgccgaatacgcgcggcttatcaaggatgaaaggcaacgccagggcatcagtcagaccgacatggcccaacggctgggcgtgtcacgtcgctggctgatcgaatttgaacacgcccgagtccccaatcccggattctccaccattctcagcgctctgactgagcttggcttgtcgctggatgtccgcaaaaccccgcagcccgccgaactctatgaatggtgacaccatgagcgaaatcactctcaatgcatttctcggcgaaacacccatcggccagtttcgaagaacaaacgatggcagcattattttccaatatcacgattcctatcgttggtcgcaatcacccacaccaatatcgctttccatgcccattaccgcagccgaatattcaggcgacatcccgcgtaatttccttgaggccctggtcccggaatcccctcaggcccgagatgaagccatgcgattgcatcatgcccgatcgacaagcgcatttgatctgttgcaagccatcggattcgatgccaccggcgcattacggctgtccgccgacccgcacttgcccatagatgacgattcgcttattccaatcagcgattcgcagatcgcgaatcgactacgcgcagccgcccccacaggcatccagtccgcaagcgtagacgagcattggtcggtcgcgggacagcagggcaagatcgcactgaggaaccgcaatggatcatggttctccaccactggaatcgcgcggacgactcatatcatcaagcccggcataccgacccttccacaccaagcattcaacgaacacatcaccatgcgcattgtggaggcgatgggaatacccgtggcccacacctcttttcacatctttgatggggtcccagccatcatcagcgagcggtatgaccgtatagtgtccgccaatggtacggtgacggccctgcaccaagaagactttacccaagcgctgggcattccctcatcgctgaaatacgaggaacacaacggcccaacgtccaatgcatatgcggaaatgttgcgcaagcacggtctgcccggtcaggccgaaagcaatatccgagccttcaccgacggcatcctcgccagttatctcgtcggggcaacagacagccacgccaagaactactcgctattgctcgatggcgcgtccgtgcggcttgccccgctctatgaccttgcttcggtgttcccttatttggggcatggcaagcagatcataaatgccactttggcgatgaacatcggcggacgccgagatcttcttcaattacgccgcaaacatctggaacgattcgcacagcggatgggattagatgaggaatccgtgattttgcgattccacaccttggtggataggctgccggaggcattcgacagcaccgtgcaacccgctcacgacgttatcgcgagcattggtgcgcaggaattcatcgatagctatcgcaagcgcatcatgatggtgtacgacgatgcaatgagctggatggccagtcgaaagggacagtgattcggacgggcggggattggtctcgccatcccccccccccctaagaaatcagatcttaagcggcacacgggaaacgaattcgcgcttctcgcctgttattggatcggtgaatcgtagcacacgcgccactaattgcagcggttggctgaaatcgtcgtaggggcgcgtctggatgcgcgggtagaagtcgtcgcccacgatgggcaggccgagcgaattcatgtggacgcgcaattggtgggttttgccggtgcgcgggtggagtgtgtagcggcagatggggtgattccccggatggggaccaccctccggcgcttcgcgccacctcccgtcagcgggagggaaacagaggtcgccgcgctcgatgagggtttcggcgttggccaaacccggttcctcgaatgcggccatcgtgccgtgttccttggtgatgtgcgatcggcgcagcaatgggaacgggcgtggcggttcgacctgcatgatcgtgccgaatcgcgggccgctgatcggccggcagggtgccaggcattcatagatcttgacggcctgccggttctggaacagcatctgatacgcgccgcggcaggccggatcccgcacgaacaccaatacgccggcggtcatgcggtccaatcggtgcgctggcgtgatgtccggatcccccagccgctcacgcaatcggatcagcgcggtctgccgataccacatgccgcgcggcatggtggccagaaaatgcggcttgtccaccacgatgatccgctcgtcctcatacagcacgtccatctcaaacggaatatgaggctcgtcaatcacataccgatgtggcttactcaacggtcacggacttggcgaggttgcggggcttgtccacgtcgtagcccttgagctttgccatgtccatggcgaacagctgcagcggcaccacgtcaaccagcgggctcatcagcgttgggcaggcggggcgccagaacaccacgtcagcgtaccgttccacatccgggtcgccctgctcggccacggcgatgatgtacgcgccacgagccttgacctcctcgataccagagatcaccttggcgtgcaacacattgcggccgcgctgcggcggcacgatgaacaccacgggctcaccctcgtccaccagcgcgatcggtccatgcttgagctcgccggccgcgaagccctcggtgaacgtgtaggcgatctccttgagcttcagtgcaccctcaagcgccaccgggtagcccacgtgacggccgaggaacaagaaggagttggcgttcaccatgcgctcggcggccgcctggatggtcttgggctgggtgtcgagcacccactgaatcttgcgcggcatgtctttcagggagtcaagcacctgatgaatctcatcgcggaacatcgcgcccttgacctgcgccagatacaggcccagcaggtaggcggcggtgatctgcgccacaaacgccttggtggatgccacggcaacttccgggccggcgtgtgtgtagagcacggcgtcggattcgcgcggaatggaggcaccctgcgtgttgcagatggccagcaccttggacccctgttcgcgcgcgtggcgcagggccatcagagtatccatggtttcgccggactgagaaatggccaccacgagcgtacgcggggtcagaatcgggtcacggtaacggaattcgtgcgcgagttcgatttccacggggatacgcacccagtgttcgatggcgtacttggctacctggccggcgtagctggcggtgccgcaggccacgacgatgattttgtcgatggccttgaagtcgtgttcgtcgatacgcacttcatcaagggtgatgccgccattcgcatcgaagcggccaagcagggtgcgctgcactgcggcagggtcttcgtggatctccttgtccataaaggaatcccagccgcccttttcggcggccgaagcatcccaatccacggtgtaggtcttcgggttttcgaccacgttgccgtcgaaatcggtgacgatgaccttgtcggcggacacgcatacggcctgatcctggtcgacttccatggcgcgcttggtgtaggccacgaatgcggcgacgtcggaaccgaggaagttctccccctcgccaaggcccacgaccagcggcgaatcatggcgggctccgaccacgatgtccggctggcggcagtcggtggccagaatggtgaacgcgccttcaagcatgcgggccatgcggcgcacagccttgaacaggtctggcttgccttcgtccgcgataatcttgtccacgatcttgccgagcagcttagcggccacctcagtgtcggtggcagaggcgaatcggtagccttcggcttgcaggtcgagacgcagctgagaggcgttttcgatgatgccgttatggatgatggccaccttgccgtccatgctggtgtgcgggtgggcgttcacgtcgctcggctcgccattggtggcccagcgcgtgtggccgatgcccaccgtggcaagcggcatcggcttacgctcgatgtcttcgaccaggttcttcaaacggccggccttcttgcgcacgaccaccttatccatgccgggcgcggtcagcgccacaccggccgagtcatagcctcggtattccagacgttccaggccttgcaggcagacctccaaaggcttgccgcatgccgtttcaatatttcccgcgtatccaacgattccacacatggttcaccagcctagcggacgattattgcgcaaagcgaatccaacccgccgcctttgcaggattggaacatgccccttcgtgaaaaccgtacactgactaccactcagcgtacgttcttcacgagatgggggtgcgattaggcgtcgcaaaaaaacgtacgctgagttcatcagcgtacgtttttggagctgcaacaacgagccttcctacagcacgtgctgcaagaagtccttaaacctaggctcggtggggtggtcgatgatgtcggggccgcccttttctacgactacgccgccgtccatgaacacgatctggtcggcgacttcgcgggcgaagccgatttcgtgggtcacgcacaccatggtcatgccttccttggccaaggaacgcatgacgttgagcacttcacccaccagttcggggtcaagggcggaggtcggctcatcgaaaagcatgatctccggcttcatggccagagcacgggcaatggccacacgctgctgctgaccacctgacagctgggaggggtaatagtccatgcgatcgcccagaccgacgcgctgaagctcggccacggccaggtcacgggcggctttcttggactggtgctgcacgtgaatcggggcttccatcacgttttccagcgcggtcatgtgcgggaacaggttgaagcgctggaacaccatgccgaggcgagaacgctgtgcggcgatctccttatcgtccagggtctgcagcatgtcctggccgtttttggtcacgtgcttgtagccgatgagttcgccgtccacctcgatggaaccgccggtcagggtttccagctggttgatcagacgcaggaacgtggacttgccggaaccggagggccccagaatcacggtcacagtgccgggcataacggttagatcgatgcccttgagcacatgcagcggcccaaacgccttgtgcacctgcacggccttgacagcaggaatcacggaaccgtcagccgccttgcgcacgaccggagcggagttggtgatgtcgttcgtagtcataattctcgctcccgccttacgcattcagcccagcgaaggtggtctgattgattttgttcacatcgtccttcggctcgccgtcagacttgccggggtacggcggatcgtatggcggctgcttgcccttggtgcccaccggtcgggcatcgaagcccttgccgaagtgcgcctcgaggcgggactgcacaaccatcagaatggaggtgatcagcaggtaccagaagcaggccacgagaagcagcggaatcggcttgtagatacggttggcgatggcgttggtggcgaactgcagttcgagggtgaacggcacggcggtgaccagcgaggtggtcttcagcatgccgatggtctcgttgccggtgggcgggatgatgatgcgcatggcctgcggcagcacgatgcggcgcatgatgagcgtgcggttcatgcccaatgccttggccgcctcggtctggccggggtccacggcttcaaggccggcacgcacgatttcggacaggtaggcggcctcgttcagagccaaaccaatccatgcggcgttgaatgcggtgaccaccacgttggagtcgatgctccagaactccaccgaggtgaacggaattccgaggctgatcttgggaatcagcacggcgaacagaccccagaaaatgagctgcgtgtacacaggcgtgccgcggaagaaccagatgaagaaccagctgacgccgcgcagcaccggattgatggatttgcgcatgatggcaagaatcaccgacaggatgatcgccacgaccatggagatcacggtgagctccaaggtatagcgaatgccttcaagcacgttctcgttgaacaggtacttccagacggtgggccaatccagtcgcggattggtaatcaagccttgaatgagcatcgcggcgagcagtaccacgatcactgcggccacaatcgggccggggcgcttgaccggcagcgccttgatgcgattggggatgttcagcccctcaccgtcgacttctttcttcgccataatctggttccttggatgtgttgggcagcctgaactgcaagttgcaactagcattgaaccttagtgcacgaatggggcgactgtgttacaaacagtgcgccccattcgaattttcgcgacagcttgtcgactattcgacggccgggttgatttcggccttgtccagtgcgccggattcgacgccccagtgctggaggatcttggtgtaggtgccgtcgtccatgagcttttgcatggccttctgcacggcttcggtggtctgggaatcgcccttcttgatggcgatggcgttcggcacttcatcgaagtccttgccgagctgttccagctgaccatcggtctgggcgatggcgtagccgacaaccggggaatcggcgaagaagacgtcggccttgccggtcaccacagcggtggtggcgtcggtctgctgcttggaggactggatggtgatgtctttcttgccgtccgccttgcactgcttggcggtcttgttgatggcctcttcctcgacggtgccggtctcgacggcaacgttcagaccgcacaggtcgttctcatcgacgttcttggggttgcctgtggccactgcatagcccatgcctgcggtgaagtaggagacgaagtcgacggattccatgcgctccttggtgatggtgaaggcggcgatgcccagatcgtacttggagccgatggccggaatgatcgtatcgaagttggaggagacgatttcggtctcgagaccgaagatgttgcccatggcgcgggcgagatccatgtcgtagccgatctgggtcttgccgtcggcgtcgaggaattcggccggggcgtaggaggggttggtgccgatggtgagcttgccgtccttggtcacggattcaggcagcagtgcggcgatggtgtcatccttctccacggagctgacatcgtagctggtgatggtggcggcatcggagcccttggcggaatccgtaccggcatcggccttgtcggaggtgccgcaagcggcggtggcgaacagcatggccgagctcagtgcaatggccataatggacttcagtttggtggactgcataatcgtttcttcttctctcttacgccgcttcaacggcaacgatcaacggttaagcatatttatacactacagtgcatacatatacaaaaagactcccgccgcagggcaacgggagtcttcatagtaaccgaaactactcgacggacgggttgatctcggccttgtcgacggcgccggaagagacgccccacgtgtcgaggatcttcttgtacgtgccatcatccatcagcttctggatggccttctgtacggcctcggcggtcttggaatcgcccttcttgacggccacggcctcaggggtcacaccaacgtcctcgccgagggcctcgagcgtatcaccggtctgcttgatggcgtagccggcaaccggcgtatcggcgtagaagatatcagccttaccggaagccacggcggtagtcacatcggtctgcagcttggaggactggatgtcgatggcatccttaccgtccgccttgcactgctcgttggccttgttgacttcctcttcctgagtggtaccggtctgcacagccaccttcacgccgcacaggttcgaggagtcgaccttgttcgggttgcccttctgcaccacgaacgtggaaccggccttgaagtaggtcacgaagtccacagcctccatgcgttccttggtcacggtgaaggaggagatgccgatgtcgtacttggagccgacggacgggataatcgaatcgaacgtggaggagacggtgttttccttcagtccgaacactgcggccagcgccttggacaggtcgacatcaaagccgaccggggtcttgccgtcctcggccaggaactcggccggggcataggaagtatcggtgccgacggtcagcgtgccgtcgccggccacggaatcgggcagcagtgcggcaatctcgtcgtccttctggatgctgctggtgtcgaagccttgaatcgaagtgctggacgagtccttggatgaatcgccgctcttggatgcggtgtcggtgccgtcagtcgtgccacaggccgccacggcgatcagcatggccgcgctcagggcggcggccgcagcggattgtattcccttgcttagagacattggatttcctctctccggatagtcagctgggcgggtatgtttcccagatggttccagagcgtaggagtgcaatgctacggaagcgttaatcgtgggcgaaatggcccacaacgtggacatcctactcttggctcccctccggaggggagccaaggggcgggactagtggcgcatgttggcgtagcgcatggcgcgtagggcttcacgcttgtcctgctcttcgcgcagggcctggcgtttgtcgaattccttcttgcctcgggccagtgcgatctccgccttgacgcgaccgtccttgaagtacaggctcagcggcacaatcgtgtatcccttggcctcgatgccgcgggcgagcttggtgatctgcaatcggtgcagcagcagcttgcgcttgcgcttgggcgcatggttgttccatgtgccgttcaggtattcggggatgttcgcgccctccagccacatctcgccacggcggtcgatggagatgaacgcctcggacagcgatgcgcggccttcgcgcaacgacttgacctcggtgccggtcagggccagccctgcctcgtacttgtcttcgatggcatagtcatgccgggccttcttgttctggacgatgagtttctcaccggtttccttgggcatgtctcctcctttcgtgggcaataactcgtgagtagcaactcgtgggtagcaactcgtgggtagcaacgcaacatccgacgatatcacggaccggcctcgaatacgaaaagggttcctcttcaagaggaacccttcaaccgcatatatcggccgaaccaaccggtcagtggacgaaccagtactgacccaaattggtcaaggtgcggtagtgcatgttccacggaccaccccagttcatttcggagatctggaatgtgccgtcgccatacacggcttcgactacggcaacatggccataggtgccgtcggcgccatcctggccgggcaggaaggagagtgcggcgccgacctgcggcgtgtggtccacgcgcaggccgtacgcgggggcgctgcgccaccagaagccgccattgcccagataggacggcgtgccgatgcccatctgcctgcgacgttcatacgcccagtacgtgcactggccggcggcataggcgttgccatagtcgccgttcgacgtgccttggccgccgacgctgggggcgggggcgggagcgggagccggagccggcgccggagccggagcgggcgccggagcgggggtcaccggagtggacggcgtgccgccctggttaccggtatccacccggttggcggcgtcctgctgctccttctggaactgacgattgtaggaatcgacctgggaggcgatcagtacggtctgggccgcctgcttggcggattgggaatccagactgtcgaccatggaggacagttcgttgcgccgcgtctcaccctcctggcgtagcttgtccaaagcgtcacgttcgctttgcgcggtttcggcggcggtctgtgcggaagcggccttctcatcggactgggtcttgagcacagcgatctgcttttcgatggccgccaagcgctcgccacggttcttcgacgtgctcagtgaggtcgcggcggaggaagccgcattcgcctcgttgcgggacaacgcgtcccgggactgcatggagttgacgaagtcctgtgtgctggtggcacccgtcaccacgctcatcacgtcggaagcattcgagccgtgcatctcgtcacgggccagctgggccacggcggcgtgcgcgtcatcgtagtccttgccggtctgcttgatctgctcctcaagcgtctccttgtctttctgcgcggcggaaagacgtccggatgcggcatcggcctcgtcctgagcggtggcggcatcctcgttggcctgtgtgaccttggcctgcgcggcgacaatcttgttgttggtcagatcgtccagctcaagtaccttattcgccaggtcctggctggcaccggccagctgctgcttgagttcggcctcgcgctgtaccgacgcggcgtgctggttctgcgcattgatcaggtcggaataggtgtctgcctgggcaggctgtgccgagctgaacgccagacctcccacacaggctgcggcggccaccagtgccgccagtgcgggcttgatcacacgtacgttcgtcatatgtgaatagtcctttcgctcacttaagccaataccataacatgcgaacctgagaggcttgcacatgatgtcatcacatttctcgcgggtaagccggtcgcgttacgccctcaaataacgccgcaacgagatggttgaagcgatgatggacagcagtatcgcgcccacaaccaggaacggcgatatcaccagtaccgtgagctgattcacataaggaatccatgtaacggatttcgccagccagccggtgacgaacacgttgacgatagccgaaagcatcaggcacgagagcaccgagccgatcagcgaggcgatggcgccctccagaatgaacggcagacgaatcgtccagttcgaggcacccacgtacctcatgatttcggtttcggttcgtctggatgcggcggacatacgaatggtggttccggtcagcaggatggcgaccaccaccatcacgccggcgagcacagccgtaaccgccgtggctcggttgagcacggcgaacaccgggtcgaagatctggcgctggtcggtgacgtcttccacaccctccttgccagagagcacttcggagaccacctgatatttggtggggtccttgagcttgagccagagggagtcctgcatatcgtccgcggtcagcgtacggccttggaattcaccgttcgggtactgcttggtgaaggtgttgtcgtagaaatcctgcttgctgacatagtcgatgttggagaccacgtcgttgagttcatcgcgaatggttttctgcagtgccgtgatctcattggctgagggcgatttgccggaagcgcagttcgcggattggctggtgccgtcggggcatagccacaccacgacctcgaccttgtcgtaccagtcgcccttggctttggtgatctgcgcctgagtaagcaccgaagcgccgatgaacaggaatgagatgaaggtgaccagcgtcagcgacagcagcatcgacaggttacgggtgaggttggcccacgtttcggacagaatgaatcgtgctcgcatatgatcccccttactccttcgcgccctcagcgggttgatcgtcggatgtttggtctgcggcggactgctcgccgacaggcggtacgggcggttccggcggggccggcggctcgggcggttccggcggggccggcggctcggcggcggatgacacggacgtatcggcaaccgcggcggtctcgccggactcgtcattgaacgggtcgaacgcctgggtgctttccagggcggcggcctgctcgtccaacgggatgcccttgccccaggtcagcgtgtcttccagcggcgcgaacgtctcgccatagcggccggtgcggccggaatgcacggagttggacagacgggcgatgccttcggacggctcgtcactgccctcgatggccttggtcgccgccgccagcacatgatgggcggcgtcggacttggcttcgacttcggcatccgggaagaacagggcggaatcgtaggagccatgagcctcgtcacgcacgatcttgccgttgtgcagttcgaccacgcgcttgcgcatcgagttgacgatctcttcgttatgcgtggccatgacgatggtggtgccggtgcggttgatggcgtccagcacttccatgatgcccagcgaagtggtcgggtcgaggttgccggtgggctcgtcggccagcagaatctgcgggtgattcacgtaggcgcgggcgatggccacacgctgctgctcgccaccggagagctcatgcggatagttcttttccttgccggtgaggcccacggtattcagcaccttgggcaccaacgatttgatggtggaccgccgcgtgccgatcacctcaagggcgaacgccacgttctcccatacggttttgttattgagcagcttgtaatcctggaacacgaagcccagcgaacggcggtactgcggcacttgacggttggtgatgcgccgcagatcgttgccggccacgcgaatctcgccgctggtggcctcctcctcgcgcaacagcaggctcaagagcgtggtcttgccggagccggacgcacccacaaggaacacgaaatcaccgcgttcgatatcgaggttgatgtcgtcaagcgccggtcgggtgcctttgggatagatcttggacacattgtccagtgagatcagtgccataatgctgtttactcctcggtttcggcggcgcggcgctgttcatggcgccagcggatgccggcctcgatgaacgcgttgatgtcgccgtcgaacacggcctgagtctggctggtttcgtagccggtgcgcaggtccttgaccatctggtaggggtgcagcacgtaggagcgcatctgatcgccccagctggccttgatgtcgccggcgagctccttcttcttcttggcctcctcctcgtggcgcagcacgagcagtcgggactggagcacggccatggcggaggcacggttctgaatctgcgaacgctcatcctgcatggtcaccacgatgccggtgggaaggtgggtgatgcgcacggccgagtacgtggtgttcacgccctggccgccggggccggaggaacagtaggtgtccacgcggatgtccgtatccggaatgtcgatatggtcggtggcctcgaccagcggcaccacttccacggcggcgaagctggtctggcggcggccctggttgtcgaacggggagatacgtaccagacggtgggtgccgccctccacggacagacggccgtaagcgtagggggcgtccacctggaaggtggcggacttgatgccggcctcttcggcgtaggaggtgtccatgaccttggccttgaagccgttacgctcgcagtagcgcaggtacatgcgcaacagcatctgcgcgaagtcggccgcgtcgacgccgccggcaccggagcggatggtcaccacggcggaacgttcgtcgtattcgccatcgagcagggtctggatctccatctggtcgagatccttctgaatctcgccgatttcgctttgcgcctcgtccagagagtcctgatcgccctcctcgtggccgagttcgacgagcgtttccacatcgtcgatgcgctgggaggcggagttcagacgcttcagctgcgattccgcggcggacagccggctggtgatcttctgggcgttttccgggtcatcccacaggcccggggccgcggcctgcgtttcgagatccttgatatcggccttgagtcggtcgacgtccagcgccttggcgatggattcgtatttggcgcgggcttcgccgatcgcctgggtaaagtcaaattctgccatcgtggtttaccttactgttgattctttgagattccttgggaagtcacgtccttgttgacagccttcgcacattcctctggcgttggcgggcattgccgcgccacacgcgcatccgcctgcaatccatgctgtcagaaggttccgggcctgccttgccgataaccggccgggcgacctcacgaatccctcgcatcagacgtgttcaactgcgggcacgaatatgcgaaggcaacgtcaaagccccgcgtaaatcgccgggatgaccagggagccgagcatggccacagctatgaccacgcacaccacacgcacgatggtgcggcggcggttctcacgctgctgtcggctgtcctgatagttactcacgagaccaatagtgtactcaccgcttacgaccgcaggacttgccgccgacgcccgccctgccggtggacccccacggccctttcccttgcgctttcagcgccgccagatggtgtttcatggccaccagcatgatgtgcgaatcctcaaggcccaggtggcgttcgttgtgggcggaatcaagcgcgccctgacgtttggcgtaggcgtcgagcgtgttgtctccgtaaggatgctcgttggtgggtaccgcgccggggtcccactgccggctcatcggcagggtatcgatgatggtgatgcgcccggcgcggtagctttccgcgtatccggcgacgttcagcatgaaccagctatgttcgaaggtggcgttatgcgccacgtacggctgctgggtaagccgcgcgagcaggccggcctgggcttggggccattcgtcgaagagtcggtacccggcctcgctgctgcggccgcgtacatcgatgccggtgagtttggcgatgagggcgttgccgagcgccgcgttttccggcggcacgccaaaagcgaggcgggactggccgtaggcgtcgccggcggcgtaatagccctgctcataggcgtatgtctcgggttcgccggccgggcgcggactggccatgttcatgaactcgaagccgacgtcgatgatgtagtcacgtgccggatcgatgccggtggtttcgatgtcgatgcccatcaccgcatccacgtcgcggccgggcaggtaggcgtcgcgccagtcgggcttgggatggtgtccggtagcgttgccagacgcggcggcaccacccggcagagcggcaccacccggcgaagtcgcgccggagagattggcgcgggccatcgccgcatcgcccgcccgcttctggaagcgctgggccttacgccgttcggcgcgtgcgtcaagaatcgccgccgtacggtcttggatatcgtccaaggcgactgttgtggggaacttgacatcgctgttttcggcggcagtgtttccggcagatgtgccaccggcttcgccgctcagatccagcatgccttggtcatcgttcgacgggccgctgccggagtacggcttgagcacggcaatggtggccctcccccgccgttcgcgactgaccgcccataggtgttgctgttcgcccagatgcaacagcgtgttgatgttgtcgttgagccgacgattggcgtaggcgagcgcgcgaggcagacgataggagccgatgaaccggtcgaaatcggtcatgaatgcgctgttgcattgggcgatgatcgattccagacgctcgcgtgtggcgtagtcggccttcaatgcgtcgtggatggactgtggggtggattccggtattgtgccgacgccatgcgccaggtccagagaacgcacccagtcccagtcgatggtggtgccatcggcgtccttgggcatggacgccgcccattggggaatgtctcccttggcggcgtcgaaccatgcacggtcggtcatagtgcgaaaccgagctcttcagcggcctcggtgggcaccgggtcttcgcaccagtagtcctcgaggttctcgttggtggtcagcgaacggatttcggcgcgatcgatatacaactcgccgctcaaatgatcggtttcgtgctggaagatgcgtgcgggccagccgtgcagcggctcgctgtggtgtttgccgtcttcatcatcccattcggcggtgatgtcgagccaacgcttgcgcacagcttggtatccgtcgaagctcaggcagccctcgtagaacgaggcggttttgtcgctggtgggtttgtagctcgggttgatgatcacgtggaaggggaattccgcgatttcgcgcggatcatcctcgtcgtcgcgcacgtggtcttcgaccacggcgagcgcgagccccaagccgatctgggtggcggcgagccccacgccgggtgcctccagcatggtggtgtgcatcgtatcgatgagtttggcgagcgtacgcttggaaagctggccattataggccactgtccgttggcgcaacaccggttcgccggcctgcacgatgggcaggagcttctccttgccgccggttttgatgagttgttcgacatcacggttgagttcgaggtcgactttggcgttctttccaaacattgtttttttccttagggaagggtgctacagcgcgagttcttcggcgacgatcttggcgaggcgggtgcagacttcgtcggcgtaggcttgggtggcggcctcggccatcacgcgcacgagcggttcggtgccggaggggcgcagcagcacacggccggtgtctcccagcagttcctcctcacgggccacggcatcctggatgcgcttgttggtggaggcggccttcttgtccacgttcggcacgttgatgagggtctgcggcagctgcgggaagtcggcggcgagctccttcaggctcttgccggacttgacgacctcgttgcacagggtcagtgcggtcagggtgccgtcgccggtggtggcgaattcgcggttgatcacgtggccggactgctcgccgccgagcgagtaatcgcccttgagcatttcctcaagcacgtaacgatcgcccacggcggtttccacggtcttgatgcccatatctttcagggcgagcttcagaccgaggttgctcatcacggtgaccacgagggtgtcgtggttgagcttgccttcgcgctgcttggcgcgggccagaatgcccatgatctggtcgccgttgatcatgttgccgtcttcgtccacggcgagacaacggtcggcgtcgccgtcgaaggccacgcccatcacggcatcggtggccttgaccatggcctgcagctgctcggggtgggtggaaccggcgttcttgttgatgttgtagccgtccggcgaggcgttgatcacgattacatccgcaccggcacggcgcagggcttcgggagccaccacggaagtggcgccgttggcgcagtcggccacgatcttcagtcccttgagcggcttgggctgggttttgtcatcgttcagcggagcgatggtggccaccagatgatcgatgtacaggttggtggcagtggtctggtcgtggctcacgcggcccacgccggcaccggtcgggcggtcccagtcctggccgagcacggcctcgatgtcgtcttccttctggtcgggcagcttgaagccgccgcgtgcgaagaacttgatgccgttgtcgggcatcgggttgtgggaggcggagatcacggcacccatctcaacgttgagcacgctggtcaggaacgcgatgcccggggtcgggatgatgcctgcgtcgatcacgtcgaatccgccggcggccatgcccgcagacagggcggaagccagaaaatcgccggacacacgggtgtcacgacccacgagcgcgcggcggcgcccctcaggctgatcgtcttgggtgccggcgtcgccgagcacacgcacggcggcatcgcccaaatccaacgccagacgtgcggtcaaatccctattggccagtcctcgaacaccatcggttccaaacatcttcggcatatgaagttccactccttgtatcgcgttacccgcaccatcgtagtcgttgtgctccaccctaggacccgactcggcaaaaaaccgccacggaatctgctccagaaccggaaatcagcattcaacagccgcaatggcatcacccacaaacccgcatattcatcttgttcggcggatgaatgatgagatacattcgttagcgggcatgccgggcggaccgatgcactccggcacgggaacgaagccatcgcactagtaagaacgggccggcaaacgcgcctgtaaacaatacagcggcaaatacgacgaacggaactacccagcgtacatcgataaccggcaaagcaacaccaaacagaacgacggcgaggaacacgctgagccatgcgatgaacatgcccaacggcatctcctctaccggggtggtctcggccatgaatgcaacgatctattactccgatgttgtggtcagtatgtgcggcagttgctcgtcgcggttgaggaaagaacgcgtttggcagcgaagtagcgtatgccgaccttcctcagtgcgggcgtataccatggtgcaatgcgtcaggcagcggtccaactgccggctcagtatctcggcgtcctgctggcggcgggcaaatacggacgggcaggggaagctcacgcagtaagcgcgcacgccccattccttaccgatgatgacatatcgcggattgttgatgggcgcgagtagctccttcataacgccggcgaacagcacctgctcgcgccgcgaaccgccaatcagcatgacacgcaatgccgtgaatctgcgacgtgtctggcggatcgaggaagtcgttcaccgcttcgcctgccgcgctggtttctaggcgctcaggttccgcagtcgccaaatgccagacattggccaccttatcggggtctgcgaccacgctgcggttgacggccatgctgtatgcttcactgcatcagtgtaaggcacgaatcaataggttttgagccccagatcgatggtaagaatgatgccggcgattacggcggcggcgcgcatgatgtttgcgggaatcttgcgggtgatggacggggcgatgtacccgccgatgaagcatccgatgcacagcatgatggcggccggccaatcgaccgcgccttggatgatgaataccactgaggcgctgatgttcgcgcctgtgccgatcagggttttcaatgcattgatcttgtggaatgggccgattttggcggcatcaagcacggcgagagccaaggtaccggcgcccgcgccgaagtagccggagtagatggcgaccgccgctacgcccagccatacccaccaggaatcctgactcatgggctgcacgagttgttccggcgggcggtgaggtgcggtaggggtggttgcgcgcttggcggcttcagtggcttcagtggcttcagtggcttcgatgtgcttgagttgcgcggtggcatccgcggcggcttgcttggcctgcatgcggccgcgcggattgatggcgatgatcagcgagctcagcaaaatcagcactggtgcggcaaattcaaagacactcgggtcgagtttgagcaacagaaacgcaccggccaccccgccgaatgcgccgatgaccacatacgtaatggagcgtaccgcttggcctttgagttctttgcgcgcacccatcacgccaccgatgcccgtgccgaccacgccaacggtgttagaagcgtttgccaatacaggcggaatgccgaacgcgagcagggccgggtatgagaccagtgacgatgcgcctaccgcatagcccacgaatcctgcgccgattccggccaacagaatcagcagtaatgaagttatggaaaagcccgcaatcattccccgtatccttgtcgctcatcgaccggcatattgccggccttgagcgagaatacgctgttgaggattggttgcgggttttatgttggaatgtggacgtagcttctcgcggaagcgactcccctcagtcgcctgaggcgacagctcccctcgcgcccgaggggagccagaaggaaatcagagcgcttcgttgtattcgcgaaccttgagggtgcggtgggaggatgccacgttttcgacgatcagacgcttcagggcattgtcggcggcaatgtgctcgtccagccaggcgtcaccgagcttgaccagcgtggcgggatcggcgtagcccgggtacaggccgttgagcaacgcctcggccatgtgataggtcttgttggcccagacccagtcaacggtctcgaagtacttggcggcgaacggctcggccagatcggggcgcggggtggcggagaagccacgggccacggcctcgagctgggagttggtcagctcgtcgttgtggagcgcctgatcccaagcccattccttggcctcagcggtggccatggaggcacgggcgccgtaggcgaactcgcggttttccgtggtctccttcttggcgagctgcgcgtccacgtcgtcgttggtcatctcgttgacggaggtgagcgcttggacgatggtccacgtgaagttgttgtcgatttcgaggccttcaagacgcacggtgccgtccagcagaccgtgtgcgttggcggcgaatgcggcgtcgccctcctcaccgtagcccaagtaggcggtgacgagctggaactgggtgtccgagccggcttcggcggcgttggccagagtccacagttcggcggccacgtggcgcagcacatcgtcgcggcgggcgggcgccacgtagtggtgggcggtggtgctcatgcaggccagcgcgtaacggaaggtggtggattcggtttccgtggccagaagacgcagggtcatgtccacgaagcgttcggccgggaattcgccgtcacgggtcatatcccagaaggcgagccaggtcacggcgcgggccagggcatcatcgaaacgatgcaggttggcttcggcgaatgcctgggattcggcgtcgaaacgaatcttggtgtaggtcaggtcatcgtcgttgaccagcacgaatgccgggcgcggcttgccggctgcggcctcgacgatggtggtttcgccatctacatcgagttcgaactgctcggtgcgcacgatcttgccggttgcggcgtcttcgttgtagaagccgacggccaggcgatgcgggcgcagcaccgggtgttcggccggcgcgctctgggtgagcttcagttcggcgatggtgccgtccgcgtttacggtcaggccagtggcgatcgtgttgatgccggattcctccagccacttggcgctccaggccttgagatcgcggccggaggtcttttccagttcgctcagcaggtcggccagggtggcgttggagtaggcgtgacggttcaggtagttgtggataccttcgaagaactgcgtgcggcccacgtagaatgccagctgcttcagcacggaggcgcccttggcgtaggtgatgccgtcgaagttgacgtaagtgtcgttgaggtcgttgatcggcgcgacgatcgggtgcgtggtgggcagctgatcctggcgcagcgcccagctcttctcgccggagcagaaagtggcccaagcgtcatgccattcggtggcttcggcagtggccagcgtggaggtgaattcagcgaaggactcgttgagccacaggtcgttccaccacttcatggtcacatagtcgccgaaccacatgtgcgcaagctcgtgcagcacggtcaccacacgacgctcggccagcgcgtcggtcaccttggattcgaacacgtaggagtcgcggatggtgaccatgccgatgttctccatcgcgcccgcgttgtattcgggaacgtagatctggtcgaacttggcgtacgggtagggcacgccccaggtcttggcgtagaacgcgaagcccttcttggtgatgtcgaacaggtagtcgacgtccttcgcgaaggccttggccaacgactgtcggcagtactgggccattggcacggtacggccgtcttcgttcaggtattcggtgtgccattcggcgtacgggccggcgcagatggcggtcaggtaggagctcatcaccggggtcggctcgaagtcccacagacgggtgctttcgttcggcttgtcgccgagggtgccgtcgagggtttcgcgcggatcgtcctcgatggtggcaaccggcatgttggaggtgacgatccagctggcgggagcgagcaccttgaagtcgaaggtggccttcaggtcaggctggtcgaacacggcgtagacgcggcgcgcgtccggcacctcgaactgggagtacaggtagatgttgccatcggacgggtcgaccgagcggtgcaggccctcgccggtgttggagtaacggcacttggcttcgacggtgacctcgttcttctccttgaggtcggtcagttcgatgcggttgtcctggaaggccacggctgggtccagggacttgccgttgaggtcgatggatgtcacttcgtcggcgatcaggtcgaggaaggtcgacgaaccaggcttcgcgttgaagcagatgagcgacttggaaccgaagttcttcgcgccgaccgtcaggtcaaggtcgacgtgatagtgaatcggcgcttcgataacggccttacgttcttcggcttcaatacgagtgagattagaaccgggcatgacttcaattactccttacggtcgtccctggataatccggactacttggtttctacggtttcgacgtcctgggcgatgtcggccacgacgggcacgatcatcggcttgcggtgcagctggcgcgcaacccagctgccgagcgtgcggcgcatggtctgctgcagcttgtaggtgtcacgcgtgccctgcatcatctggtcgttgagctgttcgacgatctggtgacgcaccttgtcgaactcgctttcgtcctcggccacggcgttcaggtagatcttcgggccggtgacgacctcgtggttgtcggtgtcgaccaccacgaacgcggatacgaagccctcggtgccgagaatgcggcgcttttccagctcgtcatcggtcagctcgccgacggaatcgccatcgacgtacacgtaaccgcacggcacggagccgacgaccgcggccttgccgtgatacaggtcgaccacgtcgccgtcttcggccaagaccacgttctgcgggtccacgccggtcttgacggcgatcaggccgttggccaccaggtgacggttctcgccgtggatcggcatggcgcacttgggcttgacgatgttgtacatgtacagcagctcgccctcgttgcagtggccggacacatgcacggcggcgttgtcgcggttgacgaccttggcgccgagctgcacgagcttgttgatcaccttgtagacgccgtgctcattgcctggaatcagggagctggcgagaatcacggtgtcgaactcgttgatgtggatgtcgcggtggttgccgtcggcgatgcggccgagtgcggccatcggttcgccctgggaaccggtgcacatgaagacgagcttgtcgtcctgaatgtcgttggcctgcttcaggtccacgacggtgccttcggggatgtgcaggtagccgaggtcggcggcgatggacatgttgcgcaccatcgaacggccgacgaacacgaccttgcggccgtacttgtgggcggcgtccaccacctgctgcacacggtgcacgtgggaggagaagctggcgacgatgatcttgcgggtggcctgggcgaacgcttggtcaagggccgggccgatggaggtctcgggcttgacgaagccgggcacctcggcgttggtggagtccatcatcagcaggtccacgcccttttcgccgatcttgccgaattcgacgaggtcggtgatgcggtggtcgagcggcagctggtcgagcttgatatcgcccgtgtcgatcagggagccggccggggtcttgacatagacggccagggcgtccgggatggagtgggtgacgttgacgaattcgaggtcgaagggacccaccttgagcttctcacggccggcaacctcaaccttggtggggttctggtggtgttccttgcacttggcgtccacgaaggcgagggtcagcttggaaccgatcagcgggatgtccgggcgcagcttgagcaggtagggcacgccgccgatgtggtcctcgtggccgtgggtgagcaccagggcgtcgaccttgtcgagacggttcttgatgtagctgaaatcgggcaggatgagatccacgcccggctgctcctcctcggggaagagcacgccgcagtcgatgagcagcaggtgaccgttgtattcgatcacgttcatgttgcggccgatttcacccaagccgccgagcggcgtgatgcgcatggagcccttgcggtacttcggcggggcgatcagcacggcatcctgctggggtgcggtggcctgccgggtggcgttgatcttacgggacggcgtacggctgttggatccgttggcgttgcggccgcgcgcggaaccgcgacggcgagaattcgtgttcttgcttgttttcttttgttcttgtgccataacctttttgggatttctgttgtggtgcctctgctctgtcatgcaggggcggcgggctggcaacccgtatgcagcgtttcgggcttacagcagtccggcagcgcgcatgccctcttcagccttgtcaagctgagtggcgtcgggaccgatgttcggcagacgcatggtggtggaggggataacgcccttgaccttgagcgcagccttggccatgacggcctgatagccgtcgccattcaacgcgtggacaaggggggcgagctggttggcgaggcgacgggcggtagtgatatcgccgcgatcgaatgcctggacaagctgctgcatggggttggaggcgacgtgggcaatcaccgaaatgatgccgacggcaccgatggagaggaacggcaggaacaggccgtcatcgccggaataccaggcgaggccggtgcgctgctgcttctccactgcggctgcaagatcgccggtggcgtccttgacagccttgacgtgttcaagttcggccagtcggtcgtaggttccgaccttgaccttcaatccggtacggccgggaacatcgtagacgatgatcggcttttcggcggattcgtcgacggccttgtagtggccgacgataccgtcctgcgaggggcgggaatagtaaggcatgacgacgagcaccgcgtcggcacccgcttcctgagtctgttcgaccatacgcacggtgtgtgcggtgtcgttggagccggcgccggaaatcaccggaacgtcgacgacctccttgacggccctgaccagctcgaccttctcatccatatgggtgacgggcgattcgccggtggtgccattgaccaccagaccatccgcgccatcggcgacgaggtatttggcgagcttctgcgcggcggcgaaatcgacgctgccgtcggatttcatcggggtgaccatagccggcagaatgcggccgaaaggtgctgaatcaagaaggtgcatgtcatgctcgctcatagtgtttaccgtacttcccattgtggactcttatactacgtaccttgattgttgctgaatgcgtggcattatggccggagccggtggcaatgccgtgatgcgcgtcccggcgcgcttccctgcctgaaatgcgggggcaactactggtcgactgcgggtcgattacaggtcgaggaagtggtcgaggccgatggtcaggccagccggagcgtcgccggcgagcttgcgcacggcaagcaggacgccgggcatgaagctggtgcggtcgaagctgtcggcccgaatggtcagctgctcgccggcgttgccgaagagcacttcctcgtgggcgttgaggccgcgcagacgcacggcgtgcacgtggatgccgtcgaccacctggccgcgtgagccgccatcggtttcggtggcgtccggcacgggggcgagtcctgcggccttgcgcgcttcggcgatgccgtgggcggtgtggatggcagtgccggagggggcgtccaccttggtggggtggtgcagttcgatgacttcggcggattcgaagtatttcgcggccttggtggcaaagtagtcggccagtacggcggagatcgcgaagttaggtgcgatgaagaccttctgggtttcgggcttcggaccgttggcgatggcggatttgacctgggcgagtttctcgtcggtccagccggtggtgccgaccaccatgtccacgccttggccgatcagggtcagcacgttgttcaggctgacggacggcacggtgaattcgacgaccacatcggtgttgtcggtggtgatctgggtcaggtcgtcgccggcatccaatgcgagcgccagctgcgtatcctcggcgttgttcaccgcttcgaccacgtgcgagcccatgcggccctttgctccgaccaccgaaaccttgatcatgtcttcttccctgtctacccgtacctgcccggcaatgtacccgggacgttttccaatcggcaatcagcctatcaccgccaagccctcacgccaataccccgtccacagaatcaagctccctctgacgagccgaaccgtgaagtcgagctccctctgatgagccgaaccgtgaagaaaacgccggaggcgtttttaggtgagggcgaacgacagtgagcaataattcagttggctgaaagccatcattaattgcgttcgagctggacgcgaagcggactgagggagagaccccggcgaagccgccaaccatccatcgggcgtagcccgatcccgtttcacccacgccgcttggccaaggcccatccggccaacgccaatggcacggacgccagcgtgaagatgaatggcagcatcatgcccacatgagggttggaggcgtcaagcacaatgccggccacggacgagccgatcgacgtgccgaccgtgcctgcggtggttacccagctcagtccttcggtcagggattccgccggcaccagatccttgacgatgaggttgccggtggcgaacgtcggcgagacggtcaggccggcgaggatttcgaagacgcccagcaggatgagattgtccattgacaaccggaagaacacgtagccgacggtcagcagcgacaggaacatcaccatatgcgcccaatgggagcctttgagttggcaagagccgaacaccagcgcgccgatgcacgagccgaccgcgaacatcgccaattgcagaccgaggaagggctcaagtcccatggatttcatggtggcggtaatggacacgtcgaaggacgtgaagctcatattgaacacgatgaacacggcgagcaacggcagtacgccggcatagagcaatacactcttgggcttggcaccgctgcgtttgagttggcgcagggtcagctggtcggcatcttcgcttgcagcggggctgccgtcatcgtgcgcggccacgctgacctgttccacgatgaccggcggctgggtggatttcagcgagaagaatatggtgccgccgatgccgcatgccacggtgggcacgaacagttgggataccggatgcacggaggtggccagccaagccgccagaatcggccccagaataaagacgatctcgtcaatggcggcttccatggcgtaggccgtgttgagcagctgttcgccatcttccacaccgcgcaacgcataggaccaacgggttcggaccaatgcgccgaatgagaactgcgtcagacccatgatgatggccagggcgaacagcagcggaatcggcacgcgcaccaacgccgcgaaggcgaaggcgagcatggccacgatctgcacggcgagcgcaagccggcccacgcgggcttggccgaaacggtcgaaggcgcgggcgtagaacggggtgacgcagctcatggccagcacataggcggcgctcatggtgccggcgatggtccaattgtcgtagagatggttgagcgccagaacgatgccgagactcatcatggagatcggcaatcgtgccaccgcaccggacaggcagaacgccttggctccgggcagcatgaacaggcgctgatagggcgagtgggcagcggacgacttcgaaaccgcgcgagtcgtggacacaataactccttactggtgcgttgtccggcacgtgcgcccgcccacacgtgccatccgaggggtagcggttcccaagcaacgtcacgcggcgcgtttcaaccgcggaccggtacgtggccagtcgtcttcatcgtcggagatgccttgcgatgcataaggtctctccgccggtgaaggccgtccgatgctgtacaggtcatgagcctttgggctcagtcgttgtcagattgttcgggaatgccggagctcaactcggtaaggatttcctgtttggttttcgcgcgggcgtgaagctcgcgcaagccctcgtcgggctcactgacatagtagagagtggcgtcgatactgtccaattccacaccttcgaccgctgccagcagcagtcggtacatgtcgagctgggcgagtttgcgggtgatgtcgtctggcttggtgggccgacgaccggttttccagtcgaccacggtaaagcgtgcggtggtgctggacgggtcaagtccaccgatgaataccgcatcgagtttgccattgaccaggcccacgcccggcacgtccacgacgatggcacgctccgtccacgccgggatgcgcttggcccacgatgattcggccagtctgcgctgccacgccaccagcttggactcggtggcattgtcgctacttatggaagtggcggaggcggcggatacggcggatgcggattgttgagccgtgggctgtgggacagcgggctgccgtgtggatggcttgcggcattgccgctcccgttcggccaaatcggccaacatggcttcccgggaaacgaatcccgcatcctgacctgtatgcggcatacttgattcggcttcatatgccagtaccgcttcatccggcttaccggcattgatgaattgctcagcccacgcatggaactgcgtgccggcctcggccgccggagacgatatgcgcggaatcgggcggataatgctacgccagtagaggcgctcctcccgttcgttcatgccacctacgcgggcttgcaggcttgtcacgttctgacgtccgacggccagaatgcgttgcgccttggctttgactgcctcatcaagcgactggccgctggcggcatcggccatcaaatcggcgtcgtccaccagcaattgcgcccgttgcagcagtggaccggcgtcctggtgctgctcaagtgacgaggaatctgcggcgataacatcgatgccacgtgacagctgttcatgcactgcgtcgctgagggtagccggccacggcaattcgacagcggcatccgtctgcgtaatcggcgtctgccatgcctcccccaccacggcgtcaccgtatgccgcggcatgctctccgataaagaacccttcgggagtggcaatcgcttcgccttgcgccgagatcagcataggcttcccggcattggcggcttgcagccgttccacacagtcctgagccgatatcgcatgttcacgggcttggagcgcgtcatgcacttcaagccagaaattggatggctgagcggcgcgagagcctttgggcaccactgacgggtcccgcccggattcgcccgtataggcgcaataggtcatcagggcatcttctcgcgcacgggtaagcgccacatacatcaatcgacgttcgtcggcatgcagccggcgcccatattcctccgcctgcgtcaaataccagccggatgcatccacttcttccacgccatcgccgaattcgcgcatggagccgaacacttcatcatcaataagctccacatcatccaaagccgccaacgatgcgatggggtcggcttccacatcggcatcatgggggaatcgcggcagaatgccggcatcggcacgcataggcacgggtacggcggtggggttggtgagccaggagtcggcggtctcatgatattcgggtgcggtccagtgaccttgctcggtgcctcccgtatggtgctcgtccagcacgatcttgagatggtcgccctgattgctggggaatccgacggcggtaagccccactaccgcaacggcatcccattccaaccctttggactggtgtacggtcatcagttccacatccaccggagcgtcagggagactggcggcttcatcctccaccgaagccagatgatccacccatgtgatgaacccatgcaacgagggagtttgctcagcggcaatctcttgcgtgtacgtatccaccaaatccacaatcgcatccataggcatatgcgccaaagcgggattggcgcggtgctgcggattatgcagcacaccggccaatacggtgtcgatgtcaagatccaacgcttctatgccggcgcgaatcacgtcgcccagtggccgcccgacggcatcatgcacctgacggagcatcaccgcggcccgggttatggcgttgcgcccgtgtgcgctcaaccgttcaagcagttttaccaggtcgccgcgtagcaatacgtctggcaggaataccgcattggccacctgatcgcggtactcacgcaccacagccgcccattcattcgctggtgtatccggttgggcaaggccggcctgcaccaatgcttggaagcgttgttccgtgttctgttcttcagcaaaacgggccaacatggtcaaatccgctgcggacatggtgaatcgtggcgtggccagcaagcgcatcagcgatcccgtatcggtgtggtcggcggccacgtgcagcaacgccatcagatcgcggatttccggacgttccaacagcgcggaatagccgaccacgaatgtggtcaatccggcctgttccaatgccgcctgatattcgggcatatgtgatttggaccgaaacagcacggcgaccggcgctttctgttcgcccggcatctgttcctgttgttcggctgcggaacggtgccgtgcgatggccgtcttgcagaaacgcactacggcgtcgatctcctgcccggccgtggcgaagcccagtactcccaatgttccttcgggggcatcaggcatggggtcgagcgatgagacatcgacctcacgcatcaatgagctggaaggacgcgacggattggagcgcaacggcagcgtgagattattggcggcttcgagcactatacggctgtttcgcctggtgacggacagcgggaatggcttgtatccggcagacaggtggaaatcttgctggaacatacggaatgcaccagggctggcaccacgccatgcgtaaatcgactggaacggatcacccaccgcgttgacggcggacctctgtgacgcatccacgtggaacagtgctgccagcagagcggcctgcgtggtggaggtgtcctgatattcgtcgagcagcacgtggctgtacctgcggcgcgtacgctctccgatggaggggaagcgctcgataagctgatacgcggcaatggtgaagtcggagaattcggccatattgcgttcccgcttggcttgggcataggcctccaccagctggagcagaatatcgcgtttgcgtgtggtctccagcagcgcaccgcaatgataggtgcagcgggcgtgcaaatgttcggcacggtcatcgagcttggcttgccagctggcgtcggtatctttcttcagtcgtttgatcttggggattttcggctcgtcctcgggcatgggttcgtctgcaacggcttgttgcaatcgattgatgaatgccgaatcccattgccgtactcgattgatcgcatcatcgaagctggtgcagccggcaccgatcatggcactgccaatggcatccgacaacgccagaacacggttcgccaaactggagaaggcgccaaaatcctcactgaacgccagatccatgtgactgtcgatgacttcggtggccagttgaagcgctccggctgcgctcaatggttgcgtgttctgatcgaatccgacaagcagtccatattggcgcacgatggtctggaagaaggcgtcatacgtgaaaatggccggcttgaggaatgcccgatcagacaccgtggcggtcgtagagcccgccatatcaccggccactgcggcggagacgcgttccagcagttcgcctgcggccttgcgtgtgaaggtcaggcccaggatgcgttcaggtgccacacctcgattgataagcgcgatgatgcgttgggtcatcgtaaaggttttgccggaaccggcaccggcaaccaccaatacgtcagcatcgactggcgcatcgatgatggcggcctgttccgcactgggagtgaacgtgctcatgcttgcctcgtttcgaaaatcgtgtcgatctggcctgcacaggcagggcagacgttcttcatacggcagaatccgatatgggtgtcttgcggatgggcctcgatgatggctgatctgctggccgccgcggcatagaatacgcgggcgatcatggtcagcgaccataacgtctgcgtaccggcgagcgcggcgaattgcgcccacgcttcggcactcacaccttcgggaggagtagccggatctatggcgggtatgtcgaagaaacggttggggtctttataccagtatcggggcgtgaacggttcggcattcaacgagccatcagtgaacagcggcggctggaaggcaccttccggagcgtagcttctggctggtgccgcattctgcccgacatggaatagcacgctttggctgatatgcggcattgcggcaagtgccttggcaccgcgcggcccgtcttcggggaacacgaggccaagctgatagcacacgagctgcaaatcattgaaaatctgtttgaccgtgggcgttctgcctgttttgtagtcaatgaggcgaatgcattcgccgccgtctgcgagtacgcgggtttccatacggtcgatgcgcccggacagtctcacggtcagatgctcgtccatgccttccggccaccctccgaccagtgctcccatcagacggaccagcgtgttccgaccgattgggtgcaggccgggcacggcattgtatgcgtcgagtatgtcacgcacatcgaatcgtgcggcaaactcccgttcgcattcggcaccggccaatgcgccaatgctgaagttgctggagttcttgccaagatacgtttccggatcggcgtcgctgcgcacaaagtaatcggcgatgttgcgcagggtatccgccgcggactcgtccttacgggtggcctcatagcggttccgggtgtcggctatggcattcggatcaggacgtttgctctgatagatggcattaagccgtgccgagacagcctcgatgcgacgttccgcgccggccgtggagtccaagcccagtgcggccaacgcctgggcattgtgggaaagatggtccagcccttcctcgctgccttgctgcgcaaccgcatggatgagggttccgaaactggtggccacggagctggggcgaggaccggcgaaccggttctccagcatccagcacaccgggcacgcccataggctgtcgaccgccgatggagataaggtgaccatgggcgcggcctgcgcatccgtcttgcctttccctgtttggataccgtcaggctgtacaccaccagatgacgcgctgtcggatgaggcactgtcagatgaggtatcgccagatgacgcaccgccagatgacgcaccgccagatgacgcgctatccgattgggccggcgattccacaaacgcccagctctgcggatttgcggcgcgcacaccatgctctaacaggagtgtcaacgcaatcgcggcgtcctttgcggcagcctgctgcggttgagcagtggccagaaccgcgcgggcggcgctgaccaacccacgtgggtcggcgtccaatccggccagatcatattcggcgaatcccgcatgtgcccccactgtggtgaaaggcgcctgttgccggttgcgcggatagtattccggcagatacccgaagagaaagtccgaggggctcatgctgtcgttccataccgcgctgatcatgattcgccgtgcacgggtcagcgcgaccaggaaactcttcttctcgcccgacaatacagccgcgaaccgcggatcatgcccggttttgtcgctttcttcaagcgctcccctcagcacgagctcggcaaggtcttcaccaccgaacatggtgttgcgcccggcgaggttcggccacacgtcttgctggaccaccggtatccacgcatattcccagtggcgtccggccgcgcctgccggcgtagtcaatgtcaccgcgtcttccaccggtcctatgtgggccaaggaatcggcctgcacttccatgccccgaacctgtgccatgaatgacgtgatgtctcgactggcggtggaatcatcggcgaactggaacaggcgcattgccgcgtccagccggtcattggccgtacgcccctctgccgtgttgaataatgccgcacgctgccagaccggtgccagaccggtggcgttccacgcaacagacagcgcatagcgcggctgtacgcgctggcttgccggcagccgctccaagccggaagcaacgctgcccaccagatgccacaggttcgcaaaagcgcgggcctgagggtcgttgccgagcaccgcgtggatggatgcgagcgcagcctgcgccggcgcggcggcatcatcaatggcaagcatcacgtacagcgcgtcaacgccaaaggccaagtcatcgccggacggttcaccgagtatttcgacagacactggcaacgaagtcactgacgacgaaaccgctgacgtcgaaaccactgacgaggatgtttcacgacctgtttcacgccgtgtttcatggtatgtttcacgcaatgtttcccatgccgtcgtcagagaggtcagcatggcatcatccgtggcgagatgcgccagcgactccaacgaccccatggccgattcgatcggcgcaagccttgcgggacgcccctgaccgggtttggccccggcactcaccaacgggccgttcatcaacgtggccactctagtccttatatatgccgcgcaggaagccaacgtcatctggcattccgccatcccctcggcacgcaatcgggcaagctccacaagcgcgaacaatccctgcacgaaagtctcgtccttcaaaggacgggtgaccgacgaataccgcaccggtacaccatctcggcgcagtcgttcgccgaacagccgcacggcggcattgtcgtgggtgatgaccgccatgtcgttccaccgaatatgccggtcaagatgcgcccgcttgatgcgccagaccacatcatccagctcctcacgtgaggatcggtacaggccggcggtcaccgtgccgtccgcctgataattcgctgcatcgactccgcccagtatggcggtcagcttgccgggacgctcggccggaggcagcggctcgtcttccggcgagggaatcgacagcgaaatacgagacgcgatcacatcagccatcgtcatgtgcgactgatcagcgacggcactgccgccaaccagctgttcttccttggccttcagccgcccttccacggcacggcgcatcagatattccggatacgatccgcggaaggtctgcaccgattcatccgggttgccgaccagcaccaacttgacgccggcattccccaactcctccaagaagcgcatgccggccagcgtggtgtcttgaacatcatccacaaccagcagccggggcaagcccaacgcctccacacacataggccggtcggaatcatccgcgtgatcggcggcgaatgcctcacgcaccacacgagcgcctgccaccagcaaatacgaggcatccaaacggtattgccccggatataccgcgctttgggctgcaatatattcacggcgcaacgcgaaagccaaacgccattgcaccgacaatcgcgcgtcctccgtcacggcgtccaagagacgtggctcttcgtgaacgcctacaccgagctcatccaatcgggccagcatatcgcgcaactggctgataaacgcatctgaaatacctcgcgtgaacctatccgcgctggtcgagccgcctgccgacgtcggagacggcgaatccgacccttgttgcgagaggcttgattgtgcggaagcggccgagccgggcatctcgccggcaccggcatcgcgtatgagtctcgcccagtcatcctgggcaaagtagacgcgcagcaaatcacaggtgccgcaatcatctcccgctacggcatggcgcagatgcacggccatgacttgacgcagcaaagcatcctgttccgcaccgttcagcaatcgaggcgacggcaatccagttccctcgcgcgaagccgatatggcccggaatgccacggcacccagcgtggtgaccggcctggcctgcacggaaaacccgagctcacgaatcacccgattgcccaatgcgtcggcggccacacggccggatacggccatcaccgcctgcgtgccaccgtagcggcgcagccccgccatcaacaccgataaggcgaattcagttttgccgcttccaggcgtgccgacaatcagcctcgccgctccatcacggtcgatgccgtccagcactgttccaggttcaagtctcgtcatcatggctccagcctaaacccgaccgtcacagagggaaaaattttaccgaacccgacgaagaatcgtacccttgacggtatcctgtagaacgaatgcagggagagcgcattttccaaggagggagggaacagatggacaacattccgatgagaccgccgaagctgcccggatatgatttcgtccagatgttgggaagcggtgccaccgccacggtgtacctatataaccagcgtatgcccgaacgcccggtggcggtaaaggccagcgccaaaacccttgacccacgggccgctgccctgttcaaccgcgaggccaacttcatggccaagctgtcatcccacccgtacattctgccggtatatggtgccggcgtcacctccgatggccatggctacatcgtcatcgaatatgcgccgggcggcacctacaacagcatcatgaaggcccggtccatgacctgcgagcaggtactcgacctcggcatcaagctgtcaagcgcgctgttcaccgcgcatcgcagcaatatcatccatcacgacatcaagcccagcaacattctcatcacctcgcagggcttgcctgttctgggtgatttcggtatctccaccgatgtgtatgaccgcaccgaaaccggattctcgccgccgtgggcaccgcctgaggtgcttcagcatctgaccaatggttcggaagccgccgacatctattcactggcggccaccctgtacgccatgttcgtcggctgctcgccattccagcacgattatcacccgcgttcgcaatcggaactgatttcgctgatcgtcaaccagccattgcctcgcctcaaccgccccgacgtgccggccgatgtggaagcggtgctgcgccgggccctgaacaaggaccccgaccagcggtactactccgcgttggagttcgcacgtgccatgcagcgtgtgcaattcgcatatttcgggcatgccactcccgttaccgtggaagggatgccggcctatcccaaagacatcgagcgtcggcgccgggccacggaccagcgagatcagatcacccgttcgtcacggcgatgggtcaaaccggtgggtattaccgtcggtatacttgcggcgatcaccgcagcggcactgatattcgccttcgtggtcgttccccgcatggacagcgccaccggatcagataccaaacaggtggcgacgcccggcaccaaggatgatgacaacaaccgcaataatcaggatgacgtgatcaccgataccgcgaacgcccagattccttccccggagaatctgaacggcacctatgcggcggatgggtcatccgtgacgttcacctggacgaatccagacccgcaaagcggtgatacctatgcgtgggccatagtgcagggcagcaataccgaccagagcgcgcaaaccgtcacaacgtcagatcccacggtgaccgtcaacgcgcaggaaggctcgcagacctgcattcaggtgtccattgtgcgcaagaaccgccagatgtccgtcagccccgccatcgcctgtgcggccaagccgcaagaatgatccgctcgccactgccgggcatgccaccctggcattgcgtatcgcatcagacgtgcgcccagcagcggcgaattcaccaaatggacaacaggaacggcaggtattggaaccgtaaagcgttgtcattacaccagcaaccagagaaaacaggggtcagggagttcagatggccacatcgtcccagtcatacgatcgtcgccgacgcatcagcgcggctttgcgccgccttatgccctccggagggcatacgtggacggttcccgtaatcacgctcctgctgcttctgggacttgttgccggcgcggtgatcatgagcaccgtcacgcgccgccatgtgcaactggacgatggcaccgtatgggtcacttcgctgaaaaaccagaaggccgcacgattcaacgtaaagaacaaggaggccgacgccggcgtctcctcctccgccccacgattcgacatcgcacagcataatggcgacaccatcctgaccgaaacgaccaaagcctccaccatcaaggcatccacggtcagcaccggtgtcaagaccgacatcaaagccaacaccaccactgtggtcggcggggataccgcagccctgatcaacgagaagaccggcaatgtgtggaccggcttgtcggaaaaccttgattccgtgacccccaccacttccgatccgaaaataaagctgggcgagggcgggcgcatcgcagtaacccacgatggcaaggtctacggataccgtccatccgacggtatggtgctgcgtcttgacaatcccagcagcgccaaggccaaaaccctcgaatcgctgaccgacggcaagcagcagaccgttgaaagctttaccgtcatcgggagcacgccggtaatcgcaaccggcaaaaccgtcatattcaagggcggccgcgtcgatgtcgacacgaccggcaccctcacccttcaggagcctcccaccgatgacatacagtccgattgggtggccgcggcatcaccgagaggccttgcgcttatcccgttgaagtccaatgccaaggcgaatttcatagccaacgggggcaaggcgaatccagcacgaccggtatcgtccaagggctgcgtgtactcggcttggagccagaaggccagcaactacattcgcgcctgctcccccacggataccagcgtcaagccgcaaaccctcgaatccgtcaatactacttccgaattggtgttccgcaccaaccatcgccttgtggtgctcaacgacacggttaacggcaatgtgtggaaccctgaggattccaccaaagtcatcaaaatacagtggaacaaaatacagaccgagcagaccgagaaagaacagcagaacaacgactcggccaacaaccaccacgacttctccaagacctgttccgcacaatccggccaaatcaaagccgaggatgatgaaatcggcgcacgagccggttcggaacagattctcgacgcgctgcgcaatgacgagcagaccgattgttccgtactgaaaatcaccaaggttggcgcaccaaacaacaaagacgtcaccatttcgccgatttacgacggccggtatctgcaactcgatgcctccgccgcatccgcaggcaccgttacctttacttacgatatttccgatggtcgcggccagacctcttccgccacggtgaccgtaaccctgaatgatggaggcaaccacgctcccgtacagttcgacactcctcccgagatcgatgtggagcagggagccagttataccgccaatgcgctgagcagcttcaacgatccggatggagacccgctcactctggtctccgctgtggcccagaacaccgaccaggtgcaggtgtccacccgagccgacggccagcttacgttcaacaccggtgcgctggcgtcgggacgtgtgggcgtcgaggtcaccgtctccgacggcacggcaaccggcaccggcatggtgtatttctcggtcaagcccgcgaacaccttggccgcggtcatcgacccggtagcgaaaaccaccgttcccaacacggataccgtcgtcaagctgtcctcttatgtgcatggcacttccttgcagccggcacaactgactcaggtggatacgcccaacggcgcttcgacgaccaccaatgcggcggatatgtcgttgacgttcaaggccaccaatcccggcacctattatgtgccctacatcattactcaaggttcgattccggccaccggattggctcgagtcgaggtgcagcctgccaccggcgaggccgccaaaccggttgccgccaacgatgtcgccctgcttggcgcggataataccgccattgtggagccgctcaccaatgacgtcgatccgatgggcggtgtgctgtccgtcaccacggtgagcgcaccggccgactccggcatcaaggttggtctcgtcagccataagcgcgtgtatatcaccgcgcgtcaggtgcccacgaagcccgtcgcccttacctacaccgtggccaacgcctccggaaccgccaagggcaccatcgtgttgcagccgccggctctggccacctcgaattcagtgcccaaggccagcaatatcaatgcccaggtgcgtaccgacggcatcgtgtccgtggatgtgcttgaccatgtggcctactcggatggcaccacggtcaaactcaagaacaacctgcaatacgacaaggggacgttcaagggtctggccttcgtctctggagacacggtccgctaccaagcatccagcgagaccggcaacttccccatcacctatacggttgaagacaatctgggtaatgtggcttccgccaatatcaccattaccgtgcataagagcgacgcagcgagcaaggccgcgccaaccccgcatgacgccgaagcgcaggttgccgccgggcagaaggtccgcatccccatcacactgaccggcatagacacggatggcgacgacgatcagctgttgggtctgggcaacaaggcacccacgctgggccgcatatccgaagtcggttccgactacttggtctatgaagcgtatccggattcgtccggcaccgacaccttctcctatgccgtggaggattggaccggtcagcgcgcacaggcgcagatccgcgtgggcgtattccaaggatcgtccgactccggcgtatacgccagggatgacgaaatcacgttgaggcccaatacggccgcaaccgtgccggtcgcgcagaacgacatctccggcgacaacaccaatctgaccgtcgacaagcatgtcgaggtccaaggtctcgacggggtgagcgtgaaagacaatatgatctccttcaccacgcccggcagcgccaccaccgactatatcgcctacacggtcaaagacaaggccggcttgtccgatacggccaccctcacggtaaacgtggatccgagtgccgccatcgagccgcctaccgcctacgactatcgtgtgccgtccgccgccaccatcgataagaagtccgtggatgtggatgtttcccagtggatcgccaatccttccggcacagccaatgagctcaaggtcggcgtgcatccctccgccagcgctcacgctcacgtcaagggcggcgagcattcgaccaccatcaccgtcgacctgacgtcacaggcgcgagccgtgccttacacggtgaccaatacgaaatacaacatcacctccaccgcgttcatccaggtaccggcctatggtgtctttccgcccacgctgcgtcccaaggcaccggaattgaaggtcaactcgcgcgagaccattgaaatcaacatcaatgactatgtccgcgtcggcgccggcaaggaaccgtatatcgaaagcgctgattccgtcagcgccaccaaggcttccaactccgatttctacgtgaacgacaagaccctgaagttcactgcggcaaaagactacgcaggccccgcctccattacctttaccgctgtggatggcaagcagggatcggataagaccaagatcatcaattccgcagtgatcactctccagatcacggtgataggccgcgatgtgccgccgcccacgttctcgtcctccactattgatgtcgaggcgggcgcggaccccaagaccgttgatctgacggcgctcacccatgcaccgtccggcgtgtatgacgacgaaaagcaatacacgtattccggtggaagctcatcatccaggcaaatcaccgcaaacctgtcccgttccggtagcttgcaggtttccgccaccaaggatgccgatcctggcaccaccgcgtccattcccgtgcaaatcgcatacggcgcgggcaccgtgaatgccggtgtgaccgtgcgcgtagtgtcttcgacccgtccgctgacacgcgtcggcaacaagacgttgaagatcaaggccggtgccagcgatgccgtgaacgtgcttaccggcgcgtacaatccgttccccgattcctcgctgaccgtcatcagctgcaaggcggatgacgccgccaaactcaccatcgccggatgcgatgcctccggaaacatcaccatcgccgtcgcatccgatgtaggtgcttccacgaacaccgtgctcgtcaccgtgcaagacggcaccaagtccaaggatcgtgaagtcaccgcatcgattaccgtgtccgtgatcgacaagcccgagccgccactgctctcccccgtagccggggaaccgcaggacagcgcggtcagcctcacatggacgcccggtgccgccaatggcagcccgatcaccaactacaaggtcagttggaccggtgccgtcaccggagagaaggattgcggtaccgtcacctcatgccaggtcactggtctgaagaacggcaaaacctattccttcaccgtcgccgcgcgaaatgacgtcggctggtccaagccgtccaccgccgccgaagccacaccggacaaggtgccgtccgctcccaccgatgttacggtcacaggtggcaataaaaccgccaaggtgacgtggaaagcgccgagcggtgatttcagcgccgtcgacaactattcagtgaccgtcaccggtgcaggtgctccgcagaccaaggaaaccggcaatacggccaccgagctgtcgtttacgttcaacaacaacgacatttccgatggcaccgccattacggcgaccgtcaaagcccataacaaaatcaattggagtgccgagtccgccgcatcgccgtcagagaagatctggggagacccggatgcgccgaacattgcgttgtcgaacgacgacaccacggtaacggcgaaagtcactctcggcaataaccacaatgccggctgccggcgaatttccttgggaggagacgtcaaggacaccatcgattgcagtgacagtggcgctacgttcgatatcaatgagaacgatttgaacacccgggaaatcaccgtaacggccaccgtggtgccgcagcgcgatgcttcctccggcacgggcaagagcagctttgtcccgcagtacaaggtccagccgcccactgacgtctacaccaccggatccggcagtacatgcaccgtgcattggaccaagcagggacatgcgcagtcctacagcgtgactgccgatggcatcgattccggtacagctactaaccggaactcactcgacttccgaatgagtccttgggccaaatgcaacaccgcatcggtgcaacaggtgttcaacggcgctaccagcgacgccgtcaccggaggcccgcacaatggcgctccttacacctatgagaagaaggctgtaatcaacaaaccgcaggagctgcgctggtcagacaacgctcacgtcattaacgtcaccggcggttcggttgatgtctatggcaagtcggccactgtacaaatcatcatcaatggccaaccgttcacgtggaactccggccagccattggatgtcaccgacttggccgtggccgccgatggcaactacgcgtggagcgtcaaagtcaccggcgggccgggatactccggtctcgacaacactgcggacggaggcagcgtcgcgggcacacgtccctctgactcctcggaggggaccaagtcgctcaaatccggtaccgatgtcaccactttggccaagaacccctggattcttggtttcggcaataccccaatatcgtcaaccaccattcacaagcagtaggagaacatccatgagcgagaacatcgatgacgcgacgcagttgtctgacacgacccgtctgtccgacagcacgcagctatccgacagcacgcacttgtccgacgccacgcacctggcatccgcaccacacaccggcacgaccccaagcaccgagtcggcgccgcagtccgttgcgctgcctaacctgccgcagcggccgtcacaagcgccgtcagaaaagccgtctcctactactgatgccgcctccattcctgcgggcgatgacagcaccgtgctcaagccgcgcaagggatcgacgccagccatcccgcagcaggccaccgcgcaatcccagccgcaatcacagccgcagcgtcagtcgagcaaagccgcgcaagcagccgcatcggcactgcccgccagcatcaattccggactactgccccagcccacggctcaggtccgggatttccagcagtccttcaatgcgctggtcgaaaatgtctccaaggtggttatcggcaagaccatccctatcaagcaatgcgtcaccgcactgatggtcggtggccatattctgcttgaagacaaccccggcaccggtaagacccagttggcccgaggcttggccaattccatttccaccggtttcaagcgtgttcagttcacgcccgatctgctgccttcggatgtggtgggtgtgactttctacgatcagaagcgcggagaatttgagttccgcgaaggcccgattttcgcctccatcgtgctggccgatgagatcaaccgtgcatcgccgaagacgcagtccgcgcttctggaggttatggaagagcagaaagtcaccgttgacggcgtcacacatgatgtgccgcagccgtttatcgtgattgcaacccagaaccccatcgagcagctcggtacctataagctgcctgaggcgcagatggaccgattccttatcaagacgtcaatcggctacccgggccatgatgtgtccgtcgatatcctcaagcaggtcgatatcaccgaccgtgcgcagaccatttccccggtgctgagcggtgacgatgtcatgcggctgcgtcaggtggccaccgaaatctatgtggataatgcgattcgtgaatacatcgtcaggctcgtcgaggcgacccgccacaacgagaagatcacggtcggctcctccatgcgtggcgctttggcactgacccgatgcgcccgtatctgggccgcggccgatggccgtgcctacgtggtgccggatgacgtcaaggaccttgcagtggccgtgctcgcacaccgtatcacgctgactccggaagccaccttcgatggcgcgactccggaaagcctgatcgcacaggtgctcgaagacgttccctcccccaccatcggttcctgatagggcccggaaaggtatccgaccatggcatctacatccgccgcattacgccgtcgccggcgcgctgaacgcatgttcaagcgcgcggtaagacgcatcagacggttcttcgcatcctacgtctcgcccttgggctgggcggtaacgggcgcaggcatcgcatgccttattgcgttcccgtttctgggctggtatgagctgctcgtattcggcatcgtggcgatggtgatgatgctcgcggcaatcgtgctttccctcggcaacacacgcttccacgcgtccatcgtcgtatccaatcatcgcgtgaccgtgggagacaccgtatccgttatcgtcggcatcgacaacaccggcagaacgccgacgaccacggcacgcggatatctgccaatcggcgatgcgcatgaacgattcaacatccccatgctggctcccgggcaatccaagcaaaccgatgtggagttccgtaccgtatcgcgcgcaatactgcccatcggcccattgcgcatccgcaagggagacccgttcggtctggtgcgtcacgaaaaggagctggccgaccgcatcaccgtattcatccaccctcgtaccgtgcgtctcgatactctgaatgccggcgtgccccgcgacctggaaggccaaccatccggccagatcgtggatgatgatctcgacttctacggattgcgcgaatacgagccgggcgacgacgtgcgtaacgtccactggctgagctccgcgaaaaccggcacgttgatgattcgccaatatgaggccacgcgccgcaccgacacctcggtgaccatcagcgtgaacccggacgaatacgtcaacggcgaggaattcgagatggcggtgtccatccactcctccatcggcgtcaaatgcctgctgcaggatcgtccattgttctgccacgcgggcaacgcgcacggccagccgcgcaacgccatggagttcctcgacaacgccagtgccatagagcctgatcgtgaggataatccgaatctcgccgagggcacgctgaagcacagtcctgatgcttcgttctattttttcactgttggatcgctgaaagacatcgagcaaatcaagcgcatgaccttggccttgccccgatcggccagctgcgtggtattgcaggccagcgccggcgccaatcgcggcatcagaagattcgccaacttcacattggccaccatcggcgacctcgatgatctcccgctgatcatgggggtgctcgcatgaccttcgaccagtccagtatcaccaataccaataccgctgcgtacgccggatcgagcggcacatacaccggcacttcctccggcacgtacaccgggacctccaccaccaccggctcctgggccgactccacacattcggttatctggatgaccagaggcaatgtgcttcgcggcatgggcctcagtcgccagccgtggggcaaacgaatcgccagcctcgtactcatagcggcgatgatgttgctggcgcaagccaatctcatcgacgtgtacggcggcgtggccacttgggcgattgccgctgtaccggccaccttgctgggcgcgatcatcgctctggcgggcatgttgccggcgttgcgactgtggtggcaaatcgtgtttctggcgtttgcccaattcatcatcggcccggtggtaacgctgagttccactacgtcccattacgtgattcccaccttgaagaccttgagttcaggttgggaaatgacgtttggctcgttcaagtacattatttccgtcgatccgcctctgggcacgcaagacggcgtgctgatggcggtatggaccatcggcctgtggcttacgttcttcaccggcgtgtttgccattaatgccaacgcatggttgtctctggtgggagtgctgccccttgcggcggccgtggccgtatgtgccctgctgggcacagacagcggctggcaacgcgccatctgcggtattgcctttgccttgctgctgattatctggctgtcttggcgtcttgaactgctggaaggggggcgctggatatccgcgctgatcatcgtcgtgctcgctgccggccttgctttcgggggcacgttgctggtgccacaggaccgtttcgtgctgcgtgaccgctacgatccgccgttaagcccctacgattacaccagcccgctcagcggcatgcgatcctatatcaaggaccacaaaaaagacgtgttgctgaccgttcataatctgccggccggaacaccggtcaaacttgcggtgatggatcgattcgatggcacagtatggaacctgtccgattcttccgaagccacggactcctcgaattatcatcgcgtgggcaccacgatcaaggcggatgagcagggtaaatccttcactgcgaccttcaccgtcgatcaggaactgaccgacacctggctgccgctggcgggagcggccactggcgtgagcttcgccaacgatgccgacaacggcaatgacacgttttactacaacacggataccgattccgccattattcccgccggcacgcgtaaaggcctcacctataccgaatccggcattatcgcccgcaagcccaccgataagcagatcagcagtgcggctgcggcccgcatcacccaaccagaagcccaggatgttcccgattcggccagcaaactggccacgtccattgccggcgggcagtcctcgggcggtgccgcagccacggcgttggccgacacattgaaagactccggatggttctctcatggacttgaaggcgactatccctccgatgccggccatggcaactaccgcatcaacaagctgctggcaggcacggccatggtgggcgactccgagcaatatgcctccgccatggcactgatggctcgtgatctgggactgccctcccgtgtggtcctgggcttcctaccgaaaaacgaggatggcgaaatcaccgatgcccgcacggagaagacctcaggcaatggcaccaaaatcgaattcaccggcaacgatgtcaccgcttgggtggaaatcaaattgcagggcctgggatgggtggcgttctatccgacgcccaaggagaccaagatgcctgatgaaaaccagaacctgacgccgccgaatccgcagacgctggtccggcaaccaccagtgccgttgaccgatccgctgcgcgatcagacgcaagccaagggccaaagctcattggccggcgccgacgccgatgattcgccgaccaacctgttctgggcgcggttctggcgagtgacccgcaaggtggccctgtacggcagcccattgtggaccctactcatcgcctgcggtctgattctgatgttcaaggccatactgctggcacgagcgcggcgacacggcagtccgaaaacccgtgtggcagcaggttggaatgccatacgcatgcttgccgagcaaagcggcatcacagccaagggcactcgtcgagatcaggccggtgccatcgcccgtcaactcggcacagatgaccaggctttgatccagcttggccgggaagccgactacgccacgttctcggggcaagacattgaatcgggccaagccaccacatattggacaggagtcgaccaattacgcaaggcaatgctcgcttctttgccgcgtttcaggaggatacgtacacgactttccctgaaaagcgtggctatactgtcaaatgggcacgcagcaaagccgcacacgacgcatgtcaagcgcacgcgtaagaaggggaaggcgtcatgaccacaggctccatccgtatcgcgatgaccagtgacgtgggtcttaggcgcaaaaacaaccaagacaccggattcgcgcaacaaggcgtgttcatggtctgtgacggcatgggcggcggcaaaggcggcgagcaggcaagccagttggctgcccagcatttcgcacaattggccgccatgccttcacgcacccgtcaggatatcgacgacaccttggcacgggcccagcacgacattctcgatctgggagaccgccttggcggcgtggccggcacaacctgctccggtttggtactgccccaagatcatgcggattccgccagcgcccgcagcgctgctttgttcagtgacgccgatgatcaggacttctcggaccagacctatgtggtcaatgtcggcgattcccgcacctaccatctcagtccgttggcgcatgccgatgctcccgccacggatatcattcccgtgtgggacgccgcttcgctgacccgcatcacgcgagaccattcccagcgccaagaagccatcgattccgggcagatgttgccggaagaggcggaggcgaccattccacgcaacatcatcacccaatgtctgggtgatccggatggcatcatgcccgacgtatatgtcgccgatctgaccggccgcttcatcatctgttcggatggattgcatggcgaggtgccggacgaacagatcgcggccatcgccgcggcgcattccagtccgcaggaggccgtggacgccttggtggcggccgctcttgatgcgggcggaaccgacaatatcactgtgattgtggccgatatgccattgaccgaacccgaacatcatgcgttcagcgcattcaggctggacgaaggtgaggatatcggcgccattgaagacgcaacactacaaacactacggaccatacgttcggcataaccgagcgaacataaggaggtaatcccatggttgattatgatgctgcggtcgctgccgttcaggatccgaacgcggatccgattctgctggcaaaaatcgcctacgagaatccggaattcggtgccaatgtcgccgtgaatccgcgctgttatcccggcttgaagcgttggatcgccgagttcggtgacgatcgcgcccgcgagaccctggcgcaatacgggttcactgccgaggcattcggcggcccggttcaggatcagaaagccacggcacaggcggcccagcagcccgccgccgaacaggctcagcagcctgcggctcaggcggcattcgaggagcctgtggccaccaatccttacggtttcaccgccgaacaggccctgaccaccaccgaccagatgcaaatcgcccagattgcccagtacgcgcctgaactacgcgcctgcatcgcacgtaatcccaacacctatccggcactgatcgaatggctgggccagctcggcgacccggcaatcaacgccgctctggcttcccgtcagtgaaaggacggcatcatcatggccaaacttccctaccctccagcacctgaactgggttggtattctgacgatccggtggaaggcaccccggattccgcagttggcacagccgaaccgcagaacgactacgggcagcccagtaccgcggaagcggcaaccaataccgcttttaccgcagagcctgccgccacggccgccgccgctgagcccgctgccaccgctccggcagacaccacaccgcacgccgccgaaaacgacatcgaggattgggacagcaccgtgctctcctcctcgttcacgtccaaggcaccaaagaagacgtacctgctgcataacgatgtcaccggccagaccatcgtgatcgataagagcacgttgctgggccgcaagccttccatggatgtgccgcagggtgccaaggcggtgcgtatcgtagacccgacccgcaccacatcccgcaaccatgccgccatcagcatcgacaccgatggcgcgctgtggatcgaggactacggctcgttgaacggcacctacatcatcaccaatggccaagagacacaagtcaccaagggcacaccgctcaagctcagcgcgcctgccacggtgcgtatcggagaccagttcttccagttcaccgaaaaacaggcttgagtaatcaagcaacgagcggctgcctgctcttgttcaacaggaaaatcacaatggcaaatatacggatggcccggaactgatatagttccgggccatcttattgcgattaacgcaagatctgagtcctagaaggggcatcctttctaggaccttctcacttactcctcgatgtcaggctgaccgccctgatcggagtagaaatcatccgggttgaagtcgtcgccgagcttcagatcgccgaactcgaggttcgagaagttcaggtcagacaggtcggcgtcggagaagctcgcgtcgccgagatcgccatcgccgcccagaccgaagttcgggtagatggtgtcgcggatggccttgtcaggctcgaccacggcgttgcggtagcgcgcgaggcccgtaccggccgggatgagcttaccgatgatgacgttctccttgaggcccttgaggtcgtcgaccttctcggagagggcggcttcggtgagcacgcgggtggtctcctggaaggatgcggcggacagccaggagtcggtggccagcgacgccttggtgatacccataagcgccggacgaccgacggccggacggccaccgttcttgacgatgttgcggttgatctcgcggaagcgggcgttgtccaccagctcacccggcagcaggtcggtgtcgccggagtcgatgatggtcacgcgacgggtcatctggtgcacgatgacctcgatgtgcttgtcgtggatatccacaccctgggagcggtacacggtgtgcacttcctccacgatgttgacctgggcggcgcgcttgccgaggatggtgaggatcttcttggggtccacagaaccttcgaccagctgggtgccgaccttgatgtggtcgccgtcggcaaccttgagcggcacgcgcttggagacctggtaggtgatcggcttgatcacgccgtcttccttcggtgcgccggaatcggcgtccggggtcaggatgatctggcgaccgcgatcgttctccacgatcttgatgctgccggcgaactcggtgatcggggcctcacccttcggggtgcgggcctcgaaaagctcggtgacacggggaagaccctgggtgatatcggaggccgcggccacaccaccggagtggaaggaacgcagcgtcagctgggtaccaggctcaccgatggactgggcggcgacgataccgacggtctcgccaacatcgaccagcttgttggtggccaaggaccagccgtagcacttggcgcacacgccgcgcttggactcgcaggtcagcacggaacggcacttgacttcctcgacgccgtgggccacgaggtcgttgagcacgtccatggacagggcgtcgtcgcgcttgtacagcacggtctgtccgtcggccgggtcgatgacgtcggcggcgagcagacgggagtacgggccaccgtcggcggccttgacgagcaccaggttgccgtcgttgtcgcgctcggcgacgcggatgggcagaccggccttggtgccgcagtcctcttcgcgcacgatgacgtcctgggagacgtcgaccagacgacgggtcaggtaaccggattctgcggtacgcagtgcggtatcggccagacccttacgtgcaccgtgctgggagatgaagtactccagcacggacaggccgtcgcggtagttggacttcacaggacgaggaatgatctcacccttcgggttagccacgaggcctcgcatacctgcaatctggttgatctgcatcatgttgcctcgtgcaccagactgcacgatgatggccaggttggaggtcgggtcgaacttctcctcgacttccttggacacttcggcggtgcactcggtccacaggtcgatgagttcctgacggcgagcttcctcggtcaacagacccatctcgtagttggcgttgaccttgtcggccttggcctcgtactcggcgatcttctcgtcgcgctcgggcggctcgttcacgtcggagaacgcgaaggacacgccggaccacggtgcgcgggtgaagccgagatccttcagggcatccagcgtggcggccacctgctgggtggagtaacgcatggcgatgtcatcgacgatcttggacagacggcccttggccacctgctcgttgacgaacgggtagtcggtcggcagggtctcgttgaacaggatgcggccgtaggaggtggcgaacagcacggtgccgtcgtggaagcgttcttccttgacgacctcgtcctcgccttcgcgcgggtcgagcaccttgacttcgccgggctcccagttcttcggcagcacgaagctctcgggcaggcggatgagcaccttggcctgcatgtcgatctcgtggcggtcgagggccatttcggcctcttccagcgaggagaacacgcggccctggcccttgacgccttccagcacggtggacaggtagtacaaaccgaggatcatatcctggctcggcatggtcacggtgtggccgtcggccggcttcaggatgttgtcggaagccatcatcagcgagcgggcctcggcctgggcttcggcggagagcggcaggtggactgccatctggtcaccatcgaagtcggcgttgaaggcggcgcaggccagcggcggcaggtggatggccttgccttccaccaggatcggctcgaatgcctgaatacccagacggtgcagcgtaggtgcacggttgagcagcacggggtgctcggagatgacctcctcgagcacgccccacacttcggcgtcgccgcggtccacaagacgcttggcggacttcatgttctgcgcatagttcaggtccacgaggcgcttgatgacgaacggcttgaacagctcgagggccatcggcttcggcagaccgcactggtgcatgcgcagggacgggccgaccacgatcacggaacggccggagtagtcgactcgcttaccgagcaggttctgacggaaacgaccctgcttacccttgagcatgtcggacagggacttcagcggacggttggaggcaccggtgaccgggcgaccacgacggccgttgtcgaacagggagtcgacggcttcctggagcatgcgcttctcgttgttgagcatgatttcaggggcgccgagctcgatcagtcgcttcagacggttgttacggttgatcacacggcggtacaggtcgttgaggtcggaggtggcgaagcggccaccgtcgagctggaccatcgggcgcaggtccggcgggatgaccgggatcacgtcgagcaccatggcctccggcttgttgccggtggtcaggaaggcgttgacgaccttgaggcgcttcagggccttggtcttacgctgttcggaagcgtccttgatctcctcgcgcagttccttggagatggtctccaggtcgagggactgcaggcgcttcttgatggcttcggcgcccatgcagccgtcgaagtaatcgccgtagcggtcctgcatctcgcgccacaggtccacgtcgtcgaccatgtcgccgggcttgagcttcttgaacttgtcgaagacggcgtccacacgggcgatctggtcgttgtagcgggtgcggatggcagccatatcacgctcggcaccgttacgcaacttggtgcgggccgggcccttggcctcgccggcctcctcaagggcggcgagatcctcttcgaccttcttggcgcgggcttcgatgtcggagtcacggcgctgctcaaggcgcttgatctcggaatcgaactcgtcctgcaggccgggcagatcgttgtgacgctcgtcttcgttcacctcggtgaccatgtaggaggcgaagtaaatcacgcgctccaggtccttcggggtgacgttcagcaggtagccgaggcgggaaggcacacccttgaagaaccagatgtgcgtcaccggggcggcgagctcgatgtggcccatgcgctcacggcgcacgcggctgcgggtcacttcgacgccgcatcgctcgcagacgatgcccttgaagcgcacgcgcttgtacttgccgcaggcgcactcccagtcacgggtcgggccgaagatctgttcgccgaacagaccgtccttctcaggcttcagcgtacggtagttgatggtttcaggcttcttgacctcaccgtggctccaaccacggatgtcatcggcggtggcaaggccgatgcgaatcttgtcaaatgcgttgacgtccagcacttgttaatccgtttctgttcttgagaccttcccaagctccccttgtcaggggagctgtcagccaaggctgactgaggggtagtgcaaaccggaaaggtctctgtacgttatttatttcacgttggcggagctacacgcggcgtattgaccgcatgcagcccgagggatcactggtattcgggctcttcggccttctggtcttccttggcggccgcgtcggggcgggcgccgatgttgaagccgaggtcgtcagcggagctggccggatcgtcatcctcatccttcatgtcgatggccacgccttcggcgttgagcacttcgacgttcagggacagggactgcatttccttcaggagcaccttgaacgactcggggatgcctgccggcggcaggttatcgcccttgacgatggcaccatagacacgcacacggccgtcgacgtcatcggacttggtggtcatcatctcgtgcagcgtgtaggcggcgccgtaggcctcaagggcccacacctccatctcgccgaagcgctggccaccgaactgggccttaccaccgagcggctgctgggtgatcatggagtacgggccggtggaacgagcgtgaatcttgtcgtcgaccaggtggtgcagcttcagcatgtacatgtagccaacggaaatcggcttggtgtacggttcaccggtacggccatcgaacagggtggccttgccgtcggggccgaccagacggtcgccgtcgcggttcggcagcgtggtggacagcaggcccttcaggacctcaggcttgacaccgtcgaacaccggggtggcaaccggggtgttcggctcggccttctcggcaccggacggaatcagtttcttccactcggcttccagattcggatccaaagagatgtcccaaccggagtgagcaatccagccaaggtgcagttcgagcacctggccaaggttcattcgggaaggcacacccagcgggttcagcatgatgtcgaccggagtaccgtcagccaggaacggcatgtcctcttccggcaggatgcgggagatgcagcccttgttgccgtggcggccggagagcttgtcgcccaccgtgatcttgcggtgctgggcgatgtagacgcggatcatctggttgacgccgttgggcagctcgtcgccgtcctcctcggcatcctcacgggtgatttccttgacgccgatgacggtaccggtctcgccgtggggcacgcgcagggaggtgtcacgcacctcgcgggacttctcgccgaagatggcgcgcagcaggcgctcctccggggtcagctcggtctcacccttcggggtgaccttaccgaccaggatgtcgccggcctcgacctcggcgccgatgcggatgatgccgcgctcgtcgaggttggccacggcgtcctcgccgacgttcggcaggtcgcgggtgatctcttcggcacccagcttggtttcgcgggcgtcaatctcgtactcctcgatgtggatggaggagagggtgtcgtcctgcacgaggcgctgggagatgatcacagcatcctcgtagttgtagccgttccacggcatgaaggcgatgagcaggttcttgcccagggccaggtcgccgttctggatggcggggccgtcagccataaccgagccggcttccacacgctcgccgtcgtggacgatcgggcgctggttgtagcaggtggtctggttggagcgctggaacttggccagcttgtaggagctggtggtgccgtcgtcgttcatcacgcggatcaggtcggcggacacgtaggtaaccacaccgtccttctcggacttgatgacgtcgccggagtcgttggcggcgcgccattcggagccggtgcccaccagcgggcgctcggattcgatcagcggcacggcctgacgctgcatgttggtacccatcagtgcacggtggccctcatcatgctccaggaacggaatcagggaggcgccgagggagaccatctggcgcggggagacgtccatgtagtccacggagctcaccggcacatcgaccgcctcttcttcgccgactcgggcaagggcggacttctgcacgaagttgccgttctcgtcgagctcctggttggcctgggcaatgacgtggtcaagatcgcggtcagcggtcatgtactcgacctcgtcggtcacgtggccgttgacgaccttgcggtacggggtctcgatgaagccgaacgggttgacgcggccgaaggttgccagggagccgatcagaccgatgttcgggccttcaggagactcgatcgggcacatacggccgaagtgggacgggtgcacgtcgcgcacctccatggaggcgcggtcgcgggacagaccgccggggcccagtgcggagagacgacgcttgttcgtcacaccggacagcgggttgttctggtccatgaactgggagagctgggaagtgccgaagaactccttgatggtggcgttcaccgggcggatgttgatcagggactgtggggtgatggcctcggcgtcctgagtggtcatacgctcgcgcaccacgcgctccatacggctcagaccggtacgcagctggttctggatcagctcgccgacctggcggatacgacggttgccgaagtggtcgatatcgtcgacgtccacgcgcaggtcaacgtcttcgccgttgcgcttgcccgggaaggtcgccgcaccgtcgtgcagggccaccaggtacttgatcgtggcgatgatgtcttcctggtggagggaacgatcgttgaaatcggcctcgacacccagcttgcggttgatcttgtagcggccgacgcgggccagatcgtagcgcttggtgttgaagtagaaggagtccagcaggttcttgccggcctcgggggttggggtgtcggccggacgaatcttgcggtagaggtcgacgagggcctcgtcctgggtctcgagggtttccttctccagggcgtcgagcaccagcgggtaatccttgaaggcctgggcgatctcggacttggtcatgccgatggccatgaggaacacgatggcggactgcttgcgcttgcggtccacgcgcacctgcggctggtccttcttgtcgatctcgaactcgagccatgcaccacggctcgggatgatcttcgcgccgaagacctccttgtcggaggtgcggtcctgctggcggtcgaagtagacgcccggggaacgcacgagctgggagacgatgactcgctcggtgccgccgatgatgaaggtaccgtgcggggtctgcagcgggaaatcgcccatgaacacggtctgggacttgatctcgccggtgtcgccgttctcgaactcggcattcacgtacagcggtgcggagtaggtgtaatccttctccttgcattcctgcacggtgtgacgcggctcttcgaagtacggatcggagaaggtcaggctcatggtctgagcgaagttctcgatcggagagatctcgttgaagacctcatcgaggccggaggtgtgggccacggtgttagtgccgttcttttcatcctcctcgacgcgcgccttccagcgttcgttgccgatcagccaatcgaagctgtcggtctgcacgcccagcaggtagggcacatcgatgggttccttgatggaaccgaagttcacgcgatccgacgccttgtgcaggtcaatatcatgctggtcggcgcgtgcgatgatggtggtggtgttcgtcgtagactcagtagccaatggacgttccttatcgctcgctaatatgtggtaattcccctgggagcgccggcatggccaccatatgcctatgcggacgcttcattgtcgacggcatgcccgcaatatgacacacctcatgtaaattcaaaagaatactgatatgcgaggacatctttagctcccgctgacgaggaagctgtcgagcggagcgagactgagggagagacccagcgtccaaacaccaaccgcagatcctaccccaccgtaaacgtcaccggatcgctcttcaccttcggatgatccttcaaactcagctgcgccacgtacgttcccgcattgaccttggcccaatccgactcatccgtgcattcggtgagcgtggcgttcgcattggtattccacgtgaccttctgaacgtccttatcacccttggccatcagcagcagacgtgaatccgccgggcacacatcggacttgtaaatcgtttcctgaccggaagtaatggtgagcacacggccggaatcggacccgtccaccaaacagttgcctgacccctcgtgcacgatggtcgcggtgaaatcaagcgatcctcctaccggcacggattgggaggccgcggaaagctgcaatgtcacatcactggccgagcaatccttgacgttgctgactttcttcggcgccggcgtggcgtcgcgggaaatcgcatacacctcgtcatggtgaatcatcgtgttcacggcaccgataccccggccgaggctgtacacgcagaatacgatcagcgcgattatcagcagcaacaccgtaccggccacgatacgccggcgacgatagatggcctgctgctttttgctgatcctgcgcttgcgtggcttgccggaacggttgttctgggagggcctgccggatggcccattggccccggtgccggctccgcgtgccgttctcgcgcctgatgtgttcctctgcactgccataactcttccagtctacggtcaccacacccatacacgcttggggagcccaccattttttcacaatgtcagctgggtagtcgcaggccgccgtccagaatctcgatcaggccgtcatcgtcaaggctggcgatgcaggcggcaagctgaatctggtccttccaaagctcgtcggcatcttccctaggcaacgtggctccagcgggaagctcgcgcagcgcggcgaggaccagaccgcgcacctgtcgatccgtgccttggaatcgttggcgcgggcgggtgcggcgctcccccagtccggggcggccggccttgagaaatgcacagtcgtccgcaatcgggcaggtgtcgcacagcggcgacttggccgtgcagaccaccgcgcccagttccattaccgactggttccacgtgaccgatgggcgttcgccacgatgcagtcgggagcgtttgtcgccccggatagtgctgttcgcggcatgttcggcgctaccggcattatcggcgacgtcagcatcgcatccgaaaatctcgtctttgggcagcatgcggttcgccagcgcacgttcggccggactggccgctcccccgcgcgattcgatgccaaggaacacacggctcagcacgcggcggatgttggtatcgatcacggcaattcgttcgccgaacgcaaagctcatcaccgcggaggcggtgtaatcgccgatgccgggcaacgcagtgagttcgtcatacgtgcgcggcagtttgtcggcgtactgctcggccaccacgcgggcacattcctgcaagcgcaatgcacggcgtgggtatccaagccgaccccatgcggtaatcacctcggccttgggggcctccgcgagcgcgcgggcgtcgggccagcgttccatccagtcggtccagtacggcactacacggctcatctgcgtctgctggctcatgacttcggataccagcacgccccacggcgtggcccggccgaagcgccatggcaaatcgcgcgcattggcctcccaccatgcgcccaatcgcaaagccgcgttcccctgacgattatcgtgcatgccgagactgctgccgttaccgctggaaacgccgtctgaacacgccatggccgtatcggcgcagtctaccgccggggcatagtgagccatatcaacgccatgcatcatccgcgtcctttccaccggtttgaccatcccgcaattccagttgcttccctgagcaaacccattcgaatccatcgagcttatcaagttcacgcatattcccctatccttcgtacactgacatctagagagacgacattgacggaaaggacaatatggacgacgatgacgcgctgcccccccctgagtaattacccagcgttatctgtggtagtgccctgctacaacgaggaatcctgtctgccgctgtttttgccggagctcgcgcgggccgccaagcgcatcacctgcgaacatcccggcgcaaccatcgaactggtactggtggacgacggttcaagcgatcgcacggtgcaattatgccgtcaggcagccgctcatgcacaacggtcatcttcgggcgccgccgatgcgattgacccggctgccacagatgattctgctgccatgacagatgcgaatcccacacattccacggagcccatgccacaatggcccttcagtgtgcaatggatgtcattctcgcgaaacttcggcaaggaaggcgcactgctcgccggtctcgatgtggcgaccggcgaattcgtggcggtaatggacgccgatttgcaagaccctccgtcattgctgccccgcatgttcgacatgctgaccaacgacccggacatcgactgcattgccactcgccgaaccacacgtgccggcgaaccacccatccgttccgctttctcacgcctgttctaccatgtcatgaacatgctgtcgccggtcgaggtgcccgatggcgcacgcgacttccgcatgatgcgccggcccatggtggatgcgattacctcactgcccgagcacaatcgcttttccaaaggactgtacgcctgggtggggttccgcaccacatggattgcatacccgaacgtgccacgtgcagccggcaaaaccacatggaacttcttcaagcttgcccgttatgccgttgaaggtctggtctcctgttccaccgccccattgatcttcgcctcatacgtaggcatcgtgttgtgcgtcgttgcattcttcgccgcatgtttcatcgcggtacgtgcggcactattcggtgatccggtcaccggctggccatcactcgcctgcatcatcaccttcatcggcggattgcaactcatgcgcctgggcgtaatcggccaatatctggcgaaaacctatctcgagaccaaacgtcgcccggactacatcattcgcacaggcaacatcgctcgatatccgcatcagcatcatcgccaataccgctatcgcgaccaacgggccaactgatcagcgattcatccgcaacgtcacgtaacgattcactcgaaacaggacaaccgcatgcatcatctttccaccatcgccgttcgggtccgtcaatcacgctggtcgttctccatactgaccggcgtatgcgcacttgccgcaatcatcatcagctttctgatgggtcgaaaccagtctctgtggtttgacgaacaatactcactgctaatctgcagcaaaccggtccggcaaatgctggcattgactgcggtagacgcacatcctccgctgtactatctgctgctaaaaacatggatgacactggtcggcggcaatgtagccatgctgcgcctgctgaactgcatcttcctcggagccaccgtaggcatcatggcattgttggtgagaagcctgtatggtcggcgcgtagcagtggcctgtctgccattactgctttgcggcggattcatattgcgctatggctacgaattgcgcatgtattccttggctatgttgctcgtcgtcttcggcacatatgccttgctgcgagccaccggctccatacctgcgcatacgcaatcttcaacggcctccgatacgacggaatccttgagtcaccatcacattcacggatggcatgcggtctatgcactaaccgttgcactcggcatgtatacgctgtacctgaccgcgctggtgtggataacccacgtactgtggctgttcatatgctcgtggaaagacagccacgaatccacggtggtgtcgcgccttcgcaagctctccgcattccggtggataccgatttatttcgtctctattatcctgtatctgccgtggatcccgtcactgttcgggcagatggggcatcccgtactaccgccggtcagacgttcgatgaatatgactgggctggcaaatgcctttgacgccatactgctgggacgaaccgaatcgagcatgccatcaatggcctccttgctggcgctgtcaattggtatcgccgtaatcgttcgtctcagtattgccaaaccgcatgatcgcgcattcctattaatcgcgacgctgttcgtggtaccgctgctgatgatgaccatctggtcggcggttcgagaattggtgagcaatggctatggattcttctcggtgagatatctgagcttcaccgcaccgtttttgtacattgcattggcgctgctctgcttgcattcgccggcgatacggttgcgtacttcccggttgttgtacgcagtcgtattgctcacgctattcgccggcacaatggtgttcgcgacgcaaggcaattacaatttcgatcgggctgatacccccggcacggcacgcttggcacaacaggtcaggtgctccaaagcgcatccggtggtggcgcaagacgagtacacctatatcgacgcctactggtatttccgcgactgccccgcctactatttccttgatgacaaagatgttcccacgcgtggcggctacgcgccattgcatgattccgcggcgcagttacataacatcaataatctgaaaacagataatttcacgctgctgagctggtcgaaactgcatgacacaaaatatgatgcattgctcaagtcaaaaatctggaagcgtggtacggttacccgagtcaatggcaatgcgagcgtcctgtaccgaagtaagttgatagattgaccgtgccggagtgcgtgccggcgatagccgagcgacaatcggcgacgatagcccggccgtgaatttgcatccagcagcggcctcgccgcaaaatcgccgaaaatgccggacagcacgcggtgtcgttcatcgttcttattcttagcagctatgacgaacgaggcaaaacacaacccccagagcacaccgaatccagccaatcccgaaaccaaagtcgagaaaatgttcgaatacggctatcgcaagtcgaattacgggccggacgagctggtgaccgacgcacacggcaaccccatctccgtggtggacgcgatgctttccgccgagaaggccgccgccaccgaaaccgtgacgccgcacctgtgctattactcgccgcgtattcccggcaacaccggttcggccatccgcctgtgcgcagtgaccggcacgatcctgcatttggtggagccgttgggcttcaacctgcgcgacaccaagctgcgccgagcaggcctcgactaccatgacatggcccacgtggtgttgcacccgaacttcgacaacctggtggagtccatgcccaattcgcgcatcatcgcgttcaccgcgcacgccaccaagctctacaccgaagtggaatacaagccgaccgacatcctgctgttcggccccgagcccggcgacatccccgacccgatggacatcatggagggccctcatgtggccgaacaagtgcggctgcccatgcgcccgtccctgcgttccctgaacctcaccaactgcgcatccatcgccatctacgaagcctggcgccagctcaattttgcgggcggagcgtgaggagaaggcccggtgggccttcgagtagcgacgacgaacgaacaccgacaggcgtgagagcggaaacactgagcttcgcgcagtgatgaacgctgaatataaggctacctgcgtttcgaggggcggatttggcatccgccggaggtctactgccgcttcaaggggctgtcaaaggacgagaccccgagtatggccgttgaaatatcaatgcttgtactcggggtcttcatatataccagcccctcgaaacggaagtagacctccagaaaggtcggaatcagcccctcgaaacgggaatagacctccagaaaggtaattcgagctggtatctgccttcaaagaggtacattcgagcgtttgcagaatgctatctgccttcaaagaggtaccgcaatcgagaaaccccgggtatgagtgttgatattccaacgctcatacccggggtttccgcatataggtacctctttgaaagcagatagctctccgcgaggggccaaatgcacctctctgaaagcagataccctaccgaatcaattcttgaagctgtgaatcggcgcagggattcggccgccacgggtcacaaaggcctcgcagctggtctggttgaccggcatgatgggcgcgtagcccatcaggccgccgaagttcgccatctcgcccacgcccttgccggcaaccgggatcacgcgcacggcggtagtcttctggttgaccatgccgatggcggcctcgtcggcgatcaggccggagatggtggaagcagaggtatcgcccggaatggcgatcatgtcgaggcccaccgagcacacgcaggtcatggcttcgagcttctcgatggtcaggcaatcggaagaagccgcgtcgatcatgttcttgtcttcggagaccgggatgaacgcgccggacaggccgcccacgtaggaggacgccatgatgccgcccttcttgacctggtcgttgagcatggcgagcgccgccgtggtgccgggagcgccgacctgttcgaggccgatcttctccagcacttcgcccacggagtcgcccacagccggggtcggggcgagcgacaggtcgatgatgccgaacggaatgccgaggcggcgggatgcttcctgggccacaagctggccgacgcgcgtgatcttgaacgcggtgcgcttgatggtctcgcacaggaactcgaagtccttgcccttggccgcatcgagtgcgcgggagaccacgccggggccggagacaccgacgttgatgaccgcgtcgccctcggtgacgccgtggaagcctccggccataaacgggttgtcgtcaggcacgttgcagaaggccacgaacttgacgcagccgtaggagtcgttgtcggcggtacgctcggcaacgtccttgatgatatggccgagcagttcgaccgcgttcatgtcgatgccggtcttggtggagccgacgttcacggacgagcagacgatgtcggtctcggagagagcctgcggcagggagcggatgagcagctcctcggccggggtcatggacttggagacgagtgcggagtagccgccgatcaggtcgacgccgacctccttggccgccttgtcaagcgcgtgggcgatcttgacgaagtcctcgctcgtcttgcaggagctggcaccgaccagcgagatcggggtgacggtgatgcgcttgttgacgatcgggatgccgtagtcgcgttcgatggccttgccggtggaaacgaggtccttggcataggtagtgatcttgcggtagatgttgtcgcaggtcttgtcgacatcgtccgaggcgcagtcgagcaacgagatgcccatggtgatggtgcggacgtcgagcttctcctgctcgatcatctgattggtctcgtggacctccatgatgttcagcatggtttgttccttacaggatatttgaagactagtttggcggtcaccctcatcagagggataaggatggctccgtcagcggaaagcccaccgggctttccacctcctcgcgtgaggcggcctgctgagccggtcgcctcaaatacggtgcatcttggtgaagatttcctcacgctggcagcggatgcgcacaccgatgtcgtcgccgaggtcctcaaggttgccgaccatcgcgccgaagtccttgtccgcgttggcgtagtcgacaatcatcatcatgttgaagtaaccgtcgatgatggtctgggaaatgtcgagcacgttgacgttgtgctgggacaggtaggtgcagactcgcgcgatgatgccgacggtgtcctgaccgacgacggtgatgattgccttgttcatggctctccctggtcgtatacaaaaagcgggtgactacccaagtatagggaagacacccgccattatgttcattaccgattcatgtatcgtttgccgcccttgaacatgaaggagaacaccagcacaacgcccgagttgacgccgatggtaaagaacagtgcgccgccgatcgcggtcatcaccacgccaatggccagtatgcagccgacgaccatccactgggcggtaccggaggatacggagaactcgtccatcaaatcgggcagggcgatgttcatggatgtctcggacagcatgccgaggaatgcgccgatgtacaggccgagcatcaccttatgcggatggtcgaaatgcctggtttcaggagcgttatgggggttatgggaataagtggtgccggattcgccggcgggcatggtggtggtgcgggataaaacgaagctccctcgtcagagggagcttgcaatggctcaggcctcgcgcaaagcgctcggcgctgcgcacgcggtcctgcaattacggacgacctacggccgacccagcattacctcggcctcgcctattggctcgacctcgaccgcatccgccggacaacccaccgggttgtcctaggcctcgcgcgaagcgctcggcgctgcgcacgcggccagggcgcgaggagcgtggaagccttgcttttcgaattcgtcggcgatcttctgagcgacttcctgagaacgacccttgtccaccaacgcgatgatggagccgccgaagccgccgccggtcatacgcgcaccgtaggcgccgttcttgcgggccacgtccacggcgatgtccagctcggggacggtgacctcgtagtcggcggccagcgaatcgtgggaagcgttgaacagacggcccgcagccttgatgtcgccctgagcgaaggcacgcacgaaggaacgcacgcgctcgatttcggtgacgacgtggcgcacgcgcttcttcatggtctcgtcaggcagggcgtcaagcgtttccttgagggcctggaactggtcatcggccttggagatgccgtcggcggtaacgcgcaggttggccacaccgagaatcttggcggcttcctcgcaggtggcgcgacgctgagcgtactggccatcgttgagctggtgcggagcctgggtatcgaccacaagcagctcgaggttgtacttgtcgaggtcgaactcctgctgggagacgttctccagcggggtgagctccgggcggcagtcgagcagcagcgcatggccggcggtgcaacgcatggaagcgttctggtcaagaccgccggtggaggcgccggccatctcgttctcggacttgatggcggcgttgatgagggtcacacggccggcgtcggaatcgccgtagccaaggccgtacacgtcgtccagagccagagcggtggagcaggtcatggcggcggaggagctcaggccggagcccagcggcacgcaggagacgaaggcggcatcaaagcccttgaccttgtcgaaaccagcctgacgcagcgcccaggccacaccggtcgggtaggcggaccagccgtccacgccacgggccttgaggccatcgagatcagcttcggcgaccttgtcgggagccacgccggagacgacgcgaaccttggtgtcttcgcgcggcttcagggcgatgaaggtgcggtgcggcagagcgatcggcaggcacaggccggcgttgtaatcggtgtgctcaccgatcaggttcacacggcccggagcagcccacacgccctcgggcgcagcgccgtaggtgtcgacgaacagcttggtagcttgcgagacgccttcctcatgggtcagcggctcaatgaattcaacagcagtcattgatgttttctttctatcagtcggcgatgtcgatggagccgagctcgtggaagcgcttggcgatgagttccggcgtggtgtcggagatccaggcggccatgccggattcggagccggcgaggtacttgatcttgttggcggcgcgacggaaggagaagaactgcaggttcaggcggtagttctcgcggcgggcgtcgtggatcggggcctggtgccaggcggcgatgtatggcaggtccatgcctttgccgtcgcccttgtcgaagaaggcgttgccgcgcttcaggaggtgcgagtacatggaggcgaggtcccagcgttcttcgtcgttgagctggtcgagggtgagcacgtcgcgcaccggagccacgtggacctcgaggggccaacgggcggcggccggcacgtaggcgacccagctgtggttgcgcatcacgatgcgttcgccggcttcgagctcggcgttcatgatgtccttaagcaggttgccgccggtcttctcgtggtaggcctcggtgtgctggagttccttctccatcttcggggcgatgaacgggtagcagtagacctggccgtgcgggtgggcgagggagacgccgatttcctggccgtggttctcgaacgggaagatctgctcgatgccttccatcttggagatttcggcggtacggaaggcccaagcctcaaccacggtgcgcaggcgggagaccggcagatcggccggcaggccgtcctcgttcgggtcgaagcagatgacctcgcagcggccggcggcgagcttcttctcccacagcgggttgccgtcaacgtaggtcacgtcctcggagacgccgggcacgcgcaccatggaggggaagcggttctcgaacacgacgacgttgtagtcggtgtccggcacttcgccgtcctggtacgggtcaccgggcttgcgggcggccagcgggttgcccttggcggtagcgccggggccggcggtgatcgggcggttcatacgggcggtggccatcgggatccagtcgccggtcagcgggtcgcggcgcatctgcggggcggcgtacggcacttcgttgccgtcggcgtccaggtgcggggcgaaacggtagtccagcgggcgcgggtccttgagctcgcgggtcttggcaccggagacgaactcggggtcgtcgtccaggtagaagaagtcacggccgtcggcaagcgtcgtcggcgtgatgcggatgtgctccttcgcatactccccgggggtgtagttggcgaaatcagccatgggtttactcactttcctcaatgatctcgctctggtgggccagcacgagttcctttaccaaatccttggttttggcggcggagtcgggatcgagcccgtcgtcagtaatgaccgtgtccacctggtcgaagcgcgcaaacagcgacagcgatgtgcagctccacttggtgtgatcggtcaaaactatggtgcgatcggcgatgtccatcatcgccatatcggttgcggcttccagcgaattcggcatcaggaagccacggggaatcgacaccgagtgggtgccgaggaatacggtgttgacacgcagcgaagcgacgaccttgtccgcgatcgggccgacaagcgagttcgatcgggtgatcacgccgccggtgacgatcacctccacatccttggattcgagggcctggaccagctcggccacgggaatcgaattggtgaggatggtgatgccgctggactgctgcgattcgagcagatgctgggcgaagacataggccgtggtgccgccgccgatggcgattacatcgccgggagccacatatttgatggcttcctgggcgatggcgtccttcaggccgatatccatctgagacttgacagagaacaggggttcgctgagcaaggtactggtagtcaccgcgccgccatggacgcgcttcaacagtcccttgtcggcaagttcggcgatatcgcggcggatggtcatcgccgacacacccagttccttcgatagcgccgtaatgcgcactgccccgcgtgtgcgcaacctgctcaagatgaggtgctgacgttgtgacgaaatcatgcgaacattatcgcacacaaaagctcacaaaccaaaccggcttgagcgttttggggacaatctctcgaaaatcccgggcaattcaggtgttcatttccacaaaaccgcgcaaaatcgcacattgtgcgaaccgatattctcgcagcgaccactagcgcgatgactcacgaccgacgactctcccgagcgcgttgctcagcggcgagtcacgcctgatacctggtgcatcccgattcatgtatcttctgccgagccgacgcctgcgtgcgcctcgacacgcggtagccccttccccaattcgcctaggcaggaatcgcctagccgcaccagcccaagcgtgagacaataggcggtatgacttacgtttctgaaagcttctggcacgacgccgtcaacaaagccaccaccgatctgttcaccttcggctacaagcacatcatcaaaccgaacttcgtgttcaaccaccgccccgatgaggcacacgatcagatgatcgagttctgccacgtcgtcaagaacgtcccgccgctgctgctcgccgagcagctgatgctcgactacaccgaccccattctggaaacgaatgtgatgggcgtcgatttcaccaacccgttcggcctgtccgccggcctcgacaagaactgcgacatgcccgtggtgctggaccatgccggcttcggttttgaaaccgtaggctccaccacctcgcgtccctgcccgggcaacgccaagccgtggttccaccgtctgcctgaatacgattcgatgatggtgcacgtcggcctcgccaacatcggttcggacaaggtcatcgagcgcgccgagaaggcttggactcaggcccgccagatgcagctgtctgtgtcgatcgcccgcaccaacgacgaccagtgcggcgatttggacgaaggcattgaggattactgcatttcgatgcgccgcgccgccggccgcaccgcgatggtggaggtcaacgtctcctgcccgaacacgcacgtcggcgaaccgttcaccgcgactccggaagcgctcgaccgtctgtttacggcgctcgacaagatcgaccgcccgcagcccacgctggtcaagatgccgttgaacaagccgtggggcgagtacaaggagctgctcgatgtgctggccgagcacaatgtgcaggggctgtccatcgccaatctgcagaaggaccgcaccggcctcgagattccgcgcgattgggagggcggcctgtccggcggcccgtgcaccaacgccagcaccgagctgattcgcaaggtgtataaggagtatggcgaccggttcgccatcgccggcatcggtggcgtctttacccccgagcaagcctatgcgaagattcgttccggctccagcctggtcatgttcatcagctcgctgatgtaccgaggcccgcagcagatcaccgtgttgaagcgcggtctggcccagctgctgcgccgcgacggattcgagcacgtctccgacgccgtcggcgtggacgtggagtgaactcacatattgccctattacccatggggcggtaaaaccctcatggggcggtgattgtcccatggggcggttagccaaatttcacattccgcagaataccgccgttttgggttaccgccccatgagggttttaccgccccatgggaaagtcaccgccccatgaggattcagtacgcaccggccacgtattgcggggcgtaggggacctctgtggacggtatgcccagcttgttggccgcacgcaacggccagtacggatcgcgcaatgcggcgcggccaatttccacggcatcggcttcgccacgggccaaaatcttggccgcctgcttcggcttggtgataagacccaccgcggtcaccggaatatcggccttggacttgacctgctcggcgaacggcacctgatagttcggcttgaccggaatcgacactcccgacatgatgccgccagtggacacgtccatcacatcgacgccatgctccttcagcaccttggatagtgcaatggtctgatccaaatcccaaccgccagcggcccaatccgtggccgaaatgcgcaccagaaccggcacgccctcagggacggccccacgcacggcatccacaacctcgaccaggaaccgagagcgaccggtcaaatcgccaccatattcgtcatcacgctcattgctcagcgggtcaaggaactgagaaatcagatagccatgcgcggcatgaatctgaatcgcttggaagccggcggccaccgcacggcccgccgccacggcgaacgcgccgaccagaccatgaatctcatccacggacagcgcgcgcggcgtacgcaacccaccgaacgcgatttcagacggtgccatggtaggccagccgcccgcctcctccggcacgttctgaccgtcgtaaccaacggcaaagcaaccagtcgaagccttacgccccgcatggttgagctggatggcaggcaccgcacccgcctcgcgaataccgtccacgatccagcgccaagcatcaatctgcccgtcttcccacaggcccagatcgcacggcgtgatacgcccctcaggagccacggcggtggattcgacaatcaccatgccgaatccgccgaacgcgcgagacacgtaatgctggtagtggaacggcgtgggcctaccatcgcgggcgaacgacgaatacgtgcacatcggcggcaaccaaatacgattacgcacggtcacctcgcgcagcgtcattggcgcaaacagccccggacggtccttgctgactttcttatctgccttgctcacagcttccctttcctcataatcatcgaacgattcgctcgtcttgcccgcgccggcccgcttcttggaccgtgcatcggattttgacttcttcttaccgtgcttacggttcttcgatgcatcctcgtgcttggtcttcggctgcttggactgatcgccgtccgaagacgaagccagcgtcaccgctttgagatccggcacgtcgaatccacgaaaatcaaaattctcatgcgtcagatcgtcgttgctcatcgttcccctttccgatgcacgttcatggcaaatattcgatgaacgcgatggcgttgtcattaagtattgtaaaacgggcgtcacctgaaacaggtaacgcccgcaaactacgtaatttgggtatcgcagtcggccatgttacgcagactcagccggcctgcaatcaccaaatgtcaaacgccaatcaccaatcactggccatcattcgactgctctgaattggtgccctgggtttgggtgttgttttgcccagtgttctgcgactgagactgattgttgctgctctgcgattggctgttgccattcgtagtggtctgcggcacgctgaacgttcgtccgccaatgcccagatacttgccagtcgtggtgtacttcgagacgggctggccgtaatcgttgtcaatcggtattttcttcttggaaatgtagctattgaagaagttggtaacggccggagccgcgattgtcgaaccatcccaatagctgttgtaccggccgttgatggcaatgttggaaatacggttggtgtacgggttctgtgcatcgccgaccacagcgaacgccgcaatctgattaggaatgaacgatccaccggacaccgcaagatcctcactggtaccggtcttaccaaacgacttacgcccgtcagccaatctgaatgaccaaccggcaccatccggccgcaccgtaccttggttcagggtataagcgagtgtttggatgatgtccttatccaccgcctgatggcagttcgcggatggaaccttgagatcgttgccgtccttatcggtcaccttgctgatggcaatcgggttgcattgcacaccattcgaggcgtatacggcgaagatgctcgccatggtcagcggggacacattcaccgagccgatcatcatggatggtgtatacacctgggttttgtcgatggtctcacccgtggcggcgtcatggtatcccagttcagtcgcggtgtccgccaccttgcacagtttgaggatggcacccatggaagcctgagtagtgttatgcgaacggaccagaccgaggaatgggctttctgggttcactgtacctgcgcccatggcgttcgacacgttccacgaatcggcaccgcccgaatagttactgcaggcgaagtccgtagtggggtatgacgtcgaggtctggaggttgtcgttgatggaatggcccgcttccatccacgcaatcaggttgatcggcttccaggacgaaccgatggtccaaccagaaccaccgccatccgccaaatcgacggcatagttctggctcgtcttggtgggatcgttcgcggctgccggagtggcgtcatagtaacgattcaggccaaagctcagcacttcgccggttcccggtttgactgcggccatggctatctccatgccgctgggatcgtccggtggaatggtattacgcgcggtctccatcatcgtggaattcgcttccacatccagcgtggtgacgattttcaggccaccctcctgcagcagcttgttacgctcggcacgagtcttgccgaattcttcggagttctggatgcgatgcaccacaaaatcgcagaagtacgcgtaatcgccggtgtcctgacagccgacattcacgtcctgtgctttcagcgtgtccttcaacggcgtgttcacagcttcggtgtactgcttctgggtgatgtatccttcctgcagcatcagcttgagcacgatattgcgttggttttcgctttccttctggttctcttcgaccagcggatcatacaggcttgggttcttggtgatagccgcgatggtggcggactgcaccacgttcaaatcggcggcggacacgctgaagtagcgctgggccgcggtttccacgccatacaggttgttgccgaactgggcgatgttcaaatagccctgcagaatctcggccttggaatacttcttttccatctgcacggaaatcagcatctcgcgaatcttacgggcgatggtgtcttcagtggcatggtactgggcgatcgaatcgtcatcctcgatcgcctgcatcagcagcacgttcttgacgtactgctgggtcagcgacgaaccaccctgctgggagcctttgacgaggtaggtctgcacgaacgcacgcatcacgccttgcacgtcgacgccggcgtgagtccagaatcgacggtcttcgcgcgccaccactgcctgctgcatggttttggaaatcttcttcagcggcacgacgatacggttttggttgtagaacgtcgcgataacggtggaaccgtctcgcgcgtacatcgtcgacttctggggcagactagtcacgtcgaagtccacgttttctaccttgagcgacggaatcaccgctttggcggctttattggcaccgatcacacccggtacaaacaacacgctggccgccacgccgccgcagacggcaagcatgatataggccaagaggagaacaagcacacgttggagagtgagggacttctttttgggcatgggccccattctaaatggggtgccctaccaaccgggcttacggtcagctcccgtgaacatatcatcacaagaatcgcactagcgtaacattggctggaagtcagccgaacggtcagcgccgcgagcgtcgaatcagcataccaggctggaagatgatgatcgatcggccgtcacgtgcgatccatccgcggttggaaaagtccatcaacgccttgttcacggtctcacgactggagcccaccagttgggccagctcttcctgagtcaggtcatgcggcactttgaggccctgttccaccggctcgccgaaacgtgagcccaagttgagcaatgtcttggccagacgcgccggcacatccatgaataccaagtcggagatgcgttcgttgttgccgcgctggcggctggccatgacctgcaacatgtcgatggccacacgcggatgctcatcaagccatgcgaacagggcatcatgctccagccagaccacgcgcgtgccatggctcatggacaccgcggacgcggtgcgcgggccaccatgagggtcgaataccggaatctcgccaagcacttcgcccggcgcgtggatggacagcagctgcacgcggtcatcggaagaagtgcgaatcagcttgacgcgcccctgctccagtaaatacatgcgctgatcggtatcgccttcggagaagatatagtcgcctttatcgaacgtcgcatgcttcaaatgcggcaacagctcctcggcttcggctggcgatacctgcttgaacaatgccgtatgcaacaggatgttttcctcgtcagcaaaagcgtttggcgtttccaagctcatcgcaccatccttattgtcctatgaccgtcgtcgcccatccgtcatattgtaacgcgccccacaggtttcgtcaggagcatgccctcattcgtcacttcatgtgtggcacgatccgatagccgtacgacatgctgacgaatgcgttaccgcgaaaaacggcactgtcgcggctaccgcgctcgcccatgacaaaaccgcgcacggccagcggcaaaatcgtatacggccatcggtgaaatcacgccgcaaaccagtcaataaggtgctcgacgatgtgttcgcggctgagacccgtctggcttttcatcgggtccacgcgtttgaccgctgatttcaccgctttgtctgacatcttctcgcgactggtgttgagcacacggctcatcttggccgcatcgatgtcatatgccatggtcacatggtgcagcaccgcgccgcctgagcctacggggaagcgccgctgcgccgctcccccgatcttgccgtactgcgaggcgatatcattgaggcccgcgaaccgcacatctaaaccaagttcgcgcagcgcttcgaccagccaccagtcacagagccggtaggattcttcgatgcttacgccctgaacgaaatcgagcggcgcatacagagaataggtaatggtgttgcccggttcgataaacatcgctccgccgcccgtgcaacggcgtaccacgtcgaagccgagctgcttggcaatgtccagattcacctcgtcctgggccgattggaaacggccgatgaccacagccgggcccgcccactcccataatcggatggtcggctgtcgtgttcctgctgcgacttcacgcgcccaggtctcgtcaatggccatttgctcgtccggagtacgcggatggccgtggatcacggtgagttgaggcttgagggcgttccagcgctcccggtattcagagcttttgtcgggctgcttggtttgtgtattgatggatgctgggatgttcggcgcatcggggctgcccacccccacccgctgcgctggagcccccgccagcgggggtaagttgctgcttacggctcggctgtatgcggttttgatggcaatttcatctgtgccgataatttggcaactaggatgggcgtccaatacggaccgcaatgaatcatcgctaattagagctcgttccaggtcatgcaacaaagcatgagattcggcatccgaaactgattcaataaagaaatcaccgctgatatggcatgactgtgcggtgccgtcatcatcgacggatacggtcacggcgactagtttgctgccaacggttttgcattccccatgtcgcatttgcatgcaactcagtatagagagttttctggctcccctcagcgaggggagccaagtttgaggtcacatgcgggccagaatgtccttgccgacctggtcggtggagcgcacggtggagccgagctcctcgatgtccgcttcgacggcggtatggatcttcttggccgcatcatcaaagccgagatgctcgagcagcatggcggcggagaggatggcggcggtcgggttggccttgttctgaccggcgatgtccggagcggaaccgtgaatcggctcgaacatggacgggaactcgtcggaggcgttgatgcagccggaggcggagtagcccacgccgcccaccacggagccggcctcatcggtcagaatgtcgccaaagaggttgtcggtgagaatcacatcgaaacggctcgggtcggagaccaggaagatggtggccgcatcaatgtgctggtagtcgtgggtgacctcagggtattcctcgccgaccttgtcgacgatgcgctgccacatatcaccggcgttgacgagcacgttcttcttgtgcaccagggtgacgtgcttcttgcgcttcatagcgagcttgaaggcgtaacgcaccacacgctccacaccgtatgcggtgttgatggacacctcggtggccacctcctgcggggtgttgcggcgcaccgcgccgccggcaccgcagtacagaccttcggtgccttcacgtaccaccacgaagtcgatgtcgccggggttggcgagcggcgaggtgacgcccttgtacagcttggaggggcgcaggttcacgtactggtcgaggtcgaagcggagcttgagcagcaggccgcgttccagaatgccggccttgatgcgcggatcgcccacggcaccgagcagaatcgcgtcgttggccttgatgcgctcctcttcgtcctcgggcaggatcgcaccatcgcgcagatagcgctcggcacccaagtcgaagttctcgtactcgaagtcagctacgccttcagcggccttttccaaagccttctgagcccacggagtgacttccttgccaataccgtcgccgggaataacggcgattttatatgtctttgccatagttcaaggagcctactcgcgctatcacctgccggcccgaacccgctcagctagtggacatggcctaatgagcgagccccatcacatccatgcaccaagcgttctcataggaaacctcttcccattgctcgtaacgcccggatagaccgccgtgaccggcctcgacctcaatcttggccaccgcgtccacgccggcggactgcaaacgggccagccatttgagcggctcgacgtacagcacgcgggtgtcgttcatcgaggtggtaatgaagattctcgggaattgcgcggcggcgaccgcgccggtggcagccccatcagcactgccgtcaccggcagcctcgtcgttgccgccctcgagcacggcgaccggcacattctcgtatggcgtgtacgacttcatatactgatacacctcagggtcatgcaacgggtctccccattcgtcccattcggtgacggtcaacggcaagtccgggtcaagaatggaggtcaacgcgtccacgaacggcacatccgcctcaacaccggcgtagcattcgggcgccatattggcaatcgcgcccatcagcagaccgccagcggatccgccgttggccacggtgcgccaagcatcagccaaatgcgccttctgcagcgcgcgtgtggcgtccacgaagtcctcaaaggaatgcttcttgttcagtctgcgcccctgctcataccaggcgcgtcccatttcgccgccgccacgaatatgcggcacggcgtacagcacaccgcgatccaacatgctcagacgagagaccgagaaccccggatcggaggaaatctcgtatgcaccatatccggtaatgaacatcggcgaatcctgcgccgggcaatcgcggtgccagacgagggaaacaggaatgcgttcgccgtcgcgcgcggtaatccacacacggcgttccatgtaatcgcgtggattgaagttgcccaacacggtggctcgcttcagcagcgcatcttcaccggtggcgggatcgatttcgtgcaactcgcccgggcgggtgtagctggcgaacgagtagcgcatgcgcggcgcctcatacgaggggttgccgccgacgccgatggtgtacaagcgccgggtctcaccgggcaggtggtcgtcgctagcaccatcggaagatgacgtgtgatccgtgggggcctcatcttcggtccacaagatttcgccatgatcgccggtgaagttttcgcgatcgtcggcaaccatgtcccagtcgtcctccagggcaggcggcagcaattccgtaaaccgccacggccgtccggccaggaagtcggcggcagccgcgctcttggtcatgtatgccacgtgcggctggccgtcggcacggtagctcagggacacaaagttgcgatgcaacgcaatgccttcgatgcccagaccgtgggcaccctgcaatatcgccggattgacggcgttgaagtatgcctcggtaatcggcttatccggctcaccatgttcacagccgtacggcgacccggcggcaatgcacacgccttcgccgagtcggtacggcggctcatggccacgcatgtcaatgacgtcgatttcgaaattcggattggcggcgttgtgatagaccacggcgagtggcacatccgcaccgttctcccccgcgccttcaaaacaggcaaagctcacatcatattcaatatcgttctgacgcggaatgaaagcttggaattcgccttcaggcgtggccaccggcagcatcagcacttcggtggtggttttggaaccggtgccgatcacgatattgcgctcatcaaaactgatgccaacgcccacccagaaccgttcatcggtttctcggtacacgcacacatccgattcgaccgccgtgccaacacgatgccgccacacagcgagcggccgccaggaatcgtccaattccacccagaacacccattggccgtccggcgtgaagcatgcgctgccaatgccggtgaactgttcgggcagttcgctgaccggctccccggtctccagcccggcaaggtcgcgaatgcggaaatcatatcgttcgtctcccgcaacatccacgccgtacagcatccaacggccgtccttgctcagatccaagccgccgagccggaagaagtcatgtccctcggattccttgttcgcatcaaaaacgacctgttcaccgggcatggagccgggcgcgccttgcggatccacgaccggcgggtcccagtcatcggcatcgcgcacggggatgcggcattgcacgccatactgtttgccctgctgcgtgcgggtgaagtaccagtaatcattgacgcgcgtgggaaccgacatatcagtctcttccacatgcgatttcagctcttcaaacaacgtatgccggaaatccgccagatgcgccatgcgacgctcgcagtactggttttcggcagctacgtagctgcgcacatcatcggagtctttgtctcgcatccactcgtaatcgtcttcgaaaacgtcaccgtggaattcgcggcgcttcggctcgcgcttggcgtaaggcggcatcgcggccgcggcgtttgtgctctcgtcagtcataccacgcgattataggcgaggcaccgcaccgggacgcattcagtgttcatcacgccgcgcctatcgcaacaccgtcttcagatacggcagcatggtcttcagaatgttcgagccggtggtgccggtgaatactggcacatcggttaccggagtcggctgggtcgaggtgagccccgtcaccgacgccaatccggttgattcgcgcgggctcaactcacgaatgacgatcgccagtacacgtccgggatatctgcgggcgatggtggcgtacgtggtcgggtctttctgcccgtcatcgcccaccagaatgaacttcatgtctgggaagtcggccataagttgttcggcaaactcaagtttgtgctgggggccggtgggtacgaaggtcttgggcctcgggtcgaggtcgcgcagcagcagcgggccttcgggaaaaccatggtcagtgatgaagttgcgaatcgaactctccacattccagggcgatgtcgaaagatagaagaacggtgcgccggggaacaagtcggcgatgcgggtgaacagcacgctcatgcccggcacggaggctttcttcttggggtcgaggaacagcaggttgtacgcggccttccatggcaccggggcctgcgtgatcatgatggtgtcgtccacatcggagatgatgccgactttggcactggcggggatggtgtacaggttggcgctcacgggtttgcggttggccacgctgtaggagacgcgatggatgccgggcaccagacgatgctcggccacgaggtcgagatatccggcggaatcggagatggcgtattcgctgccgagatcgcgcgtgcggtccaccttgtcatagacctcggagacaccgatctgcacggtgttgagcggcatgtcatcaatgctggcctgcacgtgggtgcgcggcgcgggtatggcaagcatgccgcggatgccgcggatcagttcgccggattgcgcgtgcctgggggcgtataccgtgcggcagatcagacgcgagtaatcgccggtaccataacccacatagggttccactcgcggataccagtcccattggcgcaccacctgagtggagatgcgtgaccatacaccgaacacgcgggtgacggcacgacgtatgaatcgggtgatcggcggcttgacttcgatgcgctcacgcttggagggggtgtcgaacgtcgtggcagccttgcgtgcgggaatcggcacggtgggcatgtcatcggaatgctcagcattgctggcattgtcgacgccattggcggatgccttgacgtcagagactggcgcggtggcggacagcgctgcattgcaagcagcagcatcccaaggcagtcgcttgcctgccgcctcaaaatcctcgcgtgggcttctcatagacaccaatataggccatacgcctcatttttcttggctccccctccataagaggcacggtgcatataggtttgatgccacatactggctcccctcagggaggggagccatgggtggaactaccgcacgaccttcgcgtattcgtcggcgctcagcagctccggctcatcgtcgtcaagctcaaccttcagcagccagccttcgccgtacggatcgccgttgaccacggacgggtcgtccgccacgtcacggttcacatacttgaccgtacccaccacggggctgatcagcggctggacggccttggaggattcaagctccacgatctcgtcgccggcctccacacgggcgccaggctcaggcagatccacaaacacaagttcgccaagctggtcggcggcgtattcggtaatgccgatgattgcggggtcgaccgaacggtccacccatgcatgttcctcggagtattcgaggtggtcgggaatgtcgagattcagcggctgttcgttttcgttgtcatcactcatagtcataagcctaacctatcttcgcggtccgtcacagctcgcgaccgagccattcctcaatcatgtagcgggcgatggtggcgcggcccggcgccgccatacggccggcgatgagctcggccgtgtattcgtcgcgtgtgacccatcgcgcggtcatggtctcctcgccgtccacacgcacgtcggtggtgatcgcatgtgccttgaacgccatcatcagcgaagccgggaacggccacggctgcgaacccaggtaccgcacctcgccaagcttgatgccggtctcttccatggcctcgcggcggcaggcgtgttcaaggttctcccccgcctccacaaatccggcggacaccgaatacagcctcgaatccttccatgccgcgttgtgttgcagcagcagacggtcgtgcccgtccacgatggcggtaatgaccgccggctccacgcgtgggaacagcacacggttgccgtccgcctcgttggtgcatcgctgcgcccatccggcgagcgccggccggaccgccgcgccacaggtgggacagaaccgctggcggctgtgccagatgcttaaggtgatggcactggtggcttgcccggcctcgcgcgcgttggcgtgaggggcgaatccgcgcaggtccacccagtcgaaccgggtcacggcctgttgcagcagcgtgggcttcggggccaagggctgtacgggcgcgccgaccgaatcatcgaaggcatcgtccgcaccttgcccggctgaatccggtacaccgagcggcccggcgattttggctgcggctacgccgccattacccttggcgtttcccggctgccgtattccggcggcagcacctccgctgatgccgttcttgcccagcgcgccgtccacagtgccggaatcctgggtgccgagcacgccgccgacggcaccgccaacaccggcaatcccgccaacaccgggaacgccggcttccggcacgcgcgtgatatccacggcgaccacggattcgccgcgcgccccgacataggagccaaggaacatggcgaccgcttcggggtagcgtgccagttcggcggacacataggcgcccggcaacgtggcgagccgcattttcacgttctcatagtccacaagctcgccttggccgcgcggtacggcgacaagtccgccgcgcgtaagcacgactttggtggtcggctcggccagcagctcgtcgatcaggccgggttcgcttcgccggtccacctgatagtcgatgtcgccttgtgcgagcggcaggaacggcagcgcatgggtcagtgccagaggcgagaaatgaatgtcagcggtcatcgaggtctcctatgcgttcttctgcgcgctctgcacgcgcttgacgagcgagagcagtgctcgcgccacggtatccggatgttcgacggcactgaaatggccgcagtccggaatatcgatgaattcagcgccggtgattcgttcggcgagcggccgcatcacactcggattgctggaggggtccagttcgccggataccaccaggctcggtgcgctgatcgtttccggcaccgcccccagttcaggccgtccgtaggtcatgcgctgacgccaggccagaccagccgggttctgttcgttgatccagccggtcatggtcgcgatgaattcaggagtctttttgacggtggaatcgccatcggccggctgcgcgaagtgcatcaccggttcgaccgagttcgtctgttcggcggcgtccgccatcttcagtcggttctctccgcccacgccgtcggacgcggccatcgtgtcacacaaggccagtccggccaccgtttcggggtacaggcgctggatgtccatcgccacgtagccgcccatcgacagcccgacccaaatcgcctgctcatagccggcggccttgatcaggtccacgtaggctccggccaggcgatccaacgcctcgctgtacgcgccgttcgccatgcgggggcccgaatcggcgtcgctcggcaccggggatgcgccggagccggccatgtccggagcccaaatcgggaagtccggcacatcgttcaggtcggcgaaatcggcgagcgccttcgcgcacacgtcccacatgcggtggtccaccgggtaggcgttcatcagcaccaccggcacgccttcgccgtcgcggtagatatgattggccaattcgattgccatgaattactccttcacattcgcgccccactggcggagctgtcggcacagtcggctgggagcggtctcaacgcggaccgccctccgtcgctacgcgccgtcccctccaacggaaggcaaaacaactgtcagattccggcccaggccaacgcctgccgcacgatgcgcccatggccgttgaccatctgcgccacgaacgtgtccattacgtcgctcttgggatccacccattccacatccagcgtctcgtcctgcggcttgcagtcgccggcgataggcaccacgtagcacagtgcgatggcgtgctggcgcggatcgtagtattcgcttagtcccggcgtggggaagaattcggccacggcgaacggctggagcccgatcggcagcagcggcaaggcgatatcgcccaaatccttggccacattgcgggcgatggcctcgcgcaacgtctcgtggtacagcacacggccggtaatcagcgtacgctcgatcgacccgtcttcggatacgcgcagcagcgagcccacttgggagatgcggcccatctcatcggtgcgcacaggcacgatctccacatacgcgatgggcatctgatggcgcgcccggttgatgtcggacggccccagccagcccggcgggttgccgtgaccggaaccgcctccgtggatgaagtcctcgggcgtgatgttgtcgaattcgccgcggccacggccggcatcataatcgccctcgtcgggcacttcatcattcatgactggcatgcatcccattattgcgcgcaaaaacacgccacgcgtcaccttccggcgaaatcttgggaaacgtttggccggcggcggaaaatacgacacaaatgttgggtggtgctgggaagctggtagccagcagggagccggcggccacgaaccgcacggccccaagcgccaagacgtattgcatgaataaggcaatcgcccggcggccacgcacgagggccgtacggcgatgccaaggaaaacacaaaagaagggaacatcatggcaaccaccgccatcacctccgccgatttcgagaagaccatcaccgacaacgaaatcgtgttcgttgacttctgggccacctggtgcggcccgtgccgcgcgttcggcccgattttcgaggcggcctccaacgagccggagaacgcgaacatcgccttcgtcaaggtggatatcgacgccaaccaagatctggcccaggccgccggcatccaggcggtgcccacgctgatgatcgccaagcagggcgaggtcatcttccagcaggccggcgcgctgcaggccgccgatctcgacgatctgatcgcccaggccaaggcgctcgacctcgccgccgccaaggccgcccagtccggtgccgaccagcaggcctgagcctgattttccttcatccactgcgccgcctatcatggtggtcagtgtgaaatccgatcaaggagcgcaatgacgagacatgccaagccgacccgtatgctcagaccgttgaacaagcgccagtggatgaagatcgcggctgtggtggccgcggcaggtctgctcggcgcggcgggattggtgtcgcgcagtttctaccatgctgatgatgtgaagccgatttccaccatcacttcgttctccgctaccgattcggccgcatcccgttctgccactcgtggcgcaatcaacagcgccgacaagaacaccacgttcgttacggtgaagattaatggcgattcgcgcgtagtacttggcgaaaaagccaacatgaccaccgtcaaggacgtgctggagacgggtgatatcacgcttgacccggatgatgccgtatctccctcgctgaaatccaaggtcaccgaggccaccgtggtcaccattaatcgcgcggatgccgatgtggagaccaacgataccgagatcgccttcaatgaagtacgcaaggagaccagcagcctgcccaagggtcaggaaaaggtcgagaccgagggccaaaagggcattatggagaccacctcgctgatcaagcgagccggcgacaaggtcatctcttccaacgtattcgcctcatgggtcaagaaggccccggtggataaggtgatcctggtgggcactggttccaccaagtcatcgtcgtcggccgatctcggcaccactgttccggctggagaagtgcagtcctgggcgcatcagtatctgttggacaacgggtatagcgaagcggacttcaccgctgcgaactacatcatcaaccacgagtccggttggagccccaccgccaccaaccccacgtctggtgcttatggcttgggtcaggcctaccccggtagcaagatggcttccgccggtgcggactggcagaccaactacaagacccagttcaagtggttcatcagctactgcgagcagcgctacggcggcatcgtcgcagcgtacaactactggatcgctcataacaattactgattgcgattattctctatgcaaagagcctctgccggttgattcccggcagaggctctttggttatgtggctcttcgcattttggtgtgtatggcgtgtggttagaggtgggtttggatggcttgtctgaagcctccggtgtggagcaggcttctggtgatgtagttgtcgaggttgcggaagccgagggctatgtccctgagggtctcgagcctgccgttgatggcctcggtggggccgttcgcgccgttggggtggtcgaagaacgcgaacacgtcgcccatgcggcgtttgagggtgcgtccgagcgtggcgagttcggggcatccgggcgcaccgcttttgacggcgagggattcgatgagctcggccatcatgccccgtcccttgcgccggtcctcgtgcgcgtagcaggagatgatcttctggtacgcgccgtgcgcgagggcgagcggcttgttcgcggggtcggcgagcagatcgtcggcgcgcgccttctgcctgtcggtgcgcagggacgcggtcttgagcaggatcctcctgcccttgtagagcgtccttggtgccgcgccgtcccgtccgttcgcgctggagccggcagcgcacctcgaaagcccgcgacgcacggaccccaagggccagctctaccgttcatggcggctcgaggaaccgctgcgcctgctcgggctctccctcgaccgggccgggggagagctgaaccgctgggtgttccgggcctcgcatagccgcatccccgagatcgtcgagctttccaaaaaaaatcaggagacgccgccccgacatcccacgcaccatcgaaccgggctgctccaacgccaggctcgaggcgttcgacaacaggatcaaggccaccatccgcatggcctacggcttccaccgcgtcaccaacctcatcgccctgatcatgctccgatgcagcggattcgacatccgactaccacaacccacaatctaacccacaaaaacagcagaagcctcaaagatcggtattcttgcagggctttttgggttatcccgcgggcatgggtagactggcatgcggtaggagaaatactcgctgaaaggtgcatgccagctcatgggaacgggtggccagccggaaaagaatacgacgccaacggctccggcgtcgcataacagtgtcgcggatcagcccacgatggtgcagtctccggtgtccgggcctgcccaaccgggcgatgcgcagcccacggaggcgatgagcggcgttccggtgccccgtccgaaccggcgggcacggcgattcccgttgccaatcacgacatcgtcgatacgttctgggacattcctccgatcacgttccccacggacctgtacgacgccggcggtgccggtgctccatccggtccgcggccaccccagtcagccgcgctgacacccccggcatcatacgcgatgtgcacgtcgtgcactgctacgtgccgtccgccgggctacccgtccagcgaaagcgtaatcgggcagccagccagtatcgatatatgtcataacgtaaggaagtagcccatgccatcacacgcacgcacggtcaccaggaaaacccatcgcgttcgcaacgcgctgctcgtcgtgctgctgttgctggtcgtgtgcgccgcggcggccggcttcagcggattcaaactgtacaagtcggcgatgagcgccaaagcgcacctcaacaatgttgtcaacgcggccaaggtcatcaaggacggttccaccgacgacatggtcaaggcgctgtccgacgtgagccacatccagaaagaggcggccgccgccaagcaggatgtcagcggcggtctgtggacgctggcggagaagatgcccgtggtcggcggtgacgtgaagacggcgcgcaccgccatcggtaccatcgatgacttcgcgcagaccacgctgccccagctgggcaaggtcgtcaccacactgaccggtgccagtctctccagtggcgatgggcagctcgacatggagccgatcatcgccgcggcgcagcagcttgccacggtcgaccagtccgtgcaatcgcaggccaggacgatccaggatcttcccgacgccaaactcggcgtggtgaacaacgcgctgcagaacggcaagacgcagatggccgccctggcgcaggtgaccgaaaacctgagcggcatgctcaacatgctgccgaacttcctcggtgcgaacggcgcccgcaactacgtgctgctggcccagacgaattccgagatccgcggcaccggcggcctgatcggttcggccggttccttcagcgcggacaatggcaagatcgcggtgggggagttccacgcggatgccgagttcccctccaacgccgcgttggatgacgtcaaccaggacggtgacggcacgctgtacagcggactgtacttcggtcaatgcgtccataatctttcgtccacgccggacttcccgcgcgtcgcgtccatggcccagaagttctggcaggcggctccgttcggcggatcgtccgacggcgtgatgtcgctcgaccccgtcgcgctgcaggcgatgatcggcgccaccggcgacgtgaccctgtccgacgggcgcgtgctcaacgggtcgaacaccgccgaattcctgctcaacggcgcctacaaggaactggcgccctccgctcaggaccagtacttcagcgagaccgccgcccaggtggtcgcccacctgttcagcgacatgaacacgcagaagctcatgaccgtcgccaagactatgctccggatgaccgagcagcggcacctgtacttctggtcgttccacgaggaggatcaggcggtgctgcgcagcgccggcgtcaccggcgagatcaccaacgacgcgaagaacccggtggccggcgtctacctcaacgagatgcaggcctcgaagatggactggtacatccagcgcaagtcgacggtgaagaggaccggcgacaacacctaccacgttacgtattcgttcaccaacaccctgcagccgggcgaggccggatccctgccggaatacatcacggcgaacgccaagggaggcgtggcggtgaaccgcgtggtcatctacacgccggccggaggcgaggtcagcaatgtgtcggcgtcgaacggcagttccttcgcgcaggtgcaggccaaggaccatatgacctacatggacgacatctccctggcgcctcaggacacggtgaccatcgaatacgacgtgaccaccgcggccagctcggccaacctcaaactggatcagacgccgaccatcggcgaccccgcgatcacgtacgagtactgatcggtattgatctgtgggtgtgatcttgggattgtgtgcccttatgaaagcgcgccgccgactcctctcggaaccggtgacgcgctttctgtaatgcctgattagaaccttgtgggggtgcggacgaaaagttggatacttgagaggcttctgatgtttttgtgggttagattgtgggttgtggtagtcggatgtcgaatccgctgcatcggagcatgatcagggcgatgaggttggtgacgcggtggaagccgtaggccatgcggatggtggccttgatcctgttgtcgaacgcctcgagcctggcgctggagcagcccggttcgatggtgcgtgggatgtcggggcggcgtctcctgattttttttggaaagctcgacgatctcggggatgcggctatgcgaggcccggaacacccagcggttcagctctcccccggcccggtcgagggagagcccgagcaggcgcagcggttcctcgagccgccatgaacggtagagctggcccttggggtccgtgcgtcggaccacggtcggatacgtgtggcccttgcggtatccacgccgatcgccgccaggccgtcgaacggcgagggcatcgcggccctgaggcggtccgcgacccggcggacgatgtctccggccgtcctccacgcgacgtgcaggaagccgctgaccgtcttccggttcgcgacgctcatcagccatgtgcactccgactcggagtcgcgcgtgaaccggctgcccggctcggcccacggcaccatcgtgaccacggccccacaccgggggcggtccactcgcggcatgtcggcgaccggttcgacctccagcagccgaaatcctgatgacgctaacgacgacggccgccgccacggtcgtaaccgcggcgcttcctgccgcagcgggagcatcggagcatgcccccgcgtggacgcacgcggatctcgagcacgggtccggaacgcagcggcgaatccgtgatccgcacatcctcgaccaccgtgcctttgacgttgagaagctgtttgaatatgccgttcatcaggcgcctgccgccgggtagtacgtttttcttggtcgatgaacatcccacccaaaaaaacgccccccaacgactcaacgacgaaccgccacccacgaaaacagcaatagggcccaaaaaatcggacgttatcttattgctacggtacataacgcacgcatattcgcgagggaatgctcactggaatatatgagggaatgctcacaacacttgagaagggacgttgttatgcaaatcatgtatgtatgcaccggcaatcaatgccgttccgtgatggccgaatactacacccgagccaagcttgccgaccgaggaattggcttgcagaacgacaatatcaccgtgcgcagcgcgggtactctgcactatcccccgcatcccgctgatccgatggttatcgatttgctgaagaacgacggcattgacgcgaattcccattcttccacccctctcaccaccgatatcagccggcaagccgacctgattctgtgttttgagcgtgagcaaatatccgatttgcttgagcagaatccactggctattcgcaaagtatttctgttcaatgacttcgtgaacgcttgcaaacatatgcatgctgagggtccgattgccggcgataccgccgcagacaagcttatcgaaatcatggattgcgtacctatgctgcggccgtttttgcctacggcactcgaaaccgaagaccctcatcgtcaatcacgcgaggtgtttgaacgcgtgtatgcggaaatcaagcacggcgtcgatattatgctcggtgctgtggcctgaatgcgatatcggcgaatagagccagcaaaaagaccgtcagttattgcgatgttgaaattgcatatttctatattcaatacggctgatattgcgggttcttgtttcctcttttcttggtattggttaaatcagtgctattcggggagcgcaatacgtaggtcaaatgttcttcaattatgcaatcatgcatgcatatggtttgtataatgcgaaattagctggttacaattagtggcgtaaataaaaacacgttaccaatgcaataaggagagcaattatggcttcattgcttcagggattcgaagaggttcagctggtcaagccggtgggcaagaccgttctgaccgtcaccgattccgccattcgtttcaacaaagccaccgctgaagtgctcggattcccggcgtacgtcaaggtgctgattaacgacaagaccaagcagatcgccgtaaccccgaccaccgccaaggccgacaacgccattaagttcagcaagcccgaaggcaagcaggctgcttcggtaagcgtcaaggaagccacgctcattgaagcagtgaaggcatacttcactctgcctgaggctccggaaggcgaaatcgcctaccagtccgtcaacggtaccgcctaccccgaaagcaagaccgtgatcttcgacgtggccaacgccaccgctggcaccatgaagcgccgcggccgcaaaaaggccgcctgattcgacacatcgaactggatgcattcttgccggtagggccaaggggacgtcaaccgtgaaggttggcgtccttttgtttgcacagtccatgctcggtatttcatcgtcagacaaggcgtgatataacctgagaacaacggattttcagggaggacagtggttcggatgcctgcatacgcacatgaccagtacgaacgcggacggcatgttatggccgagaccgagacggacaagtcatctgctgcatccagcgtcgaaaagggcagcagcggaaagccacactccatcatcacgtatggcattaacatcgcgatcacgacggcgaatcccgacgagaacattttggatcgccggctcaagcgggccgccgtggatttcgccgaaatcatcgccgcaaaccaattggcagcagtacagtagacgatacatgtgcagcagcttctgcacacgcacaccaccatggtgcgcgtctcaagtagccctgcgattatcaatctctccggtttcatcaccctcagcacgtggaaggccattagcatcaagacgaccttcaccggcgcaaaatgcttcgtcaacaacgcggccctcttcatccacagcatggagcagcaaaagagaacggcagcccgcgcctaccagccagccaacgccaaggccagcactaatctgcaagcgattgccgacctgcgcgacctgaccaaccgtggccgcgtcaccgtcgacatcgacgccgaacccacacgctccagcctcccccagcgcaaagcccacaagcatatacagctgcattaaactatgagtcatagtgaagacgaggggccggaacccgtcaagggttccggctattccgctgacgaatcagcggcctcgcctgaggctcagaccaagcaacaccagtgtggcgatgatgatagccgtcgaccatccctgtccaacttggttggccagagcgatcaacaggcccgtcatcaggccttcccggtattgccggtcagatctcggacggttgtcatggtcattgccttccatgagaacctcctctttagttgtaaccagtcactatgcctgctggcacaatgacaccgtgccaagacgccacgctagtagttccttggtttggtctgtccagcgtacgggggaaggttcgatggatgctggtatgctgtgttctagcagaaaggtcgcgctagcttcggggcaatcttctaggcggcgccactgactttcgcctcgttggacctgactgccgaggtttcctcaacctcagttgtaatcagaaaggtctctggctggtgaattcagtcggagaccttttactttttcaattccaaccgccttcatcaagggactcacccaagctgatttatccgagcgcaccgggctaagccgcccttggatcaaccaattcgaacagggcaaaatcgagaacgccagcatcggccgtatcctgacattgtgcaacgcccttggaatcactctcacagtttcctacggcacccccgaggagacaaacgaaacagcccccagtaacgcacaactttcactatcgatgccgggccatacgctcatgtcaagagctatgcgattctggaaccggtcaacggaacgccccggctggcaccactctatgacaatccctgttcgcctacgacacgcaacacaaagcacacgcatcctgcaatggttcactgatgccgagtaatggtcatagatgacctgcgcatataacacaagcgttccgcacgtcctcagggggcccatgatagaggggtgttcctatgtttttgtcaatctttgtgtggggtgtcgtgttggtgtgtggggtgttcctatgttttttgtcaactccttggggagttgacgtgtcgggattccggttggctgtcgtgggcgcgcttcgccctgccggtggcgtccggcgtcctttcccgtgtggcccggttcaggctacgagggctggttcctggtagagggttccgtttttgagcatgctgtagatcacgtcgcagcgccgacgcgcgaggcagatgatggcggcgttgtggtgtttgccctgttcgcgtttgcgcttgtaataggccacggagggcgggtgtttggtggatgcgacgaacgcggtctgccacagcgcgttcttgaggcgtttgttgccccgcctggagggccgttcgcctttgatgctggtgccggattggccggtgacgggcgatatgcccgcgtaggcggccagatgggcggacgatttgaagttggcgatgtcgccgccgatgccgagcaggatgttgcttgcggtcctgacgcctatcccgggcatcgacgtcaggaccgtgagaagagggtggtcctccaggagcttctcgacctggcggtcgacctcgcgccgccggtccctgatcgtcttgatgtcgtgggcgatggaggggatgatggtctcggccatgagggtgccgggcacggtgacggtctgctcgccgatggccttgaacatgtcgtcgatgatgcggccggcgcgaagcccgttggacttggcccagtccttcacgtcctcgatcccggcccgtttcatgcccgcggggccgccgtaccgttcgaggagcgcgagcgtcgcgtcgcgggtggcgcgttcccctttcaggacgcgttcgaacgcgggatgagcagcattcgtgctagggtgtgcagaagaatgaaagaacaagggcattgttcctctgaaggttgaggggaatcacgtcctctgaaggttgaagggaatcacggaggaagaatttagacatcatgtcgaaagatagaggtacagcattcgtatcatccacgcaaaataatggtactggcaccaggtcaatgcctcatgtgaggatcagcgccagccgagcgtcggcatcgttctctgcaccggtggatacggcagccatcacgccgacattctttgacggtacttatttctcttctgctccggacggtagctctactcacaacgacaatatgggcactcactatctcaccggctattccattccgaaatggcgctacatttacaacaccacactggtggcactcgacctgttgacgaccattgcggcctcaggaatcgtgttcttgttccgtccttccgcctacgcatacgtgcgaggcataggtcctggagaatacggcatattcagcttcctggcgctggcttgcgcctcttggctcatcagtctatatgctgcacgcacttacgaacggcataccatgggtgaaggttacgccctgtatgccaagctactcaacgcagcgttcattgactttatcatgctatgcacgttgagctacctcttccatctcagttttccccggtcattaaacatcttcgttcctctagtttcactagtactggtcatcatcgagcgttgggcgatgcgctgtgccttgcaccgcaaccgtatgaagggcgaattcaactatcccacggtagtaatcggttctccagaaggaatccatgacgcgctcgaacaattgcgccaatgtccaagtgttggctatgcaccggttgctgtgtgcccggttgtttcggccaaaaaagaggatgatgccgatcaggctcagcatctggtgtcggtaccattcacccccgctaatgatagcgaagctcggttgaaggtattgccacttaattcccatctgcctcagacagccaagcgtatgaaagcacgcactgtgctagtggccgacgtactgacccgcgattccgaaaccatgcgtacgttgtcgctcgcggtggagtccatgggcattgagttggcaatgactgcgtccgtggccgatctaagcggcgcagatctgcacttccgcaataatccgagtatgccggtggtcactgctagactcacgcagtattcagccattactcgcattctcaagcgtatttgcgatatcgtgctttccgccatcgccattattctgagctcgcccatcatgctgtgggtggcgtataaagtcaaacgagaagacggcggcccggtgttctattcacaaacacgcattggcatttacggcaagccgtttaccatgtataagttccgttccatgcgtaccgatgccgacaagatcaaggccaaattggctaaggaacgtggcattgaggatcgcttcgttttcaaactcaaggatgatccgcgcgtgaccaagatcggtcattttattcgcaagacgtctctggatgagttcccgcagttctttaacgtgttcaagggcgatatgagtctggtcgggcctcgcccgccgctgcctgaggaagtcgcacgatatggcatgctgtattccacacgactgttggtgaagcctggtattactgggccttggcagatttccggacgcagcgatttgactcagaaacagccggaatatgcggatgtgtcatatattcaggactggtccattaccggagatattgcgattctgttgaagacagtagtcgctgtgtttaagggaactgggtcatactgagttttcttgagtcttcgccagtttgtgtagtgaggggcggggtcggtgtcgttgacgggttcttcctgtgtgcgggtatgaaaggggcgttctcctgttaggtttgtttccgccaaaaacacaaacagaaaaacagagggaacgcctttgcccaccatatcagccggcgtgccgcgcatcgagaaggacccacatggcggagacgtcgtcatagtcccggtccgaccgtacgcgaaggacatggaccggtgcaccaggtgcgagaagcatgtcaggccgtacgaccggctaggcgtgcgccggtggcgtcacctcgacatcgggtgcgccaggctcatgctggagtacgcgccgccgcacgtgacatgcgctgatcacggcgtgaccgtcgcgatgatgccgtgggccagacgcaagagcgcgtacacgcgcgatttcgaacagcagacggcgcttctgaacgtgcacgagcccagaagcgcggtgagccggctgatgcgcatggactggaagagcgtgggcccggtatgcagacgggtcgccgacgacctgcgagcggagcaggggccgggcctgttcgacgggccgcgttccatcggcgtggacgagaccagctacaggaagggccacaagtacatgaccgtggtcgtcgaccacgaccggggcgcgtcatctggatgcatcagggtcacggacagaaggtgttcgacgagcttgtcgaattgtttgtgtatgggacttatttgaggcttctgctgttttcgtgggttagatcgtgggttgtggtagtcggatgtcgagtccaccgcatcggagcatgatcagggcgatgaggttgtcgacgtggtggaagccgtaggccatgcggatggtgaccttgatcctgttgttgaaggcctcgagcctggcgttggagtagcccagctggatcgtgcgcaggatgtccggccggcggcgtcggatcttcttcgccggttcgacgatctcgggtatgcgtgaatgcgaggcccggaacacccagtgcctcaactcgcccctggcctgttcgagcgggtgcttgagcagggtcctcaatagttccttgagttgccatgaacggtagagctggcccttggggcctgtgttccgcaggttcccgaacgcctcggactgtctgtcggtcaggtcgccggggttcttcaggaccgcgtatttgacgccgcgcatgcgcttcgtggtcttctcgtcgccgtcgcggcgcgcctggttccacaggcgtttcctgaccttgtcgagcgcgtcggtcatccagctgacgatgtggaagccgtccaatacgcgttcggcgttcgggcgccaccggccgacgcacgggtcgatccagcgggccccgtcgccggtgacgaccctgatggaggcgtgctgttcgggcgtcaacgccttgaagaacaggtcgaacacgtccccgccgaccccgtcgtgcgcccagatgacccggtgccgctcgtggtcgacgaccacggtcaggtacgtgtggcccttgcgatggctggtctcgtccacgccgatcgcggtgagtccgtcgaacggcgacggcatcgacgccttgacgcgttccgcgacccgacgggcgacggcgccggcggtcctccacgacacatgaaggaaaccgctgaccgtcttccggttcgcgaccgtcatcagccacgcgcactccgcctcgaaattgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgccggcgagcacgctgcgtgtcagggtcaggctgcggctcatcttcaggatgcgttcgcttttctcggtcgtggacgcgcgcctgcgtcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgataggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaggagctcgccggtggcgggcgatgcgagcgtgaccgtgtcccaccggatcgcggccaataccctggaacgcgccgaatcggggccggcgaggtaccggttcgagtcgatgtcgaccagcccgtacttgtcggccgtccggctttcccagcgaaccgggtcgaactgtatttcgtcaagtcggtgtttcgtgtttagtcatgtatttttttcgggtttaggttttctaggcaatttccaatctaacgggtgttgcactttcatttagacaacggggataagttcacagagccgatatttgataagctggtgaatagcaatcccaataaagtggcatattgggctatggattcgttgagcagcaaagaggatgtaaaagctgctatgcaaagcattgacgatcttaagcaacaaatccgctcattcgtcaatcttgagcaccttaaagtgccgatgattgtttatttgggtggatctgctcatattgctgacgtttttgctaacctcaataaaggtggtgtccctctgaccaagtatgaagtgtttggcgctgcttgggttaatgccgccattcggctacgaggggctgaggaatctccgttgcaagatcagctgttgcagtatgtgaaaaattactatcttgatatgcgcaagcaagctgaatttgatgtagatgatttttctgaagatgaactgacccagaatcgcacggtcacgttgccggaatttggtacagcgttgggccagtatgttgtagatcatttgtcggctcttgtccctgagacaaccagtgccgctccagagattggcttcgggcttcttggagtggccatgaacttggacaatcgtaagttgagttcactcaataagtatattcagaaaattagagacgaactggaagatattctccagaagaccgaacgcatatgcaataatttgcagagtatgtttgagaccttattgcgtcgatttaaatctactggcaatgattatgaaaacggcctatcttcgacgtttaagacgttatcttatttcgcggcattgtgggatttagatccatcttcggaagaatacacaacagcgctatctaatattaaggctgcatatgtgtatgatgctatcacatcagcatggtcatctcatggtgatcagaggttaatggaatactgtaattcttctcgtgactatggcacgcgtatttcggaagaacaatttgatcaggcctttgatcagtggatcgcagatcagactccaggaataaactttggtaaagatattaaatgtctgataacaattcatgcgaacttaagctatctttctgcgtccgtgccaaacggagagacttttgagttggagcatatcattgctcggaagcgtattgacgcggcggattcttcgaggcctcgacatattttgggtaattcgttaggtaattgcatgtatttgccacgaggtattaacaatccgaagaaggataaaaccttgtatgagattaacgaccataaccgttattctcaacttataaaggagtcgcagtattttagtgaggacgagatgcagaaagccatgcaggctctgactgcatccgattacgagtcagtgaatggtttactgcgtgagcgttcgcgacaagtagcccatacattggttcgtgcgctacttaaagattctgtttgattataactgtttaaaagttgttccgagggatcgggactagatcaaaggagcctcgccatgattctcgtcactaccaccccgtccgtcgacggatacaccatcaccaactaccagggcatcgtcttcggcgaagtggtgtccggtgtgaacatgttcaaggatcttggcgcgggcctgcgtaacatgttcggcggccgcagccagggctatgaggaagagctgatgcgcgcccgtaacgaggccattgccgaaatgcaacaacgcgcggaggcgatgggtgcgcacgccgtggtcggcgtggacatcgactacgaggtgctcggcgccgacaacggtatgctgatggttaccgcgtccggcaccgccgtgcagatcgcgcgtacggcctgaaaatactcatgaattgagggcgtgcgggtggtctgctgggctgcccgcacggttcgcaaacctacagcgcgcaaacaatcagataaatcgccacgacgtggcaggcgtacccgatgaccgtgcctaggtgaaacacctcgtggaactcgaaccagcctggaatcggattcggcttgcgcagcgcaaagcacacagcgccggcgatatacgcggcacctccgcacgcgataagaatggtcgcagccgggcccactgcgggagccgtccatagttgcggaataagtgtcaccggcgccaatcccagcacaacatacacagtggtgaacacccagttcggggtgcgcagccagacgatatgcagtatcgtgccgatcgccgcggtcacccaaatcaccgtgagatatggccggcgaatcgccgggctgagtgcgaacagcacaggtgtgttagtgccggcgatgatgaggaagatgttcgaataatcgatgccgcacagtacgcgagtcaccttcgcgctgcgccacggcacgacgtgcagcagcgcgctgttgccgaacagcagcatggccgaggcaccgtacactgcgcaggccgctttgaccgagccggccggcgcgatgcagatgagtacgatggacgccgcgatgcacagcggcagggtggcgaggtgaagccatccgcgcagtcgcggcttgcgattgccgaatgcatccacggggacgatctggcgcttgatcgccttcagtgcggccttggcttggcggtagcgcgattgcgcggccctgtatcgggccgatgcacggtccagtgcggtggggttggcgcttgcgctggatttttgactcgcggttgcggaaggcgcaactgttgcggcggaagccatggttcgtccagatggcgtgctgatggaaacgctcatactgatcacctcgctatggccggcgacgctctcccgaccactaacctacgctaccgtaacctagtataggcccgcgcaataatcaaggttgatttcgtaatgcttacagttcttccgtggtgtggtattcggtggtgcggttgcggaatacatcgccgagtctgtgaactcgtattatgcgtgtctgctgggtccgacttgtgtcggttcctgatttcggattgctgcgaatgatgctcccgacgccgccccgccagttgccggattcgtacggctcggccgttcggccgagctggtcgtcggtgactccagatacttcgttggtttcgtctcggttcatgatgttatgtaatgctagtttatggcggatggaaagttgaggaaagttaaatctgcttcatgggcttctctctgatctgtatttgtcccggttcatatgtcaatcgtttgacctgtcgaccggggcagaatccgctgtcccggtcggcgatttcggcttgttttcgtgaaccgggacactccggtttcctcaactcatatcgtctggcagacggaatcggcggaataaggccgattctggaattggcacgttgtcccggttttcgcataaatcgattgacatttataccggggcaacaaaaattgtcccggtttgcaaagatcgcccgaaatcgcgaaccgggacagcggattctggcctggcttgaacgtcaaacgattgatgcaggtaccgggacattttccgccacgaaagttgggccataagtctcaagtcctaagccctcctcaaggccatcgcaacttgaaaaacggcgcttgcccggacaaagcaaaagggctggaaccttccggttccagccctttagttgctggtgcgagtggggggagttgaacccccacgagcatacactcactgccacctgaagacagcgcgtctaccattccgccacactcgcagacaatcgactaacttacacccggctgggtaatcatgcaatcttcggcgtgtcgcatgtgcggcagggatatatcgctcgtgggtcttctgcgggtgccgtgatctttgacggtggcgacactcccctcagtcacttcgtggcagcacaagccgcaacgaaggagaaaaactcacaaccctggccggcgctcgccgttgccgtagaagtgggccagcgcttcgtcgcggaactcatcaaagtatccgtcgtcgatcgaggcgcggatgtcgtctagcagcttcacgaagaaatgctcgttgtggatcgtggccaacgtaaacccgttgaactcgcgggcgcgcagcaggtggtcgacgtacgcgcgcgaataatgctggcatgtgtagcagtcgcatccctcctccagcggtccgaaatcgaacttatgctgggcgcgcttgatgttgtaccggccggcgcgcgtgtaaatcgcgccgtttcgggcgcagcgtgcgggggccacgcagtcgaaggtgtcgccgccgttctccacgcaggcgaaaatgtcgtccacagaggcgatacccagcacgtggcgtgggcggttttccggcatcgcgtcgcagatccatgcacaggtgtcgccgatgatgcgcttctcgatcgcgccgccgatgcccacgccgtcgaagtccagagaggcgatttgcgaggccgcacgtcggcgcagatcctcgtaattcgcgccctgcaccacgccatacaacgcctgatacggcttcccgactcgatcagccgtcagccgctggtgctcgtccacgcatcggcgggcccagcggaaggtgcgctccaccgagtcctcctggtaggagcgggtgttcatcagcgtggtgagttcgtcgaacgcgaacatgatgtctgcgccgattttgtgctggatgcccatcgaaatctcagcggagaaacgatgtgcgtcaccattcagaggcgacttgaatgtcacgccgtcctcgtccacccaggccatgcgctccttgcccttggcgatgatgtcgtccgacttcatgccggtcacgtccattgccagcgtcttcttgaagccgacgcccagcgacatcacttggaaaccgccagaatcggtgaacgtgggcccatcccagttcatgaaacgcgccaagccgccggccgcgtccagcacgtcctcgcccgggcgctcgaacaggtggaaggcgttggccagcaggcactgtgcgcctagatccttcatctgctcgggcaacacggccttcatcgcggcttgcgtgcccaccggcacaaaggcaggcgtgcgaatatcgccgtggggcgtgtgaatgatgccggtgcggccgtatcgggcaccgtctcgcccaagcccgctggccgtggatggcaggcgggtgatcgtttcgaaatggaaggcgctgcggtcgccgggctgtccgggctgtgcgcccaacggatgttcaagaaggctgatcgtcatatgttcactttaggcagaagggccagaaaagggccggaaattgtgaagaactcggtttcgaggggcggatttcgccgctcccgaacgtctacttccgcttcaaggggctcccggtcaagtaggccggctgcaaaaatggcggaatggcgttaaatgagggcccttgatactcggaattgaccgcgcgaacagccccttgaagtgcaagtagatgttcccgaaacaggaaatcagcccctcgaagccgagatgcccataagactctgcgatgattacgcatagactttcaatcaacgttcagaaaacctccagattgactgcctttactactgaggtagcacacgagaagtggcaatgggcaagtgcccgaatagccgccgaacagacgtgataggaatttaggaaaaggagcagcaatggctgacgaatttaacccgcagggcgtcgaccagaccccgcggaataacgaaaaccccaatagtactgccgataccggcaacgccgagccgaagaacccgtttgtgggtggcgactcggttgatgccggcaacgccagcgattccagcgagcagcaagccccggtttcctcggccgccctcgctgccgatcagcagcctacgcaagccgctaccgacactgccgccaccgagcccatcccggactacgcctccgccaagggcgagagcacggtggtctcctcctcgccggcttctccggcagcaccggccgcaggccagacctcggccacaactccgctgtatcgtccggccccggaatatggcgcttatggtccgaccccgactcgggcacagggccagcagggcggccaggccggcagcaatgcccagcccacgcagcaattcccgttcggtcagcctgcacagcaaaccctacagggccagcagggcaaccgcaatccctactacaccaataacccgcagccgcagggcaacggcaatccgttcaatccgcccacgcagccgcagcagaacaacggcaacccgtttgccagccagtccggtcagaatggccggaatggccagcagccccagcagggcggtctgttcggtttcggcgctcccggtaccggtacgccgaacggtcaaggcccgacccagccgggacagcccggtcagcccggccccgccaagcagggcatgtccaagacggcgagcaacatcctcatcgccgtggtcgccgccgttctggctgcggccctctgcctgggcctcggttacggcgccctcaccagcggcctgatcaccttgccgaccagcaattcgctgtccaacgtcagctcgaataagtccggctccgggtccgccaccgccaagagcggcgaagcccccgactggcagaccgtcgccagcgatgtctccggctccgtggtctccatccagaccgcgttgagcaacggcaccgccaagggctccggcgccatcatcgacaccgaaggccacatcatcaccaacaaccacgtgatctccggcgcccagcagattcaggtgacgcttgccaacggcaacatgtattccgccacgctcgtcggcaccgacaccaccaccgatcttgcggtcatcaagctcgacaacccgccgagcgacctcaaggccgtgaaattcgccgattccgacaagctcgccgtcggcgagaacgtgatggccatcggcaacccgctcggctacgacgacaccgccaccaccggcatcgtctccgccctgaaccgcccggtgaccgtgaccgacgataacaacaacgagatcgtcaccaacgccgtccagatcgacgcggccatcaaccccggcaactccggcggcccgaccttcaacgcggccggccaggtgatcggcatcaactcctcgatcgcctccaccgccacctcctccgactccgccggctccatcggcatcggcttcgccatcccgtccaacctcgtcaagcgtgtggccgacgaaatcatcaaggacggcaaggtcaagcacgttgccctcggcgtggtcatcaagtccgacacggttgaagccgacggcgtgacccgcggcggcgcgaccatcaccaagtccagcgccaccggcagcgcggtcgtctccggcggcccggccgacaaggccggcctcaaggagggcgacaccatcgtggccttcaacggcaacgcggtgaacaacaactactcgctgcttggttacgttcgtgccgcggctttgggagacaaggtgacgctgaccatcgtgcgcgacggcaagaccatgaatgtggacgtgacgctcgatcaggaggagtcgtcggtgaacggttcgtccggctccgattccaacggcaacagccagaataaccagaacaaccagaacggcaatggccagaacggttacggtaatggcaatggcaacagcgatggcggcaccggtgacggcggcggcttctccgacccgttcggcctgtggtaaagccgactcgacaacgtcacacggtgttgagcggtaaccgctgaacaccgtgtcggacaagcaaaggcccgtgacagtgagcaaactcctgccacgggcctttcgtatgcgcgattgtgcctcgcacccatgccgccaacgtagtttcgatatccggcatgtcgcgcaacgctcgttgatagggtaggccaagcactgagttcgggcgacgtcccgaacacagcgcataattcaatacaaaactgaatacatttctttacgccgtgtatcggaaggtctcgcgggagccgagcaaagcgaagccccaggcaaagccgccggtgggttaacaaggcgtgaccgtagcgccgattgcgcgggccacgcttaccgtaccgcaatcgactccgtatacgagcgtaaggagcaatgatgagcagactcatcagattcttcaccaaaattctcgacatctgcaagcttgtgccgatgcttccggtcgtcgtcatcgccgcaattccgttggctttactaggcgattggcgtccgtggggcaatgcgatggcgattccggtactcggcaatccgggtttcggccagtggctggttatcgcactggtgctggttattgtgattgacactgtgcgcggcatgattgacgatttgcgtcatgggcaggttggagtcgatgtgctggccgtggtcgcgatcctctccaccgtggccgtcgccgaatactgggcaagttgggcggtgacgctgatgatcacgtccggcgaggccattgaggaatacgctcaagccaaggccgagcgcagtctgaccgcgctgatggaggccgcgccgcaaaccgcgcacgtcgtcaacctgcctggcgtggggcgtgggtttgctgccgataagggcgattcgtccgatggcttccggcgcgtgggctcggcatcggctgccgccgccgcgcaccgcttcgacacggtgccggtcgagcaggtgcagctgggcgacgtactcatggtgttgccgggcgaaactgtgccggttgacggcgagctgctgtccggcacggccacgctcgacctgagcaatatcaacggtgagccggtgccgcgtgaagtgttcgccggcgcccgcgtgatgtccggcgcggtgaacggctcgactgcattgaccatgcgtgccacccaggtggccgccgattcgcagtaccagcgcatcctcgagctcgtggcctccgcgcaggagtcgcgcccggccgtggtaaaaaccgccgaccgcttggctgtgccctttaccgtgctctcgctggtgattgccggcgtcgcatgggcggtgtccggggtgccgacgcgattcgcccaggtgctggtgctggccacgccctgcccgctgctcatcgccgcaccggtggcatacatcgccggaaccggacgcctcgccgcagccggcgtgcttatcaaagcgcaggacgtgctggaaaatctcggccgcgtcacgcaggtgtttttcgacaaaaccggtacgctcaccgtcaagcagccgcaggtggtgcgcgtcgagatgttgcccggcgctgcaacccgtctcaacgaagaccatgtgctgatgatggccggcgcggtggaaagctactcggtgcacatcctgtccaaaggtatcgccaaggccggcgcggaggcgctggccggactgcgccagcggttcgaggatggccagcgcctgtgcccagagccggaggccagctggcctggccatggccgggagtatccggtcgtcaagaacatcaatgaagacgccggcaagggcgtttccggcgaggtgaacggacacgcggtgcgcgttggccggctgtctttcgcggctgctggggaggatggattcctggcggtcggcgaggctgcccccctcagcccgcgaagcggccagctccccctaagagggggagctcagcaaaaagatgacctgcgcactcgctttggcctgctgcagccggatgagatggcgtcctacgtgtccgttgacggccggctgatcgcgcgcattgtgctgcgcgatgtgccgcgtgccaacgccaaggcagtgctcgccaaactgcatgagttgggcgtcaccgagctcgccatgcttaccggtgacaagcgggcttccgccaatatcattgccagcgaagtcggcattgacgaggttcacgccgaactgttcccggaggataaggtagccgcagtcagggccgctacaggagccggcaaaaccgtcacgatgatggttggtgacggtgtgaatgatgccccggtgctcgctgttgccgatatcggcgtggccatgaccgatggcacgtccaccgccgcttccgaaagcgctcaggtggtcattatgaatgacaatatcgccgccgtgccgcgcgccatcgccattgcacgccgcaccaagcgcgtgatgcttcaagccgtaatcgcgggccttgtgcttgccaccatcggcatgattgccgccgcgttcaaccttatcccggtcgtcgtcggtgccttcctccaggaggccatcgacgtggtgagcatcctctgggccctcactgccctaattgatcgggactgattaagaatatgaggcttctgctgtttttgtaggtcagttgactgaccgggatggtcgtatgtcgagtccaccgcatcgaaacataatcggggcgatacggttggtgacgtggcggaaacggaaatcccacccacgaaagcagcaatagcatcggagttattcattaggtcgatttgacgtttattaggtcggtccttggtcggagcggcccttgaaaccccgccgttccaagggatggcttcagcaccctccgacctaatgaacgaagaaatgacctaatgaatgcaatcgaggtcgtaaagagccgttggaggtgacgtcttcagtgtcatcaagggattcgccggttgtgcagtattgttattgctctgcggcggctctttaccgtcggccttctagccaatcgaggggtggaggtgacgcggattccttgtgagacataactatgctcaacccgactggttacgtactgttgctcacacggtatgccgagaacattgccaattaaagtaaggtgccgggcgaaccggtcatggtaggtttgcccggatttgatttcgatcatcaggcgatgattcggatcggtgaaatccaacaaatccacctcgaccttgctggcatcgcggtagaagaataattgtggctcctgattggcgttcaaatgctgtttcatggtttccgcaatgatgaggttttcaaatatatcgccgaacttgggatgcgcaaccagtgcttcgaccgtccgaatgcccaagagatggcacagcaagccagtgtcataaaaatagagtttcggcgttttgaccacctgtttgcgtgcgttcgtgtagaacggtatgagatggaatgcgatgtaacttgattccagaatcgacatccatgcctttacggttcgcggacttacaccaagttcattggcgatgttggtgtagtttatgagtgctccggaactgagtgcgcaaagagtcaagaatcggcggaattcagccaaattgcgtacatcaagatattcggaaacatcacgttcgatataagtgtcgatgtagttcgagaagaacagattgagcggcattctcgtgtcgtaaatgcgtggataaccgccttgcagcataaacgtatccggagtaagggcctgatccgccttgcatgcttcttggaatgagaacggcaataacttgaccaatagggaaacccataatctgacattagcagtgctcgtaggtttcccaaacgcacaaactatggcctaatacacagaattcccaccactcgccctctgttgcaacggaaggctttgcgttaggctagagcgcgtgactgaatctgtgaatactgaactccgcattgctgtaatcggcgctggtccggccggcgtctactcatccgatatcttcctgcgccagctcaagaagctgggcgaagagctcggcctcggcaccgaagcgcgcatcgacctgttcgagaagctgcccgtgcccttcggcctggtgcgttacggtgtggccccggaccacccgtccatcaagttcatcgcctccgcgcttgagaagacgctcgataacccgaacatccacctctactgcgacgtggaattcggcaaggacgtgactcttgacgacctgctggcccgttacgacgccgtgctgttcgccaccggcgcggtcaaggacaagccgctgaacctgcccggcgccgaccttgaaggcgtgtacggcgccgccaagttcgtcgaatggtacgacggttaccccaccggtgcccgcgaatggccgcttacggccgagaacgtcgccgtgatcggcggcggcaacgtggccatggacgtggcccgcgaactcatgcgcaacgccgacgacctcaaggccaagaccgacattccggacaacgtgtacgagggcatcggccagaacaaggccaaggtgctccacctgttcatccgccgtggcgtggcccaggccaagttcagcgtgcaggaactgcgcgagatggagaagctgcccggcgtgcagctcatcatcaacgaggacgacttcgatctggacgacgagaccatcgaggtggccggcaaggacaagctcacccgccagatggtcgaggagctgttcgccgtccgcgagatggccgaagacatggaagatgacggcgacgtcgacttcgaaggcaacccggccgaccgcaagtactacgtgcacttcaactccgcccccaccgagatcctcggcgaggacggcaaggtcaaggccatccgcgtggagcgcaccgaaaccggtgccgacggcaagatgcaccgcaccggcgagttcaccgactacccggtcgaggccgtctaccacgccatcggctacaagcccgccgaagctcccggtatcacctacgacgagcacggcgcccacctggccaacgccaacggcgacggccgcatcaccaccgaggccgacggcggcaaagtgcgcgaccgcctgtacgccaccggttgggccaagcgcggcccggtgggcctgatcggctccaccaagtccgatgcgctcgccatcgtgaccaacatgctcgaggatctggccaaggccgctgaaggtggccgtgtggcagccgaccgcgaccccgaatccatcgaccgactgctggccgagcgcggcattcgcccgatcgacttcgccggctggaagaaggtcgacgccttcgagcgcgccgagggtgccaaggaaggccgcgagcacaagaaggtcatcgagcccgaccagatgcgcgagctcgcccacgcctgacggcccgcccacgcccgtccggcattcgtccggcattcgtccggcattcgtccacccggccgcgccccgtgcggacgcggccgggctcggggccggacgggccgggcgaatatgggacatttctcgcggcgcatatccagcaatcattcagcatgcgattttagtgtgtgcattatggatgccaaagtacgggtgcacggccatttcaacggcctgaagacaacgctgctgtttgccctgatgtgggccatcatcatgctgatttggtgggccacgggcggcagtcggcaaaccctgagcatctatatcgtcatcggcctgattaccacgttcggcacctactggttctccgacaaactcgccatcgcctccatgggtgcgcgggaagtcagcgaacaggaagccccggaaatctaccagatcgtgcgtgaactgagcgccaaggccggcaagccgatgccgcgcatctacatcgcccccaccatgagcccgaacgccttcgccaccggacgcaacgaacggcacgcggctgtctgctgcacccaaggcatcctgcagattctcaacgcccgtgaactgcgtggtgtgctgggccacgaacttatgcacgtgtacaaccacgacatcctgacttccgccatcgcctctgccatggccactgtcatctcctaccttggctattcgctgatgtatttcggtggcggctcgcgagacgaccgcgatagttccggtggcctcggcctgatcggcgcattgctgagcgtgattctcgcgccgattgccgcgtctttgatccagatggccatctcccgcacccgcgaatacgacgccgatgaagacggcagcttgctcaccggcgatcccgaggccctggcttccgcgctgaacaagatttcctacggcgcacagaccgcgccgatgcgcaaaaccgccggcacccagtccgtctccgcaatgatgatcgccaacccgttctccgcggtcggtttctcgcgcttgttctccacgcacccgccgaccgatgagcgcatagcgcgtctcatgcagatggccaacgaaatgaacggcacgccgatcgctccgcccacctactccacgcgcgtcggcaggtgacgtgctaggataactattcgtgcctcgtttggctgagcatgctcgtcacgtgaggtgcagcagccgtaaggcatgcggacatagttcatcggtagaatgaaagcttcccaagctttagaggcgggttcgactcccgttgtccgctccattgattttcaatgattttcattatttccgggaaagtgtcgcgcacgatcgcaaaactacgcgctatttgagcgctttgcccgcggaacccagctgccggcaagcctcgaccacgcgggcggacatggaatcctcagccttacggccccaagaacgcggatcgtagaacttcttctcgcccacttcgccgtcgatcttcagcaccttgtcgtagttctcgaacacgtggtcggcgattggacgggtgaaggcgtactgggtatcggtgtcgatgttcatcttgatcacgccgtagcttacagcttcggcgatttcttccgggcgtgaaccggagccgccgtggaacaccagctcaaacggcttgccgttggggaaatcgactatgccggccgcgctaggcaactcgccttcggccaccgcgcgcgccacacgcgcctgaatgtcgccgagtagcgacggacgcagcttgaccacgccgggcttgtaggcaccatgcacattgccgaatgtgaaagcggccatgtaccggccacgttcgcccaaacccagtcggcgggcgacttcgaggccatcttccggagtggaatacagcttttcattgatttcggcggagtgaccgtcttcctcaccgccgaccgcgccgatttcgatttcgagcacggtgtgcgccttctgcgacttgtcgagcagttcctcggcgatgtccagattttccttgagcggcacggtggagccatcccacatatgcgactggaatgtaggctcctggcctcgtgccacctgatcggcctcatgcgcgagcagaggacgcacccactcatccagatactgcttggcgcagtggtcggtgtgcagggcgatggtgatgttcgggtatttcgcagccacttcatgtgcgaaagccgccagtgccagcgagccggtaacgcgatcattgacccctatgccggagacgtaagccgcgcctcccacggaaatctggatgatgccgtcggactcggcgtctgcgaagcccttcaatgcggcattcagcgtctgtgagctggttacgttgatggctggataggcgtaaccgcctcggcgggcggcatcgagcatttcggcatagcgttccggtgttgcgatcgtcatggcttcattatcgcgcgaggcatgcccgctaggccccgttcttcaacctgtgcgcttgtgcgattggtcacagcgccgcctcgtacgagtagaaattcgtcacccattccgggtcgtcgcacccccagcctcgccctgcgtgagacgaaacttcgcagggtagagggtgtaaggtagtctgtttccggcggaatcgtgcgaatgcggaggtgcatcatgcctggaattgttcttatcggtgctcagtggggcgacgagggtaaaggcaaggctaccgatctgatcggcaccaaggtcgattacgtcgcgcgcttcaacggcggcaacaacgcgggccatagcgtggtggtcggcgacgagtcgtacgccctgcacctgctgccctccggcatcatcaacccgaacctcaccccggtgatcggcaacggcgtggtcgtggacccggaagtgctcttcgaggagattgacggcctggaatcccgcggcatcgattgctcccacctcaaggtgagcgaggccgcgcacatcatcgcgccctaccaccgcacactcgacaaggtgactgaacgcttccttggcaagcacaagatcggcaccaccggccgtggcatcggcccggcctacgcggacaagatcaaccgtgtcggcatccgcgtgcatgacctgttcaacgccgaccatctgcacgacaaggtggaggccagcctgcaccagaagaaccagatgctggtcaagctctacaaccgtcgtccgatcgacgtggaccggaccaccgaggagctgctgaagctcggcgaacgcctcaagccgtacgtggccaacaccggcctgattctcaacaaggcgcttgacgaaggcaagaccgtactgtttgaaggcgctcaggccaccatgcttgacgtggaccacggcacctacccgttcgtcacctcttccaacccgaccgccggcggcgcctgcaccggcaccggcgtgggccccaccaagatcacccgcgtaatcggcgtctccaaggcctacgtcacccgcgtgggcgaaggcccattccccaccgaactgctggacgagtccggcgaatggctgcgtcagcagggccacgagttcggcgtgaccaccggccgcccgcgtcgctgtggttggttcgatgcagtcgtcaaccgttacgcctcccaggtcaacggcctgaccgacatcgtgctcaccaagctcgacgtgctcaccggcctgaaggagattccgatctgcgtggcctacgacgtggacggcgaacgtcacgacgatatgccgaccgatcaggccgctttcgccgccgccaagccgatttacgagaccatgcccggctgggacgaagacatctccgactgccactccttcgacgagctgcccgccacctgccaggcctacgtcaagcgtttggaagagctgagcggctgccgtatctccgcgatcggcaccggtccgcagcgcgatcatgtcatccagatcaattcgctggtcgactgaccgtctgcaacgaatttcccggcttgactggtaacgacgcggcacatgatatccgccggctgattccgcgattcgaccacttgaagtggaagatggcggcggccggcatagtcattggtctggtttcaggattgctggttgtcgtataccgtctcggcatcgaatacggcacggatgcgtcccgttggatatatgcgcggattcgcgagaccccgtggctgattgcgccgtgggcggttgccgcggtggcggccgcgctggcgatcgcgtggatggtcggcaaggagccgatggctggtggcagcggcatcccgcagaccaatggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggcgcgcagtgtgtatcccaccgtttgcgcggccgccgccgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgccaccgccgcatcgctgaccgccgatttcgtctcaaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgattcggtgatctgccatccgacgcagtggcggtgtttgcggtgtgcgtgatgacgggcacgctcgccgcgtccgtgaaaacgccgatcacgtcgattctgttggctgtggagatgtctggaacgttgacgcacatgctgccggtcgcggccgtcgctttcatcgcgctgttggtgtccgatttgctgcgcaccaaaccgatttatggggagttgctggagcggtacgtgcgcgcgcaaggcatgcagatggcgatcgcaagccatgtgggcagcggcattatggaactgccattggaaatgggagcgattgcggacggcaagcgggtgcgtgacgtgcgttggccgtctgggtgcctgatcatcggcctgcgtcgcggcgaaagcgagatcgtgccgcgcggtgatacacggctgcgtgccggcgactatctggtggtgctgttcagtggcgaggaggagcgcgaggtgcgacctgcgatgcggcggctgtgtgatgcccggcttgactgagcctggctgaattcggctggactctggatgtccgaatctgcggaatcggacatccagagtgcatacgttggcgctccgtgtaaactcatatgcgttaggaaggcggcagccgcggcccagctcgttgttgcacggcctatgggcggaacaacgctgtccgcgggaggccagtacagggggagcgcaatggaatcgcaagaacaatcgccgggagacgtggtgactgcgggtgaggactcgcatcccatcacgcaggcaatcgacgctgttgaggtgacgcatgctggtgcaaccgcgcccgccgctaacaccatgaatccgcctacgattcccctggcaccgatgaaacgtatgcaggcgcggttcaatccgctcgccgacggactgatgtatgttgtggtgttcgtcggtggatttgttggagtcggctgtcggcatgcgttggatatgctcctgccgtcggtcagcggggcgccattcgttgtgggcacgtttgtgtcgaatatggtcgcctgcttcctgttcgcgatgctgaccgaattcatggcgaccgcttcgtggctgcgtcgccgggtgcggcaggttgtcagccgtggtgttgggctcggcttgctcggtgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcggggtgcgttttcagctgtttccgtgtccgattctgccgaatcggacacgcagggcgtacgccatgtgaaagtggccgacgtggcgcgttctgccgcgcaggccgcaatggaagccgcgcaggcggcgcagcaggccgcgcagacggcccagcagattgcacagacgggacaggttccgcgagtcgaaacgccaaccgtgccgccgactgccatccagcctatgcagacaggccacgttccgcagattcctccgctggtcgttcctcagctgacacagtcatcgcagccgttgttgcgcgagccggatacttcagacttggggcagctgcccgagccgattcagcagtcgcaaccaatccagcagccccagcagcagtcgcagccaatccagcagccggccaacccgcttccacccagcttcgagcccaaaccgatcactgcggagatttcgcttgtcgccgacccgactaccggggaggtgcgctgatgatgtggatgatctgtctgttcggcggtctgggagccatggcccgttacgtgctcgacgtgtcaattcaacgaggctggaaccgcgagaatcgaagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgcgtggccgccggtttcggcattgcgctgcttgccaatccggcgtaattttcacgttacacggacggtcgctgagtaacgtgaaagaaatctgagcgccaccgccatcaaggccgccagtccggatgcaacgctggtgattgcattcgaccagaccaagccgctgctgaaggccttcgcctccgcgggagtcgacactaagaagctgtatttcgttgccggactgtcgaacaggttcgagagaatgtaaatgaatgtaatatttcgtggtaagcacgtgagcatacaacgatagaacagtgatgacggggaaggtgcgatcatggtcggcatgcgcgatgtggcgaagaaggccggggtgtctctgagcaccgtctcgctggtggtgaacggcaacgggtacgtgtctgatgacatgcgcgaacgtgtgcgcaaagccatgcaagccctcaattatgtgccgaacgagcttgcccgcaatctgtatcatgattgcacgaatctggtcggcgtcatcgtgcctaccatccgccacccgttctttgcgacgtttaccgcacatctgcagcatgcgctcgccgcgcaaggattacgcactatgctgtgctctaccgcagatgaggcggatggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcaatcggatccgaccacgagcagggtgggcgattgattgcgcagatgctgatccgcaatggtgccaaacatgtggtgatgattggcggtccgcgagatcaattcttcgatttggctgcgcgcggagaagtcgaggaaggaccgttcgatttgggaaagaccacgttcccgacggtgcgctactacctcacgttggaacaggaattgacctccgcaggcgtgaaatacgagtatgttgaagctggcgaagtgatggattttgccggctatcatcgtgcggtcagcaatgcgctcgacaaggtgacgaccgacggcgtcgatgccgtggtcagttccgatattggtgcatcgttctgcgtgcgcgaagcgttgggccgtggaatttccattcctgacgagctgcagatcgttgcctacgatggtacgtatttgactgatttggccggcatgaagctgaccgcggtcgcgcaggatttctcggcgatcgcacagtcggcggccgaccatatcgtgcaggcgattgccaatgaggaagtggccgcggctaacgcttcacgcaagaacatccccaagccgttcgagccgaacgtgcttattcccatgacactggtgccaggcgataccacgcgttgatactgtgcgtcttcatgcgtgtgcccggtgtggatcgcatcgatttcagcggcgtccacaaccggcgaacgtccgtcgatagtcgtgctcatcattcgacttgtgcacatgtgtccgattctgccgaatcggacgtatgagttccgaaaaatgtgttctgtgtgtccgattctggagaatcggtcatgtgtgatgtgaattgggatgtttggatgtccgtttctgcagaatcatctttgctctgtactcgttgattcgcaaatacggcgcatggctcgtcataccggccatgctcggcggcgcggccttcctggcggactcggtgctgacgccggccgtgtcgatctcgtccgccgtcgaaggcctgaagacgctgccggcgttggagcatctgttcaccgagaacaaggatctgacgatgatgatcaccgcggtgatcatcgtgatcctgttcgccgtgcagtcgcgcggcaccgaatcgatcggcaaggtcttcggctcggtggtgatggtctggttcgcgttcctggcgatcgtcggcgtggtagccatcggcaacgactggtccgtgctcgccgcactcaacccgtactacggcatcaagttcctgttcagtccgaataacgccaccggtctggcgctgatgggcaccgtgttcctttcgaccaccggcgccgaggcgctgtactcggatatgggccacgtgggccgcggcaacatctacttcacctggccgttcatcaaggtggcgctggtgctcaactacttcggccagggcgcgtggatgctgcgcaaccagaacaaccccgaactggccgacgccgaggggatcaacccgttcttccagatgatggatccgaacgtgcgctatgtggccgtcgtgctgtcggtcaccgccggcatcatcgcctcccaggcgctgattacgggcgcgttcaccatggtctccgaggccaccggcctcaactggatgccgcatctgcaggtctgttaccctgcccgtacccgcggccagctgtacattccggtcgtcaacgtggtgctgtgcgtggccacgctggccgtgctgctgctgttccgcgattcggaacatatctcggcggcctacggcttggcactgaccatcacgatgatcaccaccacgatcctgctgggcatctacctgtggcaccgcagcaacaagttcggcgccgttgtgttcaccatcgtgttcctggcgatccaggtcctgttcttcgccgcctcgatggccaagttcctgcacggcggctggttcacgctgctgctcacgctggcgatcctcatgatcatgtacacgtggaacgagggcaccaagctggagcgctcgcagcgtcggcacatgatgccgaaggacttcctccccgcgctggacaagctgcacggcgatagccgcatccaccggttcgcggacaacatcgtctacctgaccagcgatccggacctgaagcgtctcgatacggacatcttcttctcgatcttcgccgaccaccccaagcgcgcccgcgcatggtgggcggtggccgtcgagaccaccgacgagccgttcacccgtgagtattcggtcgagagcttcggtaccgactacctgttccgtgtgcgcatccgcctcggcttcaagatctcgcagtccatcccggcctacctgcatcagatcatgcacgatctggagaagaccggcgagctgccgaaccagcagtcgatctacccgaagcttgacgccgatcccggcatcggcaccatccgctacgtggtgatccacaaggcgctgatgcccgagtcgaaggtctccggccgtggcgccctctcgctgcagatcaagtacgcgatccgccgcgtggccggttccccggtcaagtggttcggcctggcgccgtacaacccgctggtcgaggtgcagccgctgttcgtgtccacgcgccgcccgccgcgcctgacccgcgtggccagccaggcgcccaagcgcgagggctgagccggcaggccgaacagccggtgcgagccgggtggcctaatggcatgtcagggggccgcgaaccgtcatcgtacggttcgcggcctttgcatatgcgaatgatgcagagtgggcggtactgcttgtgaatgtagcgggtggacgggtgacgtggttgatgccttttgccgtatgttcacggtggctatgcgtcggatgggactgtaattcgacttcttgggatcttttttgctgcagtggtgcgccaaaaggtctcagccgtctctgcgccacgccttccggcagtcagtacaaggttgtactacactggtggctgtcacacggatgtccccggtcgcccgcgcctccgcggtacatcgttgtatggatacgtgtcacgtatgcagagtgcatgcagatatgtagaaaggaatcccatgccccagcaggaccatctgaccgcacgtctcgtcgtcgatgacgattttgaggtcgctccggtcaacaatcgtctgttcggttcgttcgtcgagcaccttggccgttgcgtgtacaccggcatctacgagcccgaccacccgaccgccgacgagcacggcttccgcaaggacgtcatcgacctggtcaaggaactcggcgccaccaccatccgctacccgggcggcaacttcgtgtccggctaccgctgggaggacggcatcggccccaagcaggaacgtccccgtcgactcgatctggcctggcattccaccgaaaccaacgaattcggcctgcacgagatggccgaatggcttgaggccaccggcggcaacgagctgatggaggccgtcaacctgggcacgcgcggcctgcaggaggccctggacctgctggagtacgcgaacgtgcccggcggcaccgagctgtcggaacgtcgccgcgccaacggcgccgacaagccgttcgatatccgcatgtggtgcctgggcaacgagatggacggcccgtggcagctcggccacaagtccgccgaggactacggcatgctcgccgcctccgtggccgccggcatgcgccagatcgatccggacgtggaactggtggtgtgcggctcctccgcccatggcatgccgaccttcggcaagtgggagcagaccgttcttgagaagacctacgagaacgtgaacttcgtctcctgccacgcctactaccagccgttcttcaaggaggacggcacgcgcgacatggccagcttcctggcctccggcgtggatatggacggcttcatcaaggacgtggccgccaccatcgacgccaccaaggcccatctgaagagcgcgcacgacgtgtacatctcgttcgatgaatggaatgtctggtaccagggtgaggagccgagcaagacccccgagggcatcggcaactggccggtggccccgcgtctgctggaggacatctacaccgccgccgacgccgtggtgttcggcgatctgatgatcacgctgctcaagaacgccgaccgcgtgcgcgccgccagcctggcgcagctggtcaatgtcatcgccccgatcatgacggagccgggcggcccggcctggcgccagaccacgttccacccgttctccgtgaccgcgcgcctggccaagggcggcaccgtgctggagccgaagctgtccgccggcaccgtggatacgccgcgctatggcgaggtcgacggcgtgaacgccgtggccgtgcgctgcgccgacggctcgctcgccgtgtttgcggtgaaccgttcgctcgaggcgaccgccgagttcgagatcaggctgcaggacggcgcgcagccggcatccgtcgaggcgcagacgctgcacgacgacgatctgttcgccgcgaatacgctctacgaccagaaccgtgtgaccccgcacgccaacgggtcggccatgtacgatgccgagtccggcgtggtccgcgtctccctgccgccggtgagttggaccgccctgcacatcaagtgacgcgatgggccgcgcggtccgttccggagaaggacggatcgcacggcccttgcttcccgggccgggcggaagggaccggaccggccggggaaaacgcgttatgctggaatcagacgggcgttccgcctgaaccgtgcggaacatgcccgatggtgcgacgagaggggtgctgtggcgaaacgggtgaccatcaccgacgtggcgcgcgagacgggcgtctccatcaaaacggtgtcgaatgtgctgaacaacaccggcagtatgcgcccggagacgcgccagcgtgtccaggatgccatcgaacgcctcggataccgcgttaacgtgtccgcccgcgccatgaaaaccggcggcacgaagctcatcggactggccatcaccgatttctgccagccgttcatgccctatctcgccgacagcatcgtggcggcggcacgttcccgcgggtacgcggtgatcaccgatacctacaacagcgccggcggcttggcgcaggcgatcccggagacgaagaagctggccgcggacggctggattttcttcatgggctcgccgatcacggatcgcacgatactgcaccagccgtatccgttggtgattgtgggcgattacgatacgcagggactggccgattgggtcacgatgccgaacgtggaggccgtacgcaccgcggtgggggcgctgctggattcgggatgccgtaggatcgcgttgatcggcggcaccgcggagaacgcatgcccggatgccgaccgcgagtcgcggcccgaaaccaccagcacgatgcgtacccgcggctatgtgttggcccatgaggagcgtggcctgcaggtcgattggcggctggtccgtaacgcggattgggtgcagtccggcggccgcgatgcggtggcggggctgttggacgatccggatgcgccgcgtccggatgcggtcatgtgcctgaacgacgcgctcgccatcggggtgattcatgagctgcagcggcgcggcgtgcgcgtgccgcaggatatgcaggtcattgggttcgacaacgtgccggatgccgagtactgcatgcccggattgacgacgatcgacccgcatgtggatgattacgcgcgacatgccgtggatatgctgatcgcgcgcatcgaggggtcggcggatccgttccgcacgtatgtgacctcctacgatctggtgcgtcgtgcctcgacgtgttgacggcccggcgttcgcctggacatgggtctgtgacgggctgctgtcgcctctcccgtggcgtattccgggagaggcgacatgcgggctaggatcggagcagcacctccgtcagcgcttgacggacggcgctcggcatatgcgaatcggagcaatcttccatgtccggcccgctgacgtgctcgagtgaatccatcgtggccaatgcgtcgatgccgttctccgctatggcggcataagcctgttccttggtcagatatcgcatttcggcatgccgaaggatgtcgaagacgtcttccatgcggggatcggcggccatcgtcgtgtcgccgatggtgacacgtatctcgctgcgggtggatacgtcggcgaccgttacctgcaatgtgagggtttcggcatcataccggcgatccgaatcgacggatgcgccgtcggcctgtacggatatgtcgctgtcggtaatgcctcggaacaggaaatcccatgttctccgggccggcagagcgtgaacgtctccctgggctggcgataccgtgagtgcggatgtggcgccgtccttgcgccatcgataggtgatcgcggtggtcgccggggtgatctgccgagagtaatgtcccgaatcctccatcagcgtgaagtcgccgtccgctccggggaagacgatgatctccagatgctgcgggttgtcgacggagttgatggaatccccctcggacaggggctgcatcggcacgatgccgccggccttcgcgaacacgggaattccgtcgagcggacgccagacggtcatgcgccgtccgttgggcgaagacgcgctataccggcgcccggtgaagaagtcgaaccagtcgccctgcggcagccatacgtcggccttgccccgtcgggaggatttatccatcggttccgtgatgggcgcggccagcagttcggtgccgaacatgtattcgttgggaacgtggtatgcggcgtcgatgtcgggcgatccccaatacatgggctccaccaggggaaggcctgtccgggatgcgcgccagttcatggtgtggaggtacggaatcatgcgatggcgcaggcggggcgcatcgtccatgatcgcacggagggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtcggaatggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggccccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgatctcgtcggcctccgcgtccagcatcgcgttcaacagctgttcgaccttctccgacaccaaccggtccagcttcgtctcgagcatgttctcgtcgacctgtagaatctgattcggcatggttccgtcgccttcctaaataggttgatttggtttggcgactgaaatcgtacccggacgacggaccatgtctctcaactcaagcctcaaccaaaatgcgcaacaaaccgggcgttatcaatcggacacattggagtcggacaggctaagctgcatagaacaccgcatctaatcggttcgacacgcgcatttcactgcgcgactggacattgacgtccctttcgaggtaatatcgaaccggttcgatacatacgtgagtatgcaaatacgtaaacaacaaacaggcagatgcgcacgcaaattgcacccgcgcccatgagccaagggaggtcccatgaaaaacaaagtgcaactcatcacatacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccataccaaagtcgacgaacgtctcggcagctgggacgacgtcgccgaactctccaagacccacaacatcatggtcgacgccatcgtcaaccacatgagttgggaatccaagcagttccaagatgtgcttgaaaaaggtgaggaatccgagtattacccgatgtttctgaccatgagctccgtgttcccgaacggcgccaccgaagaggacctggccggcatctaccgtccgcgtccgggcctgccgttcacccactacaagttcgccggcaagacgcgcttggtctgggtgagcttcaccccgcagcaggtggacatcgacactgattccgccaagggctgggaatacctcatgtcgattttcgaccagatggccgcctctcacgtcagctacatccgcctcgacgccgtcggctatggcgccaaggaagccagcaccagctgcttcatgactccgaagacgttcaagctcatctcccgcctacgcgaggaaggcgtcaagcgaggcctcgaaattctcattgaggtgcatagctactacaagaagcaggttgaaatcgcctccaaggtggaccgcgtctacgatttcgccctgccgccgctgcttctgcactcgctgttcaccggtcacgtcgaacccgtggcccactggaccgagatccgcccgaacaacgccgtcaccgtgctcgatacgcacgatggcatcggcgtgatcgacatcggctccgaccagctcgaccgctccctcaagggcctcgtgcccgacgaggacgtcgacaacctggtcaacaccatccatgccaacacccacggcgaatcccaggccgccaccggtgccgccgcgtccaacctcgacctctaccaggtcaactccacgtactactcggccctcggctgcaacgaccagcactacttggccgcccgcgccgtgcagttcttcctgccgggcgtgccgcaggtctactacgtgggcgcgctcgccggccgcaacgacatggaactgctgcgccgcaccaacaacggccgcgacatcaaccgccactactactccaccgccgaaatcgatgaaaacctcgaacgcccggtggtcaaggccctgaacgccctggccaagttccgcaacgaactgcctgcattcgatggcgagtccagctacgaggtcgatggcgacacgtccatcaccttccgctggaccgccgccgacggcacgtccacggccgccctcaccttcgagcccggacgcggcctcggcacagacaacaccaccccggttgccagccttgcctggagcgatgccgccggcgaccacgaaacccacgatctgctcgccaacccgccgattgccgatatcgactaaccgttggcccataaacgtcactccgctgtgcgcgctccaagtagtgcgcccggcgtaagctgggttcatggaaagcaaaccgcccgcagtgcactgaagccagtgcgctcgggcggttttgcgtatgcggggttgaaggtcgtgctcctgcgggcgcggcccaagcatcccgccggaatcgacgagacgagcagcagaacagagaaagagcagcatcatgttggaaccgtatgtgcgtccgggtattgatgatcgcccggatttggacaaggtcctaagtcccgaagacaaagccgccgtggccagactggccatcaagaatcgccgccgcccgcccgaagcctctgcggaccagcctgaggctcaggctgtgcgattggcttccgccagttcttcggcagccgctgctgcagccgccagtgtggacactcccgcgccggatatgtcgtccgcctacctcgacatgcgcgatcccatggtcgccgtcaatggccaacgccctaccgcaggtcaggtctcccgactcaactggggtttcttcgctgcttcaattctggtcggcgcaccttgggtggcgttgaacaccattgccatgcccaacgcgattgcgcgtacgttcggctatgacactgctgttgccggtcatatcgccatcaatccggccactggccgcccgttgcccgtcgccaccgaattggcgatgcccctggccgtgttggtgattgtcggcgtagtggcctccatgtttgcgatgccgctgatttcagtgttgtccgaccgcacacgcacgccattgggccgtcgtaccccgtggatggttggcggaggtctgctgtgcgcgctgatcacgctgattctggggcagaatatcggcatcattgtgctttgtattttctgggtgttcctacagttcgcctatgcgatgctttccgtgccgttgaccagcgccatcagcgaacgggtgcccgacaagttccgccctcgcatcgaacgctggcatggcatcggtgtgatgctcggccaagcgcttggcgtgtgcatgggtgcgcttggtgtgatgttcaattcgtttgcgccgtttagttacaccgccgtgctatttgcagtgtccggtattgccaccgtattgattctgcccaaggagccttctagcgctgagcagccgaaccagctttttgaccgcagtcaggtacttgaccaattgcgcccgccggcccacgctcccgagttctcccgggtgttcgccgcccgtacgtgcatgatggccggtgttgggctgaccggtgtgtttctgtggtatctcgtacgtttctgggtttatggcaaggccgtggtacttacgtccgcgccgctgaccattccggccggattcctcattgccggtatggctgtggccacattgatcggtgccgcgctcgcctcctgggccgccgggccgatttccgagcgaatcgaggaaaagaacattcccgtggcccgtgtggtggccggtgcctgcctgctgtatgccgctggtttggcgctcgcatggggccttggcgtctggtccaccggcactgcccgtgaaaacggcatgctgctgtttgcgttgatttccggattcgcctttggcgtctatgattcgctcggacttgaactggtgatggactctttgcccgacccgcgccgagccggccacgacctcggcatttatgcgctcgccaactcggccggtctggcgctcgccgccatcatcggcgcgctactggtgaacgccttcgagcatagcttcggctattacctgctcttcccgtccgccatcgtcatggtgctgctggccggaatcgtcaccctcaccaccaaatctgccgaataataaaccggttcgagtacactggtcagcagtgatccagtccagtactcgcaggggagcaaaaccatggtcggcatgcgcgacgtagccaaagcggcaggggtgtccttaagcaccgtttcgttggtggtcaacaacaccggctacgtctcggccgatatgcgtgccaaagtcgagtccgcgatgcgccagctcaactacattcccaacgagctggcccgcaacctctaccgaaaccgcaccaacaccatcggcgtgatcatgccgaccatcgcccacccgttcttctccacactcaccgcgcatctgcagcgcgagttcgccgcgcgcgacctcaaaaccctgctctgctccaccgccgatacagacaagggcgagagcgagtacatcgacatgctccagcggcacatgatggacggcatcatcatggcggcccacaccgagcatccggccgactactggacctccatccatcggccaattgtcgctttcgaccgcacgctcggtgagggtgtgccggtcgtccggtctgatcatgaacagggaggccgtctgattgctcgccagctcatcgattccggagcgcgccacgtggtgctcgtcggcggcccgcgctcccagttcgctgcggccaccacgttccccacgattcgctaccatctcaccgtcgagcgtctgctggccgatgccggcattgcctgcgattacgtggaagccggcgccgtggccgacatcgccgcccacgaagccaccgcatgcgccattttcgaacagtatcctgatgtcgacgccatcgtcggctccgatgtggtggcatccgtggcattgcaggaagcctcacgacggggtatcgaggtgcctgctgatctgcaagtcatcgcctatgacggcactctcatggccgaaaccgccggcaaacgcctgaccgcgattcgacaggacttcccggccatcgccgccgcgctcgccgtccgcatggactcacagatcgccgccgacggtggccccgcctctccggccaagaacgatagcgcttcggacgttgacacccaacccactcccgaagaagtcatccccgtagccctcatccccggcgaaaccacccggtgactcctatcttggctcccctctctgaggctgagctgtgaagcaaacagtccggtggactgtttgtaggcgaaggcgagccgggaggcgagcaggcagactgcgggcggtagcccgtctgtaattgcggccgagctggcggcgtaggcgactgaggggagccgagtcacggccgcccacagtcacccatctcacatgactcctacgtcacaatgtccacaatgtgaacccttgctggattggcaagacatacaaacctatgtttacattccagttcaggtcgaacggcctgaggaaataccgaaaggaggccacgcgatgactggattcaatgcttctgcgtttgtatccgcacgaattattagcccgtcttcgctggcggactaattcggcactgatgcttgaagccccgtcaacgaaggcagggccaatcaagctgacacaatcggcacggccctgcatgatgcggggctttttttgttgcgctcacaaggcttacggcagaatcccgcagacggaaacggtagcggacagtacacggcaacaacacagcgacagaacaacaacctccctgtggggcgaaataatcgcccgccgatgagagtgaacgagagcaaaacaggagtaacaatgactgcagcagtcgaagagactggcttagggcaggcggcaggtaaagccgctaccttggtacgcgattcggtcaagaccgtgatcgccgcgtcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccgtcgccttcatcgcccgcccgctgggctcgctgatcttcggccacttcggcgatcgcatgggccgcaagaccacgctggtcgtcagcctgatgaccatgggtgtcggcaccttcctgattggctgcctgcccacctacgatcaggtcggcgttggtgcagtcgccatcctctgcctgctgcgtttcatccagggcatcggcctgggcggcgaatggtccggcgcggcactggtcgccaccgagaacgcgcctgaagacaagcgcgcactgtacggctccttcccggagctcggcgccccgatcggcttcttcctgtccaacggcacctacttcgtgctcgaatccttcaacaatcaggacgcgatgctggcttggggctggcgtgtgccgttcctgctgtccgccatcctggtgatcgtcggtctcgtggtccgcgttcacatggaggagaccccgatcttccgtatggctcaggagcagaagaaggttgtcaagtccccgctgaccgaggtcttccgcaagtcttggcgtcaggtgctgcaggccaccttccttgtggctgtgacctacacgctgttctacacgctcgccacctggtccctcgcttggggcaccaaggagcagggcgaaggcggcggcaaccttggcttcaccaaccaggaatacctgctcatgctcatgatctccatctgcgtgttcgccctgttcatcgtgctgtcctgcctgtacgcggacaagatcggccgccgtcgcgtgctgaccttctcctcctgcgcacttgtggtgttcgccgtactcttcccgttcctgctggacggtggtctggtcggccagaagaacttcttcgccaacatggtgttcctgtgcgtcggctttgccctgatgggcatcgccttcggcccgatcggcgccttcctgcctgagctgttcgacgccaacgtgcgttactccggctccggcatcggctacaacctggccgccatcgtcggcgcggctttcgtgccgaccatcgccacttggctgagctcccactggggcgtccactccgtgggcctctaccttgccgtgatggccgtgtgctgcctcgtctccgtgctcacctgcaaggagactaaggacgttgactttaccaagtgacgatgttcacaacgtgaaaacccctaattccactaagtgaacccctacagggcttttccgatgcgacgggactaaacctgcatatcggaaaagcccacaaggaaagccacaacagaatatcgctcagcgaaaccccgcagaacgcaagaaaaattcaaccccataaataaacaaataaataaaaggagcgccaaaaatggcagcaactatctggtacgagaaggacgccgatctgtccgtgttcgatggcaagaaggtggctatcctgggctacggttctcagggtcacgcccacgcgctgaacctgcgtgactccggtgtcgacgtggtcgtcggcctgcgtcctacctccaagtccgtggagttcgccaaggagcagggccttgaggtcaaaccggttggtgaggccgtcgctgaggctgacgttgtgatgattcttctgcctgaccagtaccaggcagccgtctacaagaaggacgttgagccgaacctgaagccgggcgccgcgctggccttcgcccacggcttcaacatccactacggctacatcaagccgtccgaggatcacccggtgttcatggtcgctccgaagggcccgggccacatcgttcgtcgtgagtacgccgctggccgtggcgtcccggtcgtcgttgccgttgagcaggacccggacggcaagacctggccgctgtgcctggcttacgccaaggctctgggcgctctgcgtgcgggtgccatcaagaccaccttcaccgaggagaccgagaccgatctgttcggtgagcaggacgtcctcatgggtggcatcaaccacctgtgcgacctcggtttcgacgtgctgaccgaggctggctaccagccggagatcgcctacttcgaggtgttccacgagctgaagatgctggtcgacctggctaacgagggtggtctgaacaaggctcgctggtcctgctccgacaccgctcagtacggcgactacacctccacggtcatcaccgaggagaccaagaagcgcatgcagtaccagctcaagcgcattcaggacggctccttcgccaaggagttcatggatgatcaggctgctggcgccccgaagttcaagaagctgcaggaagagtactctcacccgcatctcgagaccgtcggcccgaagctgcgcgccatgttctcctggaacaacgccgaggccaaggacaaggacgaggccgagtccttcaacggcaagatcgctcgtacccaggttcagtgattgccgcccctgaaggggatttaagctagcaaaccgccgttcccgcccatacgggagcggcggttttgtgttgttgcgcgcagcgaatcattctcaataacaactatgcgctgatttcttgcaggcaaacgaacaccgaatatgcaagatcgttgatatctcagcctttccccatatgtgggattgtgcgattctgttcaaaagggtgcagagttgttatcgagaatcgttctctgcacacggctgtccatactccaatagtgacctagctcacgttgtggactccagcggggctgcgacggcgttctcggtaggattgaactcggtttgaaggacacaatcctcgcaaaacaggacttatctgcacaccgtagatacccccggcgcccagcggcgccacaacccactactgaaaaggagtgccaataatggcagcacagatctggtatgagaacgacggtgatctctctgttctcgaaggcaagaaggtcgcaatcatcggctacggttcccagggccacgcccacgcgctgaaccttcgcgattccggtgtcgacgtggtcgtcggcctgcgtccgacctccaagtcggtcgacttcgccaaggagcagggcctcgaggtcaagtccgtggccgaggcttccgccgaggccgacgtgatcatgattctggcccccgaccagtaccagcgcaccatctgggccaacgacatcgagcccaacatcaagccgggtgctgctgttgcgttcgctcatggcttcaacattcattacggctacatcaagccgtctgaggatcacccggtgttcatggttgccccgaagggcccgggccacatcgttcgtcgtgagtacgccgctggccgtggcgtgccggtcgtcgtggccgtcgagcaggatccgcgtggcgacggttgggctctgaccctggcctacgccaaggccctcggtgccctgcgcgccggtgccatcaagaccaccttcaaggaagagaccgagaccgatctcttcggcgagcagaacgtgctcatgggtggcgtgaacaagctcgtcgagatgggcttcgaagtcctgaccgacgccggctaccagccggaaatcgcctacttcgaggtctgccacgagctcaagatgctcgtcgacctgatgaacgagggcggtctgaacaaggctcgttggtcctgctctgacaccgctcagtacggcgactacgtcaacaccgtcatcaacgaggactgccgcaagcgcatggaataccacctgcagcgcatccaggacggctccttcgccaaggagttcatcgacgatcaggatgccggcgccccgcacttcaaggagctgcaggagaagtactccaacgagcgcatcgagaccgtcggcccgaagctgcgcgccatgttctcctggaacaaggatggcgtcaaggatgccgacgaggccaactccttcaccggcaagatcgcccgcgctcaggttcagtgagcccctgtagctcccgctggcgcataagcgcctgaggggagtacccagcacgtaccaaaaggccgccgctccgattcattcggaacggcggccttctagtatggtcccaccatatagtcaaacctccaccacgtagtaaaatccccacgacgtagcaaactacccaccacgtggtgacgcaaaacggctttattccgcggaatacaaaattacgctgacatcgtggtagaagattcatcgcgtggtgggcagttcatcgcgtggtgggatagacagttgatatacgccggctatcaaatcaatgatgtcttgctgtgttccccgtatgccgagctgctttatcggaagcgtttcatgggatattttcccaagaaaatcagcgagatcatggtaggcctcgtcgttgagagacacgcgatcctctggagcaagtagttgagccaaacggaatacatcatatttatgcttcttgagatcttttccgtctacgtgctcgccatgttgttctcgggcgttgagatccaaccatgctttcgccttgaaaggaatgagatatttctcgttaagcacgctgatgccttgtattgattcgcggccttgctgcagtagccgatagtagctgtcgttcagcatgatggctgacaggctggaaacgtcgtttgcaatatgcaatggcgtcaggaacgagttcggcacaatagggaagtcagggtgacgtgaaaatagctcgatcatagtgggatacccgtacgtactggggtgcatgaaacggtacaggtgaggctgtgcggagttcttcgtgatagaggtgtatccgccatcgcgaatgaaagaccacaatcgttgtgcaaactcgcgaagatgtccctcggcaatcagcaccatgtcaatatctttggtggctcggaagtccagttcgttgtcggtcatgatgatgtcacaagcggtgccgccgatgattacgtaagaatcttcgtagccggcaaaggccgttctgatgagctgcaggccttgtgtcatattgtcgctcctgagaaagtattgcggatggattcttgtatggcgtcttccaaacgttcgtcggcaatctcgccaagagtcagggccgtggaaatggggtcggcaaggtagtcttcctgcgtatattgagcaagtaggcggggatcgtacctccacagctccagaatatatgcattatctggcaccttttccaaagcggggtcgataatgcatagttccttgttgtgctgcttgagccaatgacgttcaacggcatagattcgcagttttggggtggccagttgcgtcctgtgcgaaagagcaaattcgccggccggaatcagctcgtcggcaatcatctggcgattgcgattcgtgacggtatatttgctgaatattggtgacttcaggagatgccaagatgatttcagtaaatcaagtcggctggtctgccttgaagtcagtagttcgacgctattgctgcggccttgcttggtgcggtgcacgaatgccagctgttctaacagcgtcacggcaacgctgacctgagcttcggtaaactgaagcgctcgggcaatatctgattggactttgctctcgttggagtagagcaaatacagccagaccagctgtgttgcgggggagaagggtcgcacctcgatatcctgtgcgttctccagcggccgtgaggagatgcgctgggtgaacaccatgcccagtgaagggatatacagttgggtaccgggcacgatgaaaggaacgtgattctgaatcagggcttttcgctggtatgcagaaagccggggaaactgaaagacaatgggcagatccgtccgctgctcaagcctgctggcgtcggcggtgacgcgtgtgatgctgaatgggtgagcctctccgctcgcgattagcatgctcgtgttgtcgatggtgagtttgctgaatgtccgtccgttggtcagaaatagcggcagtgaggcagtgccattccaagaagtgatttggcagggcagaccaagtgtctcgcgaatgtaatgctcggcatccatgtcgacctcaatccttaacgaaaatctgtaagattcacatctcttgttaagtatatagaatattattaagtatttcggggttggcatgtcgcgaatggaaagaaagggcagtcatccccgaaatggagacagcttagccgggaaaaaggacgacgccagcatccggagaagatggatgactggcgtcgggtaagctcgcaaaagctctactgaacaacccacgcagaagtgtcggtggggagctggccttcgggggtcagcgggccggacgccagcaccacggagccatcgggcagcgcgatcggagcattgccgaagttggtgattgaggtgaacacccgcccgccaaccgccgcgcgggtgtacgccaccacatcgtcgcccatatccacctgctcggcggtggtgtcgcgcgtggcggtcagcgactcctgacgaatcgccaacgccgcatgatacaacgtgtacatcgaatccgggtcggcctgctccacgtccaccgcgtaatccttgaaccacagcggctgcggcaggtgcgggtcggcggccggcgtcacgccatcggcgcgaaccgcaggggagaagccgaaggaagcgcccgtgccgaactggccggcggcgcacagcggcacatggttctcgccggtgccatcgtcggccggagccggacggctgaaatcggccagagcgggctcgtcggaagcggtccaaggcagaggcacgcggcaaccgtcacggcccttatccatcgtggcctgagcggtgtggaaagcggtcggatcctccagtcgatcccacggaatatcggccacctcaaacagacccagctcctcgccctgataaatataggcggcgccgggcagaccaagctccatcagcgcggcggcacgggcacggcgggtgccgagctcgcggtcttcgggatatgtggtgccgttgcgcagcagccagtcgtgcggcagctggtggtagggcgcgcccttgacctgcggcagaccgtagcgggaggggctgcgcggcacgtcgtgattgttcatgacccacgtggtggtggagccgccggtttcggccgccgccttaagacccgcggcgatggccttgcggaactcgtcggcataccagttggcctgcgcgaagtcgaagttgaaggactggcccagctcgtccatcgaagcgtacaggtgctggtgctcaggcaccacccacgcctcggccacggcaaagcgcggcgggttgtattcgttgaacaccttgcgccactcgcggtagatgtcgtgcacctcacgacggtcgaacagcgggtggctgaagtcatgattcagcacgccgaccacgctgtattcgcggccgagctcttccaacggcttggattcgagatccttggccaggccgtgcgccacgtcgatgcggaagccgtcggtgccgtggtcggaccagaaacgtagggtcttcttgaactcctcgtggatgtccggattcttccagttgacgtccggctgcgccttatcgaacaggtgcagataccactggccgtcggccacgcgcgcccaggccgggccgccgaagaaggattgccagtcgttgggcggcagttcgccgtgctcgccgcggccgtcgcggaagatgtagcggtcgcgcgccggggagccgggctcggcggcgagggcctcttggaagaacacgtgcttgtcggcggtgtggttgggcacgatgtccacgatcactttgatgccggcctcgtgcgcggcctcggccatcgcgtcgaagtcgtccatggtgcctaggcgcgggtcgacgttgcggtagtcgatcacgtcgtagccgccgtccgccagatccgaggggtagaacggggagagccagatcgcgtcgacgccgaggttcttcaggtaatccatcttctcggtgacgccggcgatgtcgccgagtccgtcgccgttgacgtccttgaagctgcgcgggtagatctggtagacgacggcctgcttccaccagtcgtcattgaggttgttggcggtcatgccgattccttcctgttccgggtgcgttgtggttgggttgttccggttgtgctcgaactgctgtgtgaaggcccaaccgttgtattgatgatgacaacgatatcatgtgaattacgcatgcaaaagtcgatttatcggcgttttgcgatggtaacgtagtcacgcctgcgcggacgctgctgttgcggcaggcggcgcggtggtttcgcgcagtattagcggagtgtccggccgtacgaatgccggttcgattgacttgcccgcaatggcatccaataccatgtgcccggcggccacgcccattgcgaacgggtcctgatgcagtgtggtcagtcccacggcggcggacagggtggaatcgtcgaagccgatgatggagatgtcctgaggtacccgccgcccgtattgacgcaggcgatacagcacgggtgcggccatttcatcatcctcaaaacagaaggcggtgatgctgggggaggcgttcagtacggcgttcaatgccgcgttgctttcgccaagaccgcgttgaatgctcaggggcgttagctcgatccccggatgggcggcagcggcatcaatgacgccctgcaaacgagcctcggcactgtagcgcatgttggtttcggtcggggcgctgccgacgaacgcgatatgccggtggccgagtgcaatcaggtgctcgatggccgaacgtgtggcggcgtaatcgtcaatgctcacgcctgcgtcgaacccatcggtggagggaatgttgatgccgacaatcggcacgtgcatatgcttcagtcgctccacttcagccggctcaatgtcgaaggagctgacaatcaccgcatccgcattgcgtcgcacgggcaaatccgcaaagaagtcatggcgctcggcggcgttgcgcatggggtagggcacagtgtcgtagccggaggggcgcagcgccgagtcaaggccggcgaagatgtttgcattgaaccaggtggtgatggtctcgctggccagcagcgcaatgcggaacgactggccggacttcagtgcggcggccgagcgagagacggagtagtcgagcttttcggccgcggtcatcactcggtctcgagtctctggaagcactagatccggcttggcgaaggttcgggacaccgtggatacggaaacgccggcctcgcgggccactgcctgaatgcttgccttggtcatatgccgtcgctcctttaccgtcgcgaacaatcattgtcatgacaacgataacatgcccataacaagtcgccgtcttcggctatctcgattacgaggggctgatttagggtgtcccggacatctacttccgtttcaaggggctccttgccggtgaaaccacaagtgcaaacgactttgtgccaacgtcattccgccgttctcgcgctgggtctacttgggcaccagccccttgaagcggaagtggatgtccgggaaaggccaaatcagcccctcgaagccgatttagaccaatttcccattgcggaatcgatcaccgcttctctcggcgcatcacggcggctagggactgcacgcgtggcaggtcgaagacctcgtcggtatgtaccacgtggcctgagctgtccgccagcggcacgcgccagttcgaatactctctggaagtgcccggctgattctgggagcggcattcgcccacgccgtccaccagcgctgcctgcagcagcagcgacggcgtatcggtgagcatggcgtgcatcgcttccacgatttcctgcacatggccttccacatcatccgccacggtctgcgagatatagccgttctccaccagacggttcatcatggccgtgcgctcggccatcgccgaggcggcgaatgcctccaccggctcgctcaggagatgcagctcctcgcgcagcttgacgtgtgcgaagttcaggtagccggcggtgggtggcagatcgtgcgtggtcaccgaggccaatgcctgtttgcgatagtccttgggtgcgcggtacgggtcgccggcgttcggcgaatcgtccacgcggttgaaccattccacgtcagtgccgagcacgccgtgatcggccagaatgcggcgcacgtaatccggtacggtgcccagatcctcgccaaccaccatgcctccggcgcgcgtggcctcgatggccagtactcccaacatcgcctcgtggttgtacgtcacgtatgcgccgttgcgggcaccgagcccctgcggaatccaccacaggcggaacaagcccagcacatggtcgatgcgcaccgcgcccgcgtgctcgtacatcgaatgcaccatctcgcggtacacctggtagccggtggcctccaggtagcgcgggttgaacggtggctggccccaatcctggccctgctggttatagaagtccggcgggcagccgaccgtgacgccacctgaggcgaagcgttccggattggcccaggcatccgcgccgagcccgtgcacgcccacggccatgtcctgcatcagccccagcgtcatgccgtggtccagcgcctcctgctgcgcggcgttcacctgctcggcagcgatccactgcagccagcggttgaactcgaacaggtcgtggtgctcctcgacgagctggcgcacggccgggtcgtcgatggtcttctcgaagaaccaacggttctcgccccacggcgcgccccatacctcgaagcacaggcaccatgtggcgaaggaatcgaggtccgggccggcggtggtcttgaaatgctcgaattcgagctcgcgcttgttgttgcggcccgcttcgaagatcaggcgcagcgccgggcgcttggcctcccacgccgcgttgatgtccatcggggtcgattcgtcgttgcgcgcggccaccgaatcatgcagcgcatccacctgcgcgcgcacgtcggccggcagtgtggcatattcggggatatcctgcggccggatgtacgtcacgttgaggaatcggcgcgattccggtagatacggcgatggctcaagcggcggaatcggcgcgccggcgtgaatcggattgatgagcatgaagtcggccttggacttctcggcggcatctgccaaaagacgcttcagatcgccgtaatcgccgatgccccacgattcgcgggaccgcacggaatacatctgcgtcatccagccccaccgctggtgctcggcgaccgcctccggcacgggaatgcgcgcgggggcggcgatgatggccgccttgccctcgcgcccgtcaaccgtgacggtcagcgtgtggtaacccatcggcaggtcgggtgcgatggtcaagtccggcttgccggaattgaggttcggcagcagggcaaagtggccaaacgcggtgccgtcctccagttcgatggaggcggtgatgtccgcgtccgacgagcagttcagggtgatgccggtcggtttgccggtggtggcgacgatggtggaggggagcaaacgtttgctgttttccacctcaagttgggtcatggagcgtacgatggcctcgtcgctggatgcgtccacgtcgagggccttgagtacggcgaccaaggccgcgtcgctgatttcggtgtaggtgccgagctggtcgatgaatgaggtggcaagtccgcaggctttggcgagcttgatgagcgggcgggcgagtcgttccgtgctttccgcgcgctgcggggcaccggaagcggcgtcgttggtggtgtctgcgatggtgccggtgctggtcgctgcgtcgttgctgtacgcgtcggtcatgatgactccttgcttgcaaattgggtactgctagtcgtttgcattgctgttcgagggccgctctgcgttgaggttccggcaatctgacagaccaatgttcgagctgttctgtctttaccgtaactcatattgacaacgattgcaatacattcggtgagttggacgaggctagaggtgttggtgtttgtcgtgatggcccgttgactatccccagtcgactttgccgacagcctcgccggcggaggtgaggtcgaacgggtttaaccaaacacgacgaacgattgcggggagagcgtcagctgcccgccgctcacggccggttcaccaagactgagcagcacgtcggcgtcggaagagagctcgtccggcaggtattccgtgaggaatgaggcgattgaggcacctgaatcggcgttgaaataactggaatcgccttcgtgctccataggcgtgtcggtattgcgcagcaacaggttgtagccgttcgggtggccgtcccggcgccagtcgaggtagaggtccatgtcgaagccggcctgcatcgattcgttcggatggcctggacgccatcggcggaccgacctgggtggattccgataaggcggccgtatgggtgaccaactgggacaccgagcgcaacggctcctcgctcaccacccgtgacggcaccagctacctgctcgccaacgccttcatgctcgcctacgattacggccagccgcacatcttctccggctactactacgccggcgtcgacgacggcgctcccggcgccacccgcacctccgtgccggacatgacctgtccgaccgacggcatcgaaaccgccggcacctggcactgcgcgcaacgctggaccgccatccgcggcatgatcggcttccgcaacgccgtggccggcaccttcaccggcaccgtggccaagggctcggccgtcgccctatacgccggcgcgacgcccgcaaactgggccggcacccggaaatacgatccgtccgatcccgcctggttcaccggcgaaacaccgcataagggcgatgacaccgccgccaagtccgccgattccgcagcgtccgccaagtcaggcgacgccaagtccggaaaggcaacgtccgatgccatccgccgcgccgcaacgctcgccgccatcctcctgcccgtcatcgtcggcgtcacgttcatggcgatagctcgcaggaacggcaaagcccagtccgacaacagcggcccgaataacgactgattcggccccgctcagccgcgcacccgcggcgcggcggtggagtcgcgtaccagcagttgcacggggaagatctcgtgcggctggtccagggtgcgcccctcgataaggtccagggccttgcgcgcggcggcgacggccatgtcgtacggcttctggcgcacggtggtcagccccacctcgcccgagaacgtgctgttgtcgaatccggtgacggacaggtcggtcggaatcgccatgccgcattggcgcaggcggaagaacagcggaatcgccagcgaatcctgatggaagcacagggcagtcggggcgtcgtcgcgcgcgagcagcgcggtgagggcggcgtcgaccggatcgtcgccggcctgcatgtccatcgtctggccggtcacgccgtccagttcgctgcacgcctccaggaatccggtgacgcggttgtgcgagctgaagcccatcgttgcatcgaacgtctcgtacaaatacaacaggttgcggtggccgagcgtggtcagatggcgcacgatcagccggatgccggccttgtcgtcgatgcccacggaggcggtgaacccctgcgaggccgtgttgatgccgatgagcgggatccgcgtggtgttgagtcgcctgatttcggccggggtgatggcgaacgacgagacgatgaccgcgtccgcgttgccgcgcaccggcagttcgtcgaagaactcctcgcgcgcgcccgcgtcgccgatcggttggatgaccagatcgtagccggccgatcgcagcacttcgttgaggccttcgatgatgcgcgaggtgaaccagtcgagcttgctgctgcccaccagcagcgccacgcggtgggagcggcccgatttgaggatgccggccatgcgggataccgagaagtcgagttgttgggcggcctccatcaccttggcgcgcgttttggcggagaccatgtcagggcgggagaacgcgcgggagaccgtggcggtggagacgcctgcttgcctggcgacgtcctcgatgctggctttcatggcccctcccggtttttcaaagttgacggtgtgacaaacttctcttcattgtaaatcattgcagtacgttttacgacagtcatagtgcaatgggttgcgatattgcgacacgccgaaaatatagaccaatatggtctcaatagctttggaatgtaacaggttgcaaatgtaacggtttgcatggctgagaaagccgggttgccgaactagttcgacgcccgtatactgaaccgtgttcacttagagcttgcgaggaagtaagggagataatgaagatcaagaaatctctcgccgcgctgactgcaaccgtgagcattatggcacttgcaaccggttgcagttcgagcggttcgtcaggcgtcgtcgacacccaggccgacaagggcctggccgtcatgggcgacaccatcacctacgaccccaaccacttggtcaacgacggccagcccatcgaactgggctactggtcctggggcgacgaaagcactgacccggtgatctccatgctccacgagtacgagaagatccacccgaacgtcaccttcaagatctcgcaggtggcttggagcgactactgggtcaagaccccgctctcgctcaagggcaacaagaacgcccccgtgctgttcaacgtccacaactccgaggatgccctgctccgcccgcacgccgtccgcctcgacggcgccagcgactggcgcatcttccaccaggtggtgctgccgatgagccgcaattccatcgccgcgctcgccatcttcaccttcctgtggaactgggaggactacctctggccgttcctcatgatcaccgatgacgacaagcagctgttgtcggtgggcctcaagatgttctccggccagtacggcaccgattacggcggactgttcgccgccacctccgtgaccatcatcccggtggtcatcgtctacctggtgttccagaagcagttcatcgccggcatcgccaccggctctggcaagtaaacccggccggtttcggccgaatccgaaccgcgccgcagtctcccaccagtcccggggagccgcggccgcatcactcgtatcatcgtgaataaccgtacagaaggggtaaccatggcacagtcaccacaactcaagcagtcgtctccgacctcgcccgatccgcaggacttccgcctcgacgccacgccggccatgcgcgccgacaatgtggtgtccggcgagcactggcgcatcggactcatcaccgattcgctcgtgcgattcgaatggtccgattccggcgtattcgagaaccgcccgacccagaccgtcctgaaccgcgatttcggtagcccagtcgaacgccgcgtcaccgagcgtgacggccgcgtcatcatcgacaccgcggccctgaccatcgtctacgaccagcagccgttcagcaaggaaggcctgagcgtggtcgtcaaaggcgtggccgacacccagttcaacacctggcattacggcgacgcccagcgcggcaacctcaaaggcaccgcccgcacgctggacgaggcggacggcgccatcgagcttgacaacggcgtgatctcgcgcgatggctgggccgtcatcgacgattccgccgccaacatcatcatcgaaaccgacacggtgaacggcaaggcgaacccgttcggcacctgggtatccccgcgcgccaccgccgaaacggacttgtacttcttcggctatggccaccgctacatcgaggccgtacgcgacttctatcgcctgaccggccccacgccgctcctgccgcgcttcgccatgggcaactggtggagccgctactaccggtacacgcaggacggctatctggccctgatggaccgcttcaagcgcgagggcatcccgttcaccacctccgtgatcgacatggactggcatcgcgtggacgacgtggacccgaagtacggttccggctggaccggctactcgtggaatcgcgaactgttccccgacccgccggccttcctcgccgacctgcaccggcgcggcctgcgcaccacactgaacgtccacccgcgcgacggcgtgcgcgcgttcgaggacgcctaccccgaagtcgccaagcgcgtcggcatcgacccggccaccgaggagaacgtggaattcgacctcaccaacccggacttcgtggacgcctatttcgacatgcaccaccgcatggaggccgaaggtgtcgacttctggtggctggactggcagcagggcggcgtgacccgccagaagggtctcgacccgctgtggatgctcaaccacatgcactacctcgactcagggcgcggtggcaactggccgctcaccttctcccggtacgccggccccggctcccaccgctacccggtcggcttctccggagacacgatcgtgacctgggaatcgctcgccttccagccgcagttcaccgccaccgcttccaacatcgggtatggctggtggagccacgacatcggcggccacatgttcggctaccgcaacgaagagctggaggcccgctggtaccagctcggcgcgttcagcccgatcaaccgactgcattcgtccaactcgccgttctccggcaaggagccgtggaacttcaaccgtgacgtgagcgccgcgatggtggacgcgctgcgtctgcgccacgcgatgatgccgtacttgtacaccatgaactaccgtgccgccgaagccggccgtccgctggtcgagccgatgtactggcagaacccggatacgccggacgcctacgaggtgccggatgagttccgcttcggcaccgagctcgtggtcgcgccgatcgtctccccggacgatgccgccgcctgccgcggccgcgccgacgcctggctgccgcagggggagtggttcgacttcttcgacggccgccgatacgtctcatccgacgccgctggccgccgactggaggtctggcgctcgctcgaccgcacgccggtgttcgccaaggccggcgcgattgtgccgttgcaggacgtcgcggaatccggcgaagcgatcaactctatcgccaacccgcaggccctgcgcgtgctggtgttccctggtgccgacggctcgttcgtcatgcgcgaggatcgcggcacgtggggcgcccccagcgccgacaccgcgatagcgttcacgtggggcggggccgatgcgtcgcccagcgccttcaccgtcgcgccggttaccggcgatacgtccgccgtacccgagttgcgcgactggacggtcgtgttccgcggcgtcgcgccggttgacgcggccagcggcgtgcgtgcatggtccggcgaggctccggtcgaggcgacggtggcgtacgacgaggcgaccatgagcctgaccgtgtccgtcaccggcatcagctcggctgccagtctgcgcatcgagattcccggcggtctgcgcatcgccgacaatccggtcgaatcggacgcgatggacctactgctgcacgcccagatgctctaccgcaccaaggagctcgcgctgcaggcggtccacaagctcggcatcggcgcgatcggcgccctgcgcaccatgaaccgtggtccgcgctacgccaacgatttctggatcaccgacatgcccgatgcggtggccggcgcgctcgaagaaattttgctgcgcagctgagcccggttgcagttttctgcaacatccgggtgcgccccggtatgcggcgataagttcggcatggttgccgaagggcgtggcataccgggtgcagtgcgtgggatggccttcgcgattgcactcatcgtgcggtcagtggaaaggaacttttcatgcacaaggtgaaacagcacaagggcgtcgcggtggccgccgcggtctgcgcggtcgcgatggcggcctcgctcgcgacccacgccggcgcggccggggaccggcgttattgactggctggcgttatcgagtgattggcggtatcaattagccggcgttattgatgagccggtgttgtcgattagccagcgttatcgaccggcactgaagcatgcagtacccactgcctgcgtttctcccgcacatcccaatccccgtgcgcatgcagcacacgctcccgatagtacgcaagcccggaatgccgccccctcaaacgtcgcgtcaccttgacgcggacggtccgtcacatcaatggtgacgcggtcctgagcggcggaaaccagcaccacgtaacgctgcgtcgaatcggcatacctggcgatattgccaaacaattcccgcagaaaatcggcgacaaacactgtgtctgagttattcagcgcatcgatgcccccagcgacaataacgtcgccgacacaccccatgcgccgcaatcgcgcgccgccgctggcaagtctgatggcaaggctgatggcgcgccccagtcaccccttgcagttttctgtataagtggattttggctccaaacgcaccactccgtcatcgccgtcagtcactcccacaaaaaacttgagccaaacatactcaactttttgtgttgaaattgggaatagaacttgccaaatggaagttgagtgatgtaggctcaagtttggaaggtccaagagacgaccaatcggaacttgggcaaagaacgtaagaacaaacgagtaattaaggagcacacattatggcacgtgcagttggtatcgatctgggaaccacgaattcctgcatcgcaactcttgaaggtggcgagcccaccgttatcgtcaacgctgaaggcgcgcgcaccacgccgtctgtggtggccttctccaagtccggcgagatcctcgtcggcgaagtggccaagcgtcaggccgtgaccaacgttgaccgcactatttcttccgtcaagcgccacatgggctccgactggaccgtcgacatcgacggcaagaagtggaccccgcaggagatttccgcgcagatcctgatgaagctgaagagggatgctgaggcctacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctggcctacggccttgagaagggcaaggaagacgagcgcatcctggtcttcgacctcggcggcggcaccttcgatgtctccctgctggagattggcaaggatgacgacggcttctccaccattcaggttcaggccaccaacggcgacaaccacctcggtggtgacgactgggatcagaagatcatcgattggctggtttccgaagtcaagaacaagtacggcgtcgacctgtccaaggacaagatcgcgctgcagcgtctgaaggaagccgctgagcaggcgaagaaggagctctcctcctccacctccaccagcatctccatgcagtacctggccatgacccctgacggcaccccggtgcacctggatgagactctgacccgtgcgcacttcgaggaaatgacctccgacctgctgggtcgctgccgcacgccgttcaacaacgtgctgcacgacgccggcatctccgtgagcgacatcgaccacgtggtgctcgtcggtggttccactcgtatgcccgccgtcaaggaactcgtcaaggagctcaccggtggtaaggaagcgaaccagtccgtgaacccggatgaggttgtggctgtcggtgccgccgtgcagtccggcgtcatcaagggcgaccgtaaggacgtcctgcttatcgacgtgaccccgctgtccctcggtatcgagaccaagggtggcatcatgaccaagctcatcgatcgcaacaccgccatcccgaccaagcgctccgaggtcttctccaccgctgaagacaaccagccgtccgtgctgattcaggtctaccagggtgagcgtgagttcgctcgcgacaacaagccgctgggcaccttcgagctgaccggcatcgctccggctccgcgtggcgtcccgcagatcgaggtcaccttcgacatcgacgccaacggcatcgtgcacgtgtccgctaaggacaagggcaccggcaaggagcagtccatgaccatcaccggtggttccggcctgccgaaggacgagatcgaccgcatggtcaaggaagccgaagctcatgaggctgaggacaagaagcgcaaggaagacgccgagacccgcaaccaggccgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagaccgctcagaccgagctgatgaccgccgcccagaagatcggccaggtcctctacgcccagcagggtgccgagggtgctgccgctggtgctgacggtgccggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccgctcaggcctcttcaggggctgacgcctccgccgagtccggctctgcgcaggattcggctgcccaggctccttccaatgaaggagccgacgcggctcctgccgcagctgagggagagaagactggcgaaggccagtccgattccgcagacaccctcaccccgctcggcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgtcgccaccaagattgacaaggccttcgagaagttcggtgtcgagaagttcggcgaaaagggcgaggacttcgaccccaccaagcatgacgcgatcctgcacaagccggacgcggatgccgaaaaggaaacggttgacaccgtggtcgaggccggctaccgcatcggcgatcgcgtaatccgcgccgcccgagtagtagtagcctccccgcaaaactgacggtcagctcgctgcaatgagttgatatttaccttggctcccctctctgaggggagccaatcataaagacttttctagaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggtgcccgcttcgccggcggttccggcggcttcgatgcttccggtttctccgacatctttggttccatgttcggccagggtgccggcggcaatggctcgcgcatccgcttctccacttcgggcggcggccccaacaacatcaacgacatcttctcgatgttcggcggtgctgcaggtcagggcggccagccgtatggcggctacggccaatcgccgtacggcaatgccgacggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggacagaaaatcaagctggccggcaagggcaagctaggcatcaacggcggcaaggccggtgacctgtacctgcacgtcaccgtcaagcccgatgccacattctcgatgcgcggccatgatatcgtcatggacctgcccgtcaccgtgggccaggccgtggccggtggcaaggtcgaggccaaggatatcgacggcaatcccgttaccttcaaggtgccggcaggctccagctccggcgcggaagtcaagctcactggacttggcgtccagcgcagcaaccagccgggcgatctgatcggccgtgtgcagatcatggtccccgccaagccgggtctggccgtcaagcacgccgccaaagaattcgacgaaaaagccggcgactatctcagcctgtaatcaggaggtgaacaatggcgcggttagccaaccagatgaagcagttatacgcgatgtgcgcaaccgcgctcgtgatgggcagggccgatctcgacggagccgatgacgtcggcttcgacatcgaactgcccatcttcaccgtcggccagaccgccgagttggccaacattcacccccagaccctccgtcagtacgaccgcctcggtttggttcgtccgcagcgcaccgatggcggcgcacgccgctactgcctgcgcgacattgcccgcctgacccgagctcagcgcctgagccaggatgagggcatcaacctttccggtatcgcgcgcattttggtcctcgaagaagagaatcgccaactgcgccgcgaagtcaaacgcatgcaaaccggcgaccaggagagcgttttcgccgcaggccgtgacggcaatatcgtggaggtacaacgctccaaccgcgcccgcctctggcgcaacgccatccgccgcgaaacccgcgaactgcccggccgcgatactgccgccgatatcgctgccggcgccaccggcgactccaactacactcccgccgactccaagtccatggtcctgtggggttggtgagtctggccgcattgcttcgattccttctccattcgtaaaactgtttgttatctcacatcgggcagctgccgaaaagcacgaatcttcttgacggagatgtcaaggtttgttacggtgacgtgcgaaaaccgattcgtaaggggtgctttaggctgagacggtatgtgccgaacccttcgaacctgtgagctaacactcgcgtagggaatgcgacggttgaactcctctgttcggctcggcatcccatatgcgcgttgagagagaggaagcgtatgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcatttggcatggtggacttctctcctgtggcatccaagggatggctgggcctgccgaccttcctgccctacggtccgttcacatttgactggaagatcttcatcccgttcttcatcgcctacatggttgccgtcatggaagctctcggcgtctatcaggcggcttctgagattcagggcacgcccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttccttggcaacaacatcatggtcggtgtattcagcgccatcattctcaatgcgcttttcgtcgctcttccggatttggtggcgaaacatcgtgcgccggcgtccgtggatgttccagcagccgatccggcggatgggactggcgctgcggcgtacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcagagccgtattcatgacgagcggaaccacgcatggcggcaagatgcgtgggcgcaacttccaccccgatcttgaggtgtgggatgaatcaatgattgtgccgttccgtcatttcatcatgccggatcgagagcgtatccgcatcgccgtgatttcgccggcatgggacatgaaccagaactcctccctgtcgcgctaccttaccaaggccgtggagtgctgcggcagcgaaggcagcggtgtgttcttcgacgagcatggactcaagttcgatgaaatcatcgccttccttaaccgtgcggtgtctgacggtgaaccggtgatgctgatgggtgtctcgtcgtcctatctgtatctgctcgattacctgcatgagcatgatctgacgttcgcgctggcccccgatagccggttgttcgacactggcggcttcaagagcactaagcgcgacatcaccgaagaccagatgcttgatgagctggaacagacactgggggtgccgcgccaccactgtgtcaacatgtatggcatgaccgagttgagctcgcagatctatgaccaaaatattctgtcgtggtatacggatggcaccagcaactatctcaaggcgaaccccgcctgggtgcgcacggtcttcctcgatccggaaacgctgactcccgtcaaggatggtgagaccggtgtgatagcccattacgaccttgccaattggaattcatgcatcggtattctgaccgaggatctcggccatcggaccccggacggattcctgctgcagggcagggcgaagggagccgaggctcgtgggtgctcaatcgcggtagacgaggtcatcagtgccaaccgttgatgaatccgtgagtcaggccattgatgtcttccacctgccctcgggagtggatgtttcggattacgaaatctatgaggtcgccacatcggatggggtgaagcgtttgcgctatccgcgactggatggctcaaaggtgacttcccttgccaagcagcttgtcgatgttcgcaaccacacgcttgccgcgatgagtgtcaacgatattctcgacatcgtggccgacgcggcccaactatgggccgatccggattttgagctgcggcgtcaggctgaactgctgattcccgcaatcaccggatatgagcctgacatggtgcggattgagctcaaacggtatatgcgccagttcaggcgtcgtgaactgctccggttccttgactccgaaatcggtcagccgtctatgctcgacgaattccggccgaacaaggcggggggatactctaaatatgtgggcccagcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgcggccgatgccgtgattgtttacggttcttcgcagactaccaaattgattgcgggcaaagtcgccggatccaagccctgtctaggttacggagcaaaagtcgggttggcgttcattggccgagaggctttgcgtcctgatacctatgccgataccgtgcatcgtgtggctgttgacatcgccacatatgaccagcaaagctgcctggctccgcagaccgtgttcgtggagactgatggagccctcacccctcgtgaagtggctcagctgctcggtggcgagcttgagaatcagcagcgcaaatatccgcgctccgtattgagtgacgccgagaacgtggccattcagcgggcgcgcaccgacgctgagatgagagccttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaagactgacttcctgccgtggctggctgcagagctgcggtgtcgctgtggattcaaccagactgtttggtcttgcggatacattggccgaggtcggtgtgaatcgcatctgtccgctcggtgagatggatcgggcgaaatccggctggcatcatgatgggggcttcaacctcatcgatctgttgcgcgcggtggatgtcgaacgcggcagcgacgcgtacagcgattcgttcgatatggatatggaataggcctgtgctgttgcgggcagcagaggctggtagcagggcgaaaggcaagggtaatgacagagcaaagcgatatggcacggcgtccaatggtgaatctggatggcagaacagcgatcatcaccggttccggcaagggcataggagcggctgtggcgaaatgcctggcatcgcacggagccgctgtcgtcatcaattacgtacatgacgccgccagcgcgcagcgcaccgttgaagacatccactcgctgggaggcttggctatagctgtacaggcggatgtttgcgatgaatcgcaatcttccaagctagtgggtaccgctgtcgactcattcggcggcgtggacatcttagtgaataatgctttcggacgcttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgctctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccggacaatgtctgcacgtcgatggtgggctgaccatgcgctgaggcgcaggggcggtgtgctgacgcgctatggttgtcgcatccgattggtgcaatggaatgcagcaagagtaaaggcgccaattggcgtgcgggcatgtggacggaggtaactatgctgctcaaagccgtgttctgggatttggacggtactctcatcgattctgagccgctctggcatgacggtgagattgagatcgcgcacaacaatggcggcgagtggaacgaggacctcggttgggagtgctccggcactccggtaccacacgtggcagaggtcatgattgcgcatggctgcacattgagcgttcccgaaatcgacaagcagctcaaggattatgtgttcaaggcggaggtcgaacgtctgccgtggattcctggtgtattggacgtgctgcactcgctcaaggagaccggcattccgtccatgctggtcaccacgtcgccgcgccgtatggcggagaacatcatgaagcagtccgagggactgttcgccggctacgtctgtggcgacgatccgtacgaacacaagccgaaccccgcgccctatctggccgcagccgacaagcttggcatcgcccgtgaagacatggccaagtgcgtggtgctcgaggattcctcggttggacttcaggccggtgcggcatcgggcgcgactctgatagcgcagactggctggattcgcacggatacttccggcctgggccagttcgcgtccatcgaatcgtatgacggtatcgatgcggccgcgctggacggtttcgtgcgccagcgtttgggggagtagaaataggccgattgtatcggcattgcattccggtgtgtcgcaagtatttgcaatgtttatatcaaccatttgatgtctgttttgacaaactcctgaaacgttatagaattgttgccaacgaagaaatctgaaacgttctagaaaaaccggcgcacagcagcgtcggttgactggttttccgctccggcaaagcatgcccgagtgttttctatggccagtttctgaaatgttacagaaaaagaagatgaggtccaagggaggtcatcatgacggcaattcaggaagccgttcccgccgcagcgggggcagcgcaaagccgtgggggagaggtgagcaacgcggctgcggcagccggcaaacgtgttcgtgcccgcaagcacagcggcgcatcgcagaactcatggcaaagcaagctgcgcccctacctgttcatcgccccgctggtcattctctccggcgtcttcatctactactgcatcggcttcaccgtggccacatccttcaccgactgggacggcatctccagtgagatggacttcatcggactggagaactacaccaagctgctcgctcccggctccgtgttctggacggccttgatgaataacatcatcttcatggtcgtcaccgtggtcatccaggccgggctcggactgctgctcgcggtgatcctcaaggagcgcctgcgcggttccagcttcttcaaggcgatcttcttcatgcccatcgccatggccccggtcatcatcgccgccatcttccgcatcatcatggatccgaacgtcggtgccatcaacgaggccctgcgcttcctgcacttggacttcctggcccaaagctggcttggcgatccgcacatcgccctctactcgatctgtgccatcaacatctttgaatggatgggcttctcgatgatcatctactacgccggtctgatgtctatctccgatgacatctacgaagccgccaagatcgacggctgcggattctggaacaccctcttccgcatcaccattccgaacctgtccggcaccaccaacacgcttatcctgcttggcatcgtcggctcgctgaagaccttcgatatcgtcatccagaccacaggcggcggccctggtcgttccaccgaattcctgaacacctacctgtacaaggccggcgtgcagcagttcaacggcggtctgtccgcggccatcggcgtgatggtcctcatcatcgccgtgatgctctccctgattcaacttgccttcaacaagcgtgccaacaactaacgagaggacgtcatcatgaagcgtaaaaccagtgcgacggtcatcatgtacaccgtcctcgtattcttcttcgtcatctggattttcccgatttacacggcaatcaccaagtccctgcaggcaggcggctggaacagctacctgtccgtgatcaacaataaggacgtgcactacttccgcgtggtgttcaacagctttttcatctccgtggtcaccgccgtgatcgtggtggtcatcacctcgctcgccggctacgcctttgccaagatgaagttcaccggttcccaggtgatctacgtgctgctgctcgcctgcatggccgtgccgattgcctccgtgaccatgccgctgttcttcaccatcaagacattcggcctgaccaacacctacctcggcatgatcatcccgttggtggcgttcaacgccctgcagatgctgttgctctggcgcaactacttcaacggcgtgccagacgaaatcatcgaagccgcccgcgtggacggctgcggttccctgcgtatctgggctcgtatcttgatgcctatctccaccccgatgatcgccaccaccggcgtgctgaccttcgtctactcctggaacgaatacctgattccgttgctgctcatccgcgacgaatccaagtatccggtcacgctggcctccacctacttcatggagacccgcagccagacgccggagatggtggcccaggaatacgccgccctgattctgatgacgattccgtccatcatcgtctacctgatcagccagaagtggctgcagtccggcatcaccgccggcgccgtcaagagctgaggtgacccaaaatgaccgcaaccatcagcaacggtgtatccgccagctacagccctgcggaagacgagctcggcgcagctgaccccaccgccttgcttgccgaatctggcgatttgaagccgctggccgaacgcacttatacgaatccggttccatatgcggacggtaagtcccataccgcgcccgacccgttcgtgctcaaataccgcgacctctactactgctatgccaccgacgagcacggcattctggtctccacctcaccggacatggtgcactggacctcacatggattctgctacaccgaagccggacgcagaaacttctgggccccatcggtgattctcatcaacggcgtctttcacatgtacttctcgaatatgccggccgaggagaccgacacccacacggaaatcatgcgtgtggccgtgagcgaggatccgctcggcccgttcgaaaagaaagcggagctgttcaacaccttcgccatcgactcccaagtggtctatggcgatgacggccagttgtacttgctttacgccgacaatcaggtcaccggcctgagcgatgaccggcccggaacctccgtgatgatcgatcgccttgtgaccccgtattcgcgtgagaacaaaccgcgcccgctcatcgtgcccaccatggacgaggagatctttgcccgcaaccgtttcggcgatggccgcgactggcacaccgtagaaggcgccacatacttcgcctaccgtgaccgcgcgttcatcacctactcggccaacgcctacgagcatgaggactacttcgtcggatactcgtacgcacagctgccgaataagcaggccgacgcccacatcgatcagctcgattggacgaaacagctcaacgagaaccgcttcgatccgctgcttatccgcagcccaaaggttgaaggcacgggccacaactccatagtcaaagcgcccaatgccgttgatgactggattgtctaccacggccgtaacgccgatgacgagctgtatgtgggcgccgaacagcgcgtaatgcgcatcgacccgctgtactacgccgaaggagggctcgacaccccaggacctaccgccgccgctcaaagcgcaccgctgtatggcactgtgcatgatgattttgcggatggcctgaacgccggatggtcggttatttccggcgcggcccacaccgaatccgatgtggacggtcacgcgcttgttgccgacgaatccagtgtattcatcgctgtgtcgggcaaatcgtccgcaacccaagtgattgacgtctgggccaaagctcccgtcaccccactgggcgcacgattcggtgtcgtggtgcggtaccaggatgccaacaacctcaccaaactcgaggtggatgctggccgtcaggtaattagcgtggtcgatgtgatcggcggcgttgcctccgaacgcgtgaccaatgccgacctccatgacttcgattcccatgcctggcatgagtaccggcttgagcgccgctactgcaggctggagatccgcattgatggccgtttcgccgcgtcctgcaccatcagtgataagcccggtcgggcgggattgttctcgttgcgaacgggggccgcgttcagcgcatatgcggccactgaacatgtgaatctgtggggtgccggattgcgggatctcggtcgagaattgcatgctgaccgccgactcgtcatcgacggcggcgtgaggtccagcggcgtgtgcccggtaacactcgaactggcatacccgctggtcagcaaccgtttcgtccttgatttcgctgggcagacgagccgtgggcaggcgctgttgtctcttggcgaataccgtttgtccggcacggcatcatccgtggagttcatgcgcaacggcaagtctctgccttccaccccggagccggccaggctgcgtgtctttgaagacaacgtccgccgtgaccgttcgggccgagccgtgctcaccatccgtatcgaagctctgaacggcacgatgcgactgcacctacgtggcaaaacctggcaggtgccgtttgcggacaatgcggcccgtgcccgtatcactcttgatcgcgcatccctgaccggatacgagaggacatcgctggaatccagcatcgaggaaaggagtgcgtccggcaattgagccaacatcagccgcacatatcgggtgtggctggcttcgccatccaattccgatgatcttccacaacgaagtgaaccaataagagaaacaaggaaaataaggagaacaatcatgttgaacatgaagaaggcgatcgccgcagtgggcgctctcgctatgtctgcaggtctgcttgccggatgcggttcgggcagcggcggctccgatgagggagtcggtaccaaggacagcccggttgagctgaccttctggacctggcagcctaccgatgcccagtggaagtcgatttacgccgccttccagaagaagtacccgaatatcaagatcaactggtggcgtacttctgaaatggccgactaccagaagaagctgcagacctcgatggccggcggcgaaggcccggatgtgttcggtgtgcaggccggttccactgtggaacagtacggccgtttcgccgacgatatgaaggagctggccgacaagtacatgcccggctgggattccaaggtggccgagggcgccgtggcgcagaccaccaacaaggatggcaagatggtggccatgccgaccatcacctccggctccgaatacatcctgtacaacaagacgctgcttgacgagcagggcatcaaggtgcccaccacctacgacgagctcgtggctgccaacaaggaactcaaggccaagggtctgatgccgctggccctcggcgccaaggatggctggcacctcgacgatatcttcgtgtggctgtccaaccagtacggcgaaggtgacgtgtacaaggccgccgaaggcaaggccaagttcactgatgagaccttcgtcaagaccatgaaggcttggaagcagatgatcggtgatggtctgttccaggatggtgcagttggtactgcgacctacccggatgctcgcgacaactacttctacgcccgcaagtccgctttcttcccgaccggctcctggcacgtttccgccgtgctgccgaacgatgagaccaagggcacggccgttgagaaggacgagctaggcatgatggaattcccgcaggtgggagacaaggctaccggcccgaccactggtgtggacttcggcctgagcgtgaacaaggactccaagaagaaggaggccgccatgaagttcatcgagttcatgaccaccggcgaaggccagcaggagtggatcaacacgctgcagggtgctccggtcgacaaggacatgaaggtcgaagtgccgtctgacgccacggaatccgccaaggccagcatcgatttggtgaccaagggccaggcctcttccaagcttgagcgcaagctcacctcccaagaactcaacgacgagatcggtgtgcagatgcagaacatctacaccggcgacgccaccgttgactccgcgctgaaggccattcagcaggtcaacgaatccatcgaaaggtgagcctatagataggaatatcgcatagtttctactcctcgagtgggcccgtccggtacgaattctcgttgtctggcgggccttctttgttggtttgccgaagtggccctgatttattaccgccggcggagtctgttgacggttgcagcgggagtcgtgggcggcgtgtcggacccgtccctgctagcggggctgtcggcaaggccgactgggggtgattctgcggacgcctaagcgaaacggcctgcgggggcgatatcccacatggtttatgctggaaacacacatctgaaacgttcgacaaccaatatggcgacgtggatggtgccatgccgagtggttgatggactgaatataagggggcgctatggttgcgagttcgcgcaaggcgacgctgcacgatgtggcgaaacgtgcgcacgtgtccgtggcatcagtgtccaattacctcaacgattacccctatatgaagccggccacgcgcgaacgtatccagcaggccattgacgagctgggctatgtgaccaaccagcaggctcgcaatttgcgttccggccgcacaggactcatctcattgtctctgccggatttgaaccagatttacttttccgaactggccgaagagatgatcacgcgggcacgggaatatggataccgcatcatcatcgaatcgaccggaaacgaccgccagcgcgagatcgagagcgcacatgccatggccagcaatatgaccgacggacttattttgagccccacggccatgcgggcggaggatgtggccgagctcgagggcgactacccgctggtagtgctgggcgagcgtatcttcaacgcacctgcgccgcacgtggtgatgcccaatgaattgggtgcccaagccgctaccacgcatctgctggaggccggatgccgcaccgtcgccgtggtgggcggaacgttggacgaatccgtgccgtcctctcgttcgatgcgaaccaaggggtatctcagcgcctttgcggaacgtggagtgacgcctgatctgaacctgatccgcgagtgcggcgaatggaccagtgccgagggcgctcaggcggtacgtgagatgtatgcgcagggcattcgaccggatggcatttttgcgctgaatgatttgctggcgatgggtgttatcagtcagctgcgggaaatgcgcgtgcgagtgccggaaagcgtgcgtgtggtgggcttcgatgatatcgatgaggctaagtacacgattccctcgctgaccactgtggatccgcagcgcgcgcgtattgctgagattgccatcacgtcgattcttgatcaggtcaagacgggggctcgggcgccgaggcggcgtattgatgtggagtattcgttgcgttaccgcgcttcctcgccgcaggtgtagcagttgtgttggccggctggtagggtatttgacggtttgcatatgactgtctggttcattgggctggcagctcaatacaagatttaggactcataggaaacacatgggcttcgttaatttcatcatcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgctgttctggttgctgccggtggtttggtgcgcgccgattatcggcgaccagtgcaactacttcatcggtcatttctttggccgccgtattatccaatccggcaaggtgaaggcgctgactcctgagcgactggccaaaaccgagggcatgattgaaaagtggggcccgctggctgtgttcctgggccgcttcttcccgttcattcgtacgttcatgccgttcatttccggtatttccggtatgcgttggagccgtttcacgccgttctcagtgctcggcggcctgtgctggtccacgttgttcacgctgctgggctacttcttcggcaacattccggccgtgcaggatcacttcgaactggtgatcgtgctgattctgctggtttcgctcgccccgaccatcatcggtctgctcaaggccaagttcggcaagaagaagccggccaaggtgaccgatgctcagttggacgtcatggaagacggcatcaagaacctcgataagtaagcaaggaatgtagattaccgcataaggaatcgtcgtgaaaatgaaggccctgactgtgcatatgaggtcagggccttttctgcatgagatgggcgtgaaacagcagcgtggttatccacatttgtcgtggacgacatgccggggtgtggataactcagcaagctagaaccacaatggtcgattcgtgttgagcattgaactcggacacgtttcaatcggcttatgaatagcaacaccacaccccgcgtggcgcgtaggatcacctcgccagcggtagcacctccgggcattccgctgcccacggacgatgcgccgattccagcgcatcgctactacactccgccgcccaggccgttggcctcatgcgaacggcagagatcgggcgaggctccggcgctcgccctaactacagacaccagcttccataacattgtgacgatgacgtcaggtcatggaggcgtggggctgagtgtcatggcttccatgcttgcatggacattggcgagacgtgaacacagctgtgctctcatagacgctgatttcgtggccggatgccttgacctgctgctcggtgtggaacgagagccgggtttacgattcagccaagtcgacgcacccctcggccgcatcgagggcgatgcgatgaaccatgagctgatgatgtgggagggtgtgcgagtacttccctatgacccttggagcgcgcgccagcctgactggtgggaagttcaagcggccattcgagccttggcggaaacgaacgacgttgtcatcgtagatgccggtcagggtggactcattgagaccgtacccgatctgcgcagtggcatgcaggtgattgccgcggaattgtcggtgatggggctggccagagccaagtcgcaccggtccagactggattcatggggctgtgaagcgccacatatcgtcggcgtggaaccacgtggcgctccacgtgggagaggccacgtgggtattggtgaggcgcaggactatttgactgccacggtattggggcctgtcaaaccaagtgtcaatctgtgtggagacgtactggaaggcctcggcatcagatcggtgaccaaaggcagccgcaaagccgtgagcttgcttgccgatcttgtcgagcaggccattcgcccggtttcgggagcttcttgcaaggaccggtgatgcggtatggctgccgtaatcactcgggctgatgagcccggcgcagtgcccagaactgtgttcttcggtctattgaatgatgtggcatccgacccgcaggttaccgatctggcggtgacctgtgatggccgcgtttgggcggaccgcggcaacggcatgcgagaaacagtattgcgtgtgccgtttcgctcgccgcaagtagttcgagaatacgccgtccaactgtgcgcgcagcttgggcgcagactggatgatgcctgcccgatagcggacgccgccagtccagacggcatccgcgtgcatgcggtgattgccccattggtgccacaaggtgccgcaatctccatacggttccctgacaggaccatggcatcgttgcgacatctgagccaattaggtgtattcccggctgcttggctgccgatgttcgtgggactggtgcgcagacatgccacagtgctgattaccggcggaacaggcgtgggcaagaccaccttgctcaaggcgctgctggcgcaatgcgatgtgaacgagcgcatcgtcaccgtagaggaagttcgtgaactgggagaactggggcgtggcgatcatgtgtcgttggtaacgcgcgaggcgaatgtggagggcgtcggagccataagtctgacggacttggtcaaagcgacgttgcgaatgcgccccgaccgcgtggtgctgggcgaatgccgtggcgcggaaatcgtcgacctattgcgcgcgttcaattctggtcatcacggtggcatgaccactgtgcatgcggacggcgtgaaccgagtaccgtccaggctgatttcgcttggattactcgccggagtcagtccacaggcgttggccatgctggcggcaggcgctttcgacgcggtggtgcatttggagcgagtgaacggacagcggcgtatcacgcagatcggcgaactgcgtgtagcacatggtgaactggcaggaacaccgctggcggtatggaatggctgccatcctcctcggtatgccgccgaatgggggcacttcattgaacgatggggcatcgttcccgggccgagtggtggtgggtgatgatgtggtgtgctgttctggtggcgctcgccgtgctgatatggccggggaacaagtccgggaggctgtatcggctggcttaccgcgggcgtgcggtcgattccgcagccataaacgaacctcgatatgccggctcacctcgcgtgggcgttgcgcaggtgattacgtccgccatcgcgcgattgcgaggtggcggcacattggttgaagcattcgaggaacaatccagcagacgcttcgccactcagcgcattactgtggaacggctcataacggtgttcgaacagcggcgtctgcccgacgaatcaccagcgcaggtacttgaagctgcacgcggggtcaccgccgcagcggttttgagcgatgagctcggttgccaagcagtgccatgtctggaagcggtattgactgcttaccggcagatgaggctgatgcagaacctgcgatcgcaagcatgtgccgttcctaaagccactgtggggctgctgagcgcgcttccggccgtcactgtggcattgggcgagcttctgggagctagaccattggcgttcttgcttggatcgccacgcggtgtggtctgcttggtattagggggatgttgttatgctgccggcttggcatggatgcgggcattgttgaaaggcagcggattatgagtacggtgtgggtacacgccgcggcaggctgtgcggcgatcgctagttggctgtataaggctccgtcttgtcatgacagccgcttgccgggcgaggaaccggccgtagcgcatgattgcgggtcgtcatggaccatactcatattgcgtatgtcgcaggtgtccttgcgtcagggctcctcgattccccgggcgcttgacatggtgggcaaagccgtcggcggcgactgcggcgctcgcatgagcgaggtcgggagatccctgaccagaggggttccctgggctgatgcgtggcatgccgctatggctgttcagcatgagggtgcgccagctgatagttcatccggaaaacgtaccagcagaacgcaacgagatcttggcctgctgcaatcggctttggaatcgtcatggacgcatggcgatatgcctggcgtgcgcctcgaatccgccattgaacagctggaccgtgacgagcgtgccgccatcgaacggaatgccgcgaagctgtcggtaaagctactgatgcctacagggctatgttttctgccggcattcgtgctggtaggagtcattccggcgattgcgtccttcatgatgtgaatataggcgtgaactgagtgcgcttagggtgaatcttgttgtatcgctcggtattgcacttggctgcgtttggttatccacattggtggtggacgacacgtcggggtgtggataactcggcaagctagaaccacataccccgtttttcctggtgcatgaagcgttgatagtccacagtggtatgcaccccgcgtcaacccggcgcgggggccaaccactcacacacgcatggggaaggtgcgaagccactgcgcagcttcccctccttaccgaaaggaacgccaatgaatacccctatccccgtcatcgtcgacgggcaggccggcatctttgcgcacagcaaggctcgtgtggccacgctgaacgccaaggcgaaagaacggctatgcctcatggacgcacgcatccgcaccctcatggctgagcccgaagaaggcgcggccactgcggaatacgcagtcgtactcgttgcggctacaggctttgcggcggtgctggtcgccatcctgaagtcggatgccatcaagacgttgctgaccaacatcatcaaacaggctctgaaagtcgggtgacagccatgaagaccatgacatgccggtggcggctcgccagactgccgccagacctatgcacggggtcggccaccgccgaattcgcgatcgtattgcccagcgttatcgccatcgccgggctgatattggcaataggacgtgtggtcatcgtttccatggactgtcaaagtgccgcggcagcggctgcacgcgagtttgtggttaccggtgacgaatcatcctcgcgcagcatagctgcggacgttgccgggggagagcctcgcgtcatcattgcccacgacggccaatcgacgagtgtgatggtcgaatgttcggtattgcctggtccgctggatgtcactccaacgcgggttaccggcaacgctacggcgataagccaataactggtcggctggctgggcggccgcaacagaaaggaactgcggtgcagggaatgcgttatgaggagggatcgggcacgatggccggagccatgctggttatggtggtgggcattgcgctcgcggtggcggcaagtgtgggcaacctcatgatctgccagaaccgagcgcgttccctcgccgaccttatcgcctttgacgccgcgtatgcgctgtggcatgcggatatcggtgatccatgtgcgctcgccgccaacatggctgaagcgaatggtgtagttttgggctcctgctccgtgcgggatgaagacgtgttggtaaccatcaaggtggaaaccatggtcctggtggcatcatccgtggagcggatggctcgggccggaccggtgagttgtacggaaggagacaattatcacaataatggaccgtaaagcaccgatactctggcgggcttctgggcctttggctaaggtgagagcatgagcgagagtgaacgcaacgagcgccgtcgcgtggtggccatggtgggcaaccccacttccgataaaggccgtggcgctaaggtggacgcgcaggtattgggtctgctggaggaagccggccgtgcccataacttcgacgtcatcgacatcaccggcacgagtttcgacgattccctgaaccaggcgcgtgaacgcgcgcacgagtacgactatctcgtagtggtcggtggcgacggcatgatcgcacttggagcgaacgccgtgggctgcagtggcaagccgttgggcatcgtggccacggggtcgggcaacgatttcgcacgaggactgaagctgccggtcaaccgtatcgaaaccgcagtggaaggtatcgtcggtgctatcgtgcgcggatcacacatcgatgtggacatgggacgcgtgacctctttggacggcggctatgccgtggatccctccactggcgaggagtacgagtaccaggagagcaagtccgccgagcatccgattgaccggtactatgcgggcatgctgtcctgtggtcttgacgcgagcatcaacgaccgtgcgaatcattcgcatctgccgaccggcaccatgcgctactttgcggcggtgctggtggagctgacgcatatgaagcgttatggttaccacatcaaagccacattggcggacgggaccacggatgaacgagacatcatcacaccattgctgacgattgcgaattcgaggcatatcggtggcggcattgaggtctcgccgtactcctgcttctccgatggattgttggacctggtgtggatggaccacgtgccgaacttcggcgaatgcgcggtggccatttcgaatgcctataacggcaagctacttgcttcaaaggtgttcggctggaaacgtatccgtgaaatcgaagtcacgcgggcaacggaaggagacgagccgccggtgctgatggcggacggcgaatatatcgggcatttgccatttagggtagtggccgaggactgcgcgttgcgcgtgctagtgccgccggccgtagccgcccgtgaggtggattcccgacaggaagtgctcaacgccattgcccgagatggtcgcgatcccgtgaccggccagttcgcgtgacccgattatattggctcccctcattaggctgagccgtaaagcaaacagcccagtgggctgtttgtaggcgagggttcgacgatagtcgaaccagaagaaagtcagccgtaggctgtccgcaattgcggacgagctggccgcgaagcggactgaggggagtgcgggagagcggtaccagagccaatggccgtcagacctcagacgacatagctttcgatatgcagcgtctgcgccatgacctctttgatggttcggtcgctgatgttcggatgcgagcgaatcagcgagataagccccacaatcagtgtgaagaacgtctcatggacgttggtgattggcaggccatgcatctgctcgaaatcacgtacggtggtctgggcaatgtagtcggcaatacggtccgccgcgcggtcaatgaacttgatatacagttcggcgttgccgtcttggatcatacggtttgagaaggggctctcgtcggcgatcagggagcggagcacatgcacgatgtcgtctaatgccttgttcacgttgcctgtttcgcgcgcttggttccactgcttcaacgtggtgaggatttcgtcgatgacgttatcgagtactgcgtcagctacggcttccttgtcttcgaagtagtggtagaacagcgaacgcgtcataccgacttcgcttgcgatgtcggaaacggtgattttggagaagcctttttccagacacaccttgcgcgcggcttgcacgatggcgtcgcgccgggcatcgccgcgggtggggcgtttctcgtcgagggtatcgctcatgggtgcctcctgaccacaaccgttattgacactatgttaatacaaagaaagcggttaataacaataaaaatgcggtaaccgttgtcaggtgaatgtcgttggaatataaagagttttccgattcggcaactatgagcccggtttatcttgactttttatcggttaattctgagggcaaaggtaggttagtagctatggcacttgcactgtatcgtcgctatcgtccggacaccttcgaaggggtcatcggccaggaccaagtcacggtcccgctgatgcgcgccttggacgagggcaagctcacacatgcctatctgttctcagggccgcgaggctgcggcaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctggtttcgcccctgcgcgcgaccgctataagattttcattctcgatgaggcccacatggtcacgcagcagggcttcaatgcgctgcttaaaatcgttgaagagccgcctgaacatgtgatgttcatcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtccgtgcttgaccagctgatggttggttcggtcgaaggcgttatcacccatgatgccgctgtagccctgctcggcttcacgccggaggcactgatcggtgaggccgtggatgcggtaatcgatcacaacggcgaagccctgtacggcgttatccagaaagtcgtggtcggcggattcgatccgagacgattcgtcgaagacctactggctcgtgtgcgtgatctgctggtgcttacgttggccggggaccgtgcggaatccgtgctgtccgacacggctgaggccgaggatatggacgatctgcaccgccaagccaaggcgctgggactgggcgcactgaccgcaatggcagacatcatcaacactacgttgggtgccatgaccggagccatttctccgcgtatgcgcttggaactgctggccgcgcgattgttggccggcagtgaatcaggctttgcaacagccgctcccgcgccagcttcttctggtatgccgcctgcgtctgcttcttcgacttcgactacgtcagccgcttccggtacgggtgccagtggttttgccggcgcatcgcggggcgggtttgccggagcctcacatggcggattctccggtgctgcacgcaaccagcaagcagccgcgcctcagagcaccgcttcccatgaatctgttggaggcaacggcccggtcagcgaccgacctgcggactctccgtctgtgcaacctgctgtagcaactgctgctgccggtgccgggtggggcgctcccgccgcgtcgccggccgtcccggctcaaccggtgacctcgcctgcggcatcggataatcggtccatcgacgagaagtgggatgcagccgtcgccgctttgccggaaaccattcgtgaatatgtgtcacgagacaaggtgccgaccgtaaaattcggtcccaaccgtaagggtctgccttgcctgtcgatgacgttcgacaagtcgctgagccagcacgctttcgccttggccgtggataacagcggtaagaaggcggcggccgtggtgatggatgccgtgcgcaacgagttcggcgccaatgcggttattgcaccttctgcggtcgcggcgaatggcgagcgagtcgaatccgtcaaacgtatgagcccggagcaattggccaaggtcaagcagcagattgccatggccaaggctggattggccgcgtcgagtttgggcgcgggcctgggcattcatatggggagcgagccgaaagctccgaagccgactgcaacaggccgagccgaggatacggacgacagccatcgagccggccaatccagtgcatccacggcggcgaagaactggagtgacgatgacccttgggccaagccggccgtaagcaacgcttcgccgcaatctgcagacgggttcgcacctaacgagcccgctgctacgcctgcgcccgaagagcatcacaagaagcatgttgcggttccggacatcagtgacggtgttgatccgtgggccgctccggctgctcctgttgcacccactgcgtccgttgcgtccgctggacccactggacagtccactgggcagccagccaccgcatcttccgctacggcagttgccggcgcgagcgacgatccatggaatcagacgcagtctcaggccgcggtctcaccggcgtcgcaaccggccgaagccgacccgtggaaccagccatatcagcagtctcctcacgatgatccgtggaatcaaccgcaggggaaccatgctcaggcggctccgcagccaggagacgacccgtggaatcagcctcagtcccagactccggcttcttcggttcctcagacagtgtcgggcaatatgtcgggcgatgacccgtggaaccagccccaatcggttccgcagccggctgccggcgatgacccgtggaatcaaccgcaggcagttccacaatcggctccgcaggccaccccgcacggtgacccgtggaatcaaccgcaacccgcacagccgaccccgaatgccgacccgtggaatagccagccccagccccagccgaaaccacaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacaacgactgatcgacgctttcgggcggctgcccggcatcgggccgaagggcgcgcagcgtatcgccttctacatgctgtccgcgcccgaagatgaagcgcgcgatttggccgaggccatcgaagaggtcaaggccaagatccgcttctgtgatatttgcggcaacgtgtgcgaatccagcccctgcccggtatgcgccgacccgagacgcgaccgttcggtgatctgcgtggtcgaagagcccaaggatgtgatgagcatcgagcgcacgcgcgaataccacggcctataccatgtgctcggcggcgcaatcaacccaatggccaacgttggccctgccgacctgcgtattcccggtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtatgccgacgaaatcacgctgggcagggcactggccggtcggcgcgaggcctaagccagcgtatcattggcgctttcgcccttgcggcgcatccacggccagaatgcgccgtggcggatgatgcgcgcggccttgtggcgtcgtgccaaccagataatgaacagtcctgccgccagtatgcctagaccaacaccaagggcgatattgcgcgcgtcaagcacgtcattcggctcgggagccggcatcggaatcgccacgcggtgcccggagataagcagtcggtgcgtgttcacgccgtatggcgtacaggtcatcaaggtggcacggtcctcacccggcacaatcttgagcttcgacgtgtcatccggcaaaatcaccgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggatttacctcccaccggcagcgacgtgccgtacaagtggccggcaccagaagccagtgcttcctcggaagtgccgtgataaatcggcagattgatggactgcttgggcaccttgattgtgcccatcacgccgttgccggtattaagcagtgactggtattccttgtctttctttgaggcggaatcctcgccgctggcttgggatcctccttgagcggcggcgaacggatcgacggcttcacccaagataggctggccggattcagcgagcttcttgttgtatgcgcgggccgccgtgagcttgtcttccgcctgcgggtaaggccagccagctacttctttggccgtggtggctgtggtggcggccaagttgcggtcggactcgaattgcaacgctagcgggaagcaggccacggcgattgcggcgatcagcagcacaatggtgatgatgcgcatcgcccacaggttgcgttgcaggcgtcggcgctcggccacgagatcgctgatatcgatgacttcgtcaaatggtgttggaacgaatgctgcgggctcgggccgcgctgaggaaacgttgtcatttgcagatgcgtcatccggcatggccgcgttgttttcccacattttctgtgaggcacgcttactcgtcgaacgtcgatgcagcaatgccatagtcgcctgttccttcgcttgatctgctcatgatttgcttatacaagacggccgggtccgtcttagtcgtgcatggcataggtgctgtcgcaaatggcaacaccgcacgcgccacactgcgaaacgttactccgcaccaagcctttcatgcaacatgccgacggggccatataggggcaatgtagggggcataagaagtctgaaaatgcgatacgaacaacgttgctacggctgtcagtgatgcggcttacttcggacaagccgttgagatgcaaggggatgcaaaggattgcaaagtatggcaacatgataagtcgcagcgtcggcgatatttggcagagctttcaaataggggggtatgaatgcataaagagggaatatgttacctcgataaaagaggcgctattgctgttttcgtggatgtcggttcgtcgtcgagccgttggtttcgtaggcgtgaggggcgttcccgcgtattctgttttccgaccaaagaaatgaatcacgaagaacgcccgagcaaaagctcattcgccggattgccgaacgtcaaaggcgcggttgcagaggatgcgcggatcacggattcgccgctgcgttccgaattggctagtgtgatcagagaaaagatggcactgtctgggcatctctctttttaggtcaaggaaaagggtctggcgataggcggtgatgacgcccatcgtgttggtggcactgttgctgcaaaaaggaaaagtctagttcgtaatctagtgtccaacttccctaataggaatggtccaacttccacaacgaaaatagtccaacttccacaattagaatggtccaacttccgcaatagagtgatttataggttgatgtttcgacggtttgcgggagggcacatatggcagtggagagctcggagattcaacgtggcgagtaccttcctcgagtggctgatgggttgctgactcaggcattgcagtcttctggtgccgttcagattaaaggtccaaaatggtgtggcaagactgcaacggcagaaaggcagtcggcgagtcaggtcttcatgcaggacccggatcgcagtgctacgctgttggccttggctgatacaaagccttctctcatcctgcgaggtgaggagccgagactcattgatgaatggcagatggccccgcaattgtgggacgcggtgcgtttcgccatcgatcgagggcgcggtcgtggccgattcatcctaactggatcggcgactcctcaacaggaaccagctcattccggagtgggaagaattgcccgattaaccatgcgtaccatgtccttatttgaatcgcaggaatcgacgggcgttgtttcgttgggagagttgttcgatggcaaccatgatgtttcgggtttctccgatttcgatattgaaaacaccgcgtttgtgctatgccgcggtggctggcctgaagcagtagtcgaatctcgagtaaatgttgccttgcgcatggccgcggattatgtcgaagaactacttgattctgacatcaatcgtatggatggtataaagcgcaataaaacttggatgcgtctgattatgcgctcgtatgcgcgcaatatttcttctcaggcgtcgcaatccactatcgcggcggatatgcagggtgaaccgccttcggaaggtacactctccgattatttagatgcattgtcgcgagcttgcgtaactgaagatcttccagcttggaaccctcgtttacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgatctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgtgcgtttgacccatcgttcccaacacaaaaggaaaaggcccgggctgcgggaccgggccttgaaaaggagagaggaagaagaaggtattcagttatggggtctgcggaaacctcgccggtttgctttcgtttgccggtaattgatagttaaccgctcgaatctcaaaggatggatgcggctgcctcaaagaaccaccggtgaaaacttgaatatttgctgaacaacgtaggccatgcccgtgtccacatgtcggcgcggggtcgcggggtgaacgcggcaacctttataatcgttgcgtttgcgtagaatattgagcaaactccccctaagagaagaacaaaggacagcagtggctctcatcgtgcagaagtacggcggttcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccatggccattcacgccgaaggcagccgtgcccactccttcaccggtcagcaggccggcttcttcaccgacgcccgttacggcgcggcccacatcaaggccgtgagaccggaccgcgtgaagaacgcgctctcattgggagacatcgccatcgttgccggcttccagggcatcaacgccaagggtgacgccaccacgctcggccgcggtggttcggatacctccgcagtggcgcttgccgtggcgctcggtgccgatatctgcgagatctacactgacgtggacggtatcttcaccgccgacccgcgtatcgtgccttccgcccgccgcattccgtccatcgattacgagtccattctggagatggcgtcctgcggctccaaggtgctggcactgcgctgtgtggaatacgctcagcgtttcaacatgccgctgcacgtgcgttcctcgttctcccgtcgccccggcacattggtggtgcccgacggcattgacccgcgtacgctgccgaacctcgactgagcgcggctacagcgaacgataatcgtaagtaatttcaagcaagacaaggcaagacatgactgaagaagaagcgaaatccatgggcgacctgttccctgacctgggccccgaggcaccggtgatttccggcattgcccacgatcgttccgaggcgctggccaccgtgcgtggcgtgccgaacgagccgggtatggccgccaaggtgttcaccgagctggccaccgccggcgtgaacgtggacatgatcgtgcaggccggcgcatccgtcggcactgcggacatctccttcaccgtgcccgaatcggccgtcaagcaggttcagaacacactgctcgacaagcaggaagtgctgggctaccactccttcgatgtggacaccaacgtgggcaaggtggccgtggtgggcgttggcatgaagacccacgccggtctggccgccaagttcttccaggccctgagcgacgagggcatcaacgtgctgatgatttctacctccgagattcgtatcgccgcgctcgtgccgctcgatcagctcaacgacgccgtcaaggcgctgcacaccgcatacggtctcgatgccgatcaaatcgaagccgtggtgtacggcggtactggccgctgagccactgagccgcgtttttgcggtatatacgacgaaagccctccttgcggagggctttctcagtttcggactcagtttcaactacttcttggtgatgtagccgagagccttgagcatttcggcgcattcaagggcaccgccggctgcaccacgcagggtgttgtgggccagacccacgaacttccaatcgaagatggaatcctcacgcagacggccgatggaaacgcccatgccaccctcgtagtccacgtcgagcttgacctgcgggcggtcatcctcggtgaggtactggatgaagtgcttcggtgcgtgcggcagctccagctcggaagccttggacgtgtagttcaccagacggtcgatgagctcttccttggtggccttcttgccgaagttcaggaacacggtggcggtgtggccgttgagcacgggcacgcggatgcactgggaagtgatcttgaggtcgccgtcgaacggcacgatctcgcccttggcggcgtccacatgaccgaacaccttgagcggttccttctcagacttcgcttcctcaccggagatgaacgggatgatgttgcccaccatctcgggccagtccttgaaggtcttgcccgcgccggaaatcgcctggtaggtgctcacaaccacctcgcgcggctcgaattccttccacgcggccagcgccggcgtgtaggcctgaatcgagcagttcggcttgacggcgataaaaccacgagtggtgcccaggcgcttgcgctggtgctcgatcacctcgaagtgctccgggttgatctccggcaccaccatcggcacgtccggggtccagcggtgggcgctgttgttggagaccaccggggtctcggtcttggcataacgctcttcaatggcgcgaatctggtccttcggcatgtttaccgcagagaacatgaaatcaacgccagaggccacggactcggcatcgtcgccatcgacgaccaccatgttcttggcatattcgggcatcggggtttccatcttccaacggtcgccgacagcctcggcatacgtcttgccggcgctgtgcgcggaagcggcaagcgtgaccacctcgaaccacgggtgattctcaagcagcgtgataaaacgctgaccgaccataccggtggcaccaaggatgccgaccttcattttttcggacatgatgacctctatgacctctgggtttcgatggattacttacgtcggacggccgtcatgcgggtggccgtaaaacaatgcaattgtacgaaacacgcggaacaacggcagtggtcttcccagatggtggctgcccaatgaagcgaaggcgatgttctacactggtagccatgtctatcgcatcagtagaggcccaaaaacagctcgaccgtatcgtggctctcggctacccggatgtggcggatatttccgccgccgcattccgctcgctggcccgacctctgatcggggcgctcgagcattccgatttgggatcgaacatcctgctggtgcccacgcgtgaactggtttcgcctgagtcgctgattgcacgaacctccatcaatcgcatggcaggcttcaccaccatgccgccgcgtgacatcgccagcttcctgcctcaagacggcttcatgccgccggaaggcccgttctatctggtcgtcaatccgcacaccggcacgtgctatgtcaatcgcgagccggatgtggcccgcaaacttattgactccgatgagcgcctgccgctcaccctcgaggaaggcttggccatcgccacccagcacccggagtggctgctggaaaagaacggcttcaatctgctcggctcacgctccgcagacggacgcgtgccgagcatctggatgagccagaacgcaccgcgactgggagccgtctggcccaattcccgccatacttggctgggcaacgcgtattgcacggcccgtcgcggggtgagcctgtttaagtaggtttagcgcgcggccttgatcagcgaacggatgatggctataaagccaaggctcatcgcgccggccaccacggcgaacacctgcgggcggcgcagctcgttgcgtgcgctgaccgctccggtaacgcaatgatcctcgaaccagacgcgcagctcgttgctggagtagcggccgaccagattaccccatgtgagcatgcgggtcacatagcccgccggattgctctcatggaattcaaacaggcgaatgccgcggtaccgcgacttgggaccatagcattcgaacccgcacgtgggtgcatagcccagatcgatatcatgcacatgaccaacgaaagagttcttatggtcatgcccgcagaacagcgcgaaatagccgccagcctcgcgcaaggcatccacctcgcccacattctcgtccgcgcagccgatcgcctcgccgagccgcgagccggggcggcagacctcatggttgagcacatagcaacgcccggcgtgcgtgcgcgcgccttccacggcgttcggcgtccatgcgggcacttccttcagacaatcgtagaattcctgcggcggaatgtgctggaaggcgatggccggcacgggcttgccgtcgccattgcgctcgcccaactcggtttggacggaccccagccattcgatggccttgggggtgggggtgccgtacccgtcggcgtcggccaggtcgagtcctcgcggattgaccacatacgccgggtattgggcgtcgttttcttcgggtttgccggcataatcgcctgaattgaccatcataacggacatggccacgcggccggaaccatcggaggactcgacgggcagcgcgaacgtgccgggctcgagactgtcgtcggggttcaggcagccggggtattcgcggtagatgtcatcctgttcgtcggccagaatgccgcattggaagtcgtggttgccgtaggtggcggcaaagggcacgccggcctcgacgaccggaccaaggaaaccggagaacgtgcggcggaccttttcgcgggtctcaatcatgagttcgtcgagggtcgccggcgtctcgtgtgcggggctggccttgccggattgcgttgaatatacgagggtggaaaccgtctcgggcgtggggctggtctcaacggaatcgcctacttcggaagtcgtgatcacgtcggtcgaatcggcgccggcagcggcgacggcgttcgtcacggtatcggggtcaagcagcgcggctggtacaggcttgccggcttcggtgagacgatcggccacgcgatcggatgttttgcgaattacggggtgacgcttgatcccgcggattttggcctcgatctcggtgaccgcgcgcacgcgagcgcccggctcttcgccgcggcggcgcaggaacgtgtcgatgtaggcgggatcatagccgcggatctggtcgccggtgaacaccacaagatccggatcggcttcgcggatggcctcgcggatgaggcggatggtgtcgggcaacacatcggggccgtcctgtacgtcggccatttgcagcacgcggaagctgccgtcttcgcggaatcgcaagctcgtcatagctcttcagtctatgttgccgggcggcggatcgcccgcgcgttcacaggactggcacagcaagggacggggcagggcggggtgccgcagccgtgttgttgcttgatggtgccgcgattttgtcatgcagcgtcggtggagatccagacagcgtccctatgctgacgttctgagaccattggcgtcgttactgattcatagaatggcccggcgccgacgctcaaagaggctagcgtcggcggtgggccaatatttgtcgcgttgccgatggttgtgggcctcgtagcgtcggtagtgtgccatagcctggcaatttgccgacgataagctttcccagagtcggtatttcgccataagttggtccgctgacgacgctgagccgtttggctgtcggtgcagtaccaatatttggcccgccgccgacgtatggagggccatctggtggggtatcgcaggcggggtgttgtgccggagtcaaagcgtggcccggcgccgacgctgagtgccctcatgtcagccaggtgcataagcaaatgccacgatacggcatttcccgcgggtttgcccgaaccggcctgtaggatgttacgtgcgtattgacaaatccgcgtggcccggcgccgccctggcacaacgccgcagtcgcgtccgcaagagggcccgcgcaataaccagtaaaggaggaacaatgggtcaggatcaatcatccgtttttgatctcgcagcggtagccgcagcgtccaatggggggaacaacgacccgctgctgcctccggcgcgattcattggcgatccgcagaagccgagtcgtatgccgtacaacaagtacgccgcctacgacaagcagatcccgtttgattacccggagcgtacgtggccgggcaagcgactgcagcgcgcgccgcgctggtgctccgtcgatcttcgcgacggcaatcaggccctcgtcaacccgatggattccgagcgcaagctgcgtttctggaacctgctcgtctccatgggattcaaggagatcgaggtgggcttcccgtccgcttccgagaccgatttcgacttcatccgtatgctcatcgagcgtgagctgattccggacgacgtgaccatcgtggtactcacccagtgccgcgagcacctcatccgccgcacttacgaggcgctcaagggtgccaagcgcgccatcgtgcacttctacaactccgtgtctgtgttgcagcgcgaggtcgtgttccgcaagaacaaggaggagatcaagaagctcgccaccgacgccgccgaactgtgcaaggacctcgagaacgaggccaagggcatcgacctgtactacgagtactcgccggaatccttcaccggcaccgagccggagtacgccgtcgaggtgtgcaacgccgtgatcggtgttatcaagccgactcccgagcacccgatgatcatcaacctgcccgccaccgtggaaatgaccacgccgaacgtgttcgccgacgaagtggagtacgtctccacccacctcgacgaccgtgactccgtggtgctctccctccacccgcacaacgacgaaggcatgggcgtggccgccaccgagctggccgtgctggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagattcgcaagacggttgagtactgcaaccagatcaagatttccgagcgtcacccgtacgccggcaacttcgtgttcactgcgttctccggctcgcatcaggacgccatcaagaagggtctcgaggctcgtcaggtggccgccgagcgtgctggcgccgatctcgacagcttcgtgtggcttgtgccgtacctgccgattgacccgaaggacatcggccgcacgtacgaagccatcattcgcgtcaactcgcagtccggcaagggcggcatggcctacctgctcaagaccaaccacaatcttgacctgcccaagcgtctgcagatcgaattcgacaagatcgtgcagaactacgctgacacgaccaagaaggaagtcaaggacgaggatatctggcgtctgttcaaggacgagtacctgccggtcgaacagtccggcatgaccgccgccggtgtggttgtgggcgatactcatgacgcctcgctcgtgccgtggggccgcttgaagctgctcaaggtggccgtcagctccggtgaggatggctccgacaccgtgctcaaggctcgtctgctcgaccgcggcgtgaacgtcggggtcgatgcgcccgtggagcgcgaggtctccggcatcggcaacggtccgatcgccgctttcctcaacgccatttccaactttggcgttgacgcctcgattatggattacgcggagcacaccatgtccgtcggcaccgacgccatggccgcctcgtacgtggaatgccaggtcggcgaggccgatgacgcgcagatcgtgtggggcgtcggcatcgattcgtcgattaccactagcgccctgaagtcgattatctccgccatcaaccgttcccagcgcaagcgctgagcgctaacagaacaaaaacaaggctccctctgattgcatcagagggagccttgttgtctgtgttttacttactactgagtgacgccgttggtgccggtgttcccgccggtgcctccggaattaccattatcgttgccggtattgttcccgttgtcaccgccggtattgttgccggcgttgccatctccgccggtagtggtgccgggataattcgggcactcggtggaatagctcggattggcgaggcactgctgggcgaactcctgagcctgctgttgcttcttggcttcctcttcggccgccttctgctgtgcgtcctgctcagcctgcttctgcgcgtcttcggtggactgcttgttggtgttgttggacaggccgctgctctgtcccttgcccaagccccaagtgccgtcggagccgccgatcttgccgttgtctttagcggtcgggaactgctccgcctcggtgccttgcaaggcctgagccatgaactcctggaacaggtgggcggggtatccagtggaagagacgccgtatccggagaaggctggcaccacttgcggattgcccttatcgtccggattccagatagcccacacattcatcatgctgggggtgtaccccacgaacgacgaagccatttcgtcgttggcggtaccggacttgccggcgacgggccggcccaacatgctggatgtgccggccgccgtaccgtacgtggtggtgccctgcatggccttctgcaccaaagcgcagtcgttggcatcgaacaccttggtgccgttgctgggcgcgttgtacatgtccttattgttggaatcaagcactttggacaccatgtgcaaggtgttcttcacgccattgttggcgatggtcgaatggccttgcgccaaatcccacacggtcagggcgttgatgcccagcacgttgtacatggagttttcatcgatatcgccctgaatgcccgcttcatgggcgattgcggccgtgcgcttcggcgtcagatgctcattgacgttcatgaacaccgtgttcaccgagttggcggtggcctgatacagattgatgttgccccagttgttctccagagcgttgttcacctcttgatccaagccggtgaagtgctggtgggaattgccgttgaacaacgtatcgaagctgacgccggattgcgcggcccccagcaaagcgaacggcttcatagtcgaacccggttcgaatacggcctgatcggcattgttgagctgcttggacagataatctgaaccggcgtatacggacaatacttcaccggtcttcgggtccagcgctatgccgccgatttgcagggattcaggcatgtcgtccagacgggtgtcgccgatggactgcataagatcctgcttgctcttgtcgatggtggtgatgatcttgtatccgccagtatccaaatcctctttggtaaaggccttggactgcaccagctcgcggcgcaccatatccagcagataaccgttcggccccgcgtattcgttctgctgcgccaccgcggcggtctgcgggaacttggcatcagtgtgctgcttggcagtgatgtaaccatcctcctgcatgatgttcagcacacgcttgaagcgcgatttggccatatcggcgttatcggccggatcccacgtggacggtgacggaataatgccggcgatcatcgccgcctcagacagcgtcagatccttggcgtccttattgaagtatgccttggccgctgcctggataccgtaggagttgcggcccagatagatggtgttcatgtaattgcacagcacctcgtccttggattcggtctgcgcgattttgatggccatgatggcctcgcgcgccttgcccacataggatgtggtttcgcccatgtaataccgctcggcatactgctgggtgatggtggaaccaccttggcgcgtgcccttggtcacattattaatgaatgcgcgggcgatgcccttcagatcaaggcctttatccgtgtagaacgtacggttttcggacgccacaatcgcgttgccgatgtagtccggcagcccctcgcaagagatgatttcacgattctgttccgcgtaggagccgatcgcggtggtgccgtccgcgtaatacacggtggttttctcggccaacgcgaacttttcgggttgcgggacctcggtggtggtgtacaggtatgcgaatactgcgataccggccagcaagcccagtccaatcagggagaagaagatgcccagcacccatttcagtacacggtgcttgccttttcctgtgttctttttcttcctgttcggggctcgatggctattggaagccttgtggcttgcgtggcgggaacggctctcctggggcgtataggggccctcctgtgcggagtggccggctctgctttgcgcggtgcgcggttgcctcagagcggggccattgcctcccgaatgtgcacgacgagtataagaagccatggtgtccaccgtaactgttggccttgaacaatcgtttgacgtgagcgtaaccacacgcatttatgccggtattttttccggaattcttacaattgggcacgcttcttgatgttgcatgaatattgcctgaatgcgctggttggcctgtcgtgcgacccggcgcgcacgtttcgtgtcgctgcgctggtccatacgtctccatagacttatccccagcctccacgcggcgctatgtcacccaactcccccagggcaggaatgcagcaagggtaagtggcctctgacgggtgcgtggaggttttctttatgtgcggatttggctgtgagctggcactagcgtggtcccctgtccggggcgcggccgtacagtcgaacgtatgaatgacgcacagacccctagaattcgcgacccgcatgcggcggtcaatctggtcggctcaggcgcagcacagcctgactcgtcgtcgaacgttgttgacccattggctgcgctcggcccggtctccggttcagatgcatcggcatccacatcaggctccttacgggatttcaggccgctggacatggacgatgcggatggggcatctgatatcgaccgcgccttggcccggcttgacccgcttaccgtgcgcccgcgaatctccagccgcgtactgtgcgtggtattcggtctgctcctgatcgctatcggcttcggcgtgtggtgggggtgcgtgtttaccgaaaacggacaatcgtacgacgaactggtctggaaaaacctgcacaacgatgtaccgtcctgggccaccggcgtgatgaacgccgtcgcacaatcctggctggttatcgctgtcagctgcacaattgccgcaatctgtatttcgtcaagtcggtgtttcgtgtttagtcatgtatttttttcgggtttagcgttgttgaccgtcctgtgcgcggtcttcgccgtgtactgcctgttcccgttcgtgtacctgctgatcaacgcgacgaagacacaggccgacttcaccagtacgttcggcctggggttcggcaagacgttcgctttgttcgacaacatcgcgaccgtgttctcctatcaggacgggatcttcgcgcgctggctgttcaacacgatcctgtacgtggtggtcggcgccggcggcgcgaccctcctggcgatcatgggcggctacgctctggccaagttccgcttcccggggcgcaaagcggtgttcgtggtcatcatcggcgcgatcagcgtgccgggcatcgcgttggcggttccccagttcctcctgttcgccaaattgggcctgacgaacaccccgtgggccatgatcatcccgtcgctgatcagcccgttcggtttgtacctgatgtggatcttcagcgagcaggcggttccgacggaattgcttgaagccgcacgagttgatggagcttcggagttccgcacgttcttccaggtgtccctgccgctgttggctccgggcatcgtgacgacggccctgttcacgatcgtggcgacgtggaacaactacttcctgccgttgatcatgctcaaggacgcggactggtacccgctgaccatcggcctgaaccagtggaaggaccaggcctcgaccgcgggcggccaggcgatccagaacctggtgatcacgggctccctgatcacgatcatccccctggtgatcgcgttcctgtgcctgcagaagtactggcagtccggactcgccgcaggcgccgtcaaggagtgaccgtactttggctcccttctggtggagggagccgagataaaggcataaccactaacagaaggaggcacctatgcagatattcgcattgttgagaattgtgcaggtgcctccttgtgtgtctgtgcaacgtgaggaatttattcccgcggacgcagattatcgataaaattcaataaaggagctgaatcatcatggaacgtaaagagttcaagtggccgcagccgcttgcgggcaacaagccccgcatctggtacggcggcgactacaaccccgaccagtggccggaggaagtctgggacgaagacatcgagcttatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcagcttgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgccgtcaacgacgcttggggcaccgcattctgggcgcagcgcatgaacaatttttccgagatcatcccgccgcgcttcatcggcgacggcaacttcatgaacccgggcaagctgcttgactggaagcgcttcagctccgacgccctgctcgacttttacaaggccgagcgcgacgccctgctcgagatcgcccccaagccgcagaccaccaacttcatggtctccgccggcggtgccggcatcgattacgacaagtggggttacgacgtggacttcgtgtccaacgatcactacttcacgcctggcgaagctcacttcgacgagctggcttactcggcctccctatgtgacggcatcgcccgcaagaatccgtggttcctcatggagcactccagctccgccgtcaattggcgcccgatcaactatcgcgtcgagcccggcgaattggtgcgcgactccttggcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtgcgccattggaccgagccgctcgcgtggttccgcgcgctggcggacaacggtctcaccgccgacgtggtgccggttcgcggctcctgggacgagtacgaagccgtcgtgctgccgagcctgaccatcctgtctgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggcgtgcgcgttgaggaattcgccccgatgggaaacgacttccccggtgccatggaccaccttgacttggacaacggaaccgtggcgcacgatttcgccgacgtgatcacttccgtggccgataccgctcacgtggtcgcctccttcaaggcagataagtggaccggtttcgacggcgctcccgccatcaccgtcaacgacttcggcgacggcaaggccgcatacgttggtgcccgtctcggccgtgagggcttggccaagagcctgcccgcgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggtgaaccgttggtcgcctcgctggcccaggtcaacgagtccgagcgcacggccgccatccagcccaacggcgtacttgtcgtcaagctgtaaaaccgcgcatagcgcctaattactcaacggctctcttgctgctcatcgcagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgaccggctcggatacaaagtcaactcgtcggccagaaacctgcgttccgggcgtacccggttgctcaagctggtcattcccgatctgcggcaggtgtatttctccgaactcgccgaggatattctggccgaggcccggcaacatggctacggcgtcatcgtggaatccaccaccaacaatcgtgcccgcgagctggaaagcatcgcatcgatgggcacgcacagcgcggacgggctcatcttaagccctctgatgatgacggttgacgatatcgcggctttggatggcgattacccgctcgtgctgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcggcatcccctgtgatgacagtctgcttatcgaaacccaaggctgggggagcgccgacggtttggtcgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgttatcggcttcgatgacgtggaggaatcggcctacatggtgccgtctctttccaccgttaaccccggcagggaagccatcgcccgactggccgtcgaatccatcatccaacaggtcgaatccggcagtcgcgctcctgcccaaaccatcgaggccccctatagcctctccctgcgcgagtcctcaccggcgttggcctgcgcctgatgaatccatggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcatcgcaatgccgagcggttgcggcgtgacggcttcgggcgcttcggcggtgttggtgcggtacggatcgtcctcatgcaacagttgcgccttgccgagcgcgagcgtgccgagaccgggcaggccgggcagcccggaaaggtcgatggtgagcgtgtgtggggtgttggcgtcgcggttgacggcaagcagcagaccggtgcgggcctgttcatcccacgtgactaccgcgtcgatggccggcacgtcgccgtatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgcggagacttaggccatggctcgtggtgcaaaccctgcgcggcctccgccttccactggtcttcctgctcgttccacttgtccgaataccatacgccccattcgtcgaaggacagggcgatgtctttggtgccgttgttggcttctcgcgcctgatcggccgcgtccgagacggtggcgatgaacttggtcatgtcttcggaagaggccaggaagtcctgcatggaggcggcggcccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggattcggcgagcttcatggcgtgggccaccttgtccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcacggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtggttgcgttgccagttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttagtcaccatggtgcgacgtgtcgtgtttgcgtaaacataaaacatgtggtaccgtttcttaaaacgatacaaggcttggaacaaaacgccaagtcccgtcgtttcccataacaaggaaggaaagaacgatgaagttcggcaagaagacaattgccctgattggtgctgtggccatgctctcctctgtagctgcctgcggttccacttctgccggggatggcggaagcaccggctcctctgataagaaggtcgagctgaccgtgtggtcctgggattccacactgcctcgtacggtcaagggattcgaggccaagaacccgaacattaaggtgaaggtgaccaacgccggcaccaacaaggacgagtacaacgcactgtccaacgccatcgaggcaggctccggtgctccggacatcgcccagatcgaatactacgcactgcccgaatacgtgattcgcggccacctcgagaacctttccgatctcggtgcctccgatttcaaggacttctacaccccgggcacgtggtcctcggtgaacatcaatgacggcgtctacgccctgccgatggattccggcccgatggcctggttctacaacaagggcgtcttcgacaaggccggcgtcgatccgacccaggtgcgcacgtgggacgacttctacgaggctgccaagaagattcgcgccgtggactcctacatcacctccgattccggtgacgccggcttcttcgactccatgacctggctggccggcgcgaccccgttcgagacctccaaggacggcgagaccgtgaccatcaacctgaccggtgacaagaacgtcaagaccttcaccgacttctggcagaagatgatcgacgaagacctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagatggctccgagaccaactccgagaacggtggttcctcgctggccatcgtgaagtccgacgacaaggccaaggtcgccgccgcctacaagttcatggaatacgcctgccacgacgccgagggcattaagacccgtgttgacggcggtgccttcccggccgacaacgacaccctcaagtccaacgacttcctcaatatgacctccctgaccgactccgacggcaaggcccacgagtacttcggcggtcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaggattacgccaagcagcagggctaccaggtgaagtaacggcaatcacagcagacttcctcctgtggtttctgtagcgggaggttgcgataacaggatcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggctggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaatggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccactactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactaccttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagccccgtgacgaatcccgtcacggggcttttaccgttttaagccccgcctagtacactcgtcaccatgcgagtgatcggacagcgaatcaaaagaatggcaaccatagcagtgactgccatcctttccgtatccttggcctcgtgcgggcagtccaccaccgataaccgcacggaaatcagcgtatggagctgggaaccgagcatgggcgaggtcatccgccgtttcgaaaaagccaatccggacatccgcgtgaaatggaccaacatctccggctacggcaatctcaacaccgccattcaggacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctacgggctgcccatggattcgggcccgatgggcttcttctacaacgaagacgtgttccgccaagccggcgtggacgccaccaagatcaagacttgggatgactactatgaggctgccaaaaagctcaaggagattggcgtgtacatcgccgccgactcgggcgatggcagcttttacgatgccatggtctggctcgccggcggccagccgttccacacgtcggccgacggcaaaaccgtgaccatcgatttggatgaggacgccggcacccaacggttcaccgaattctggcagaaaatgatcgatgaggggcttgttgacaccacctccgccacatggtccgaccgatggaagcgccgtgtgggcaccggtaccatcgcctccgtattctccggagcctggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcctatcgtttcgtggactttgtggcgcatgacgcccaaggcattagcgcgcgtgtggatggcggtgctttcccggccgattatgccaccctgaattccgctgattttttggataaaaccacgattaccaatgaccggggcattgaaatcccgtatttcggcgggcagaagttcaaccgtgtactgtcggaggccgccgaggatgtgtcggtcggataccagtatctgccattcgaagtgtatgcgcgcagtgacttcaaatcgacggtgggccaggcatacgagtggtccggcagtttccacgcctatcagcagcgacaggaagccattgagatgggcatgaaggacgaggaaggcaacccgctcgaaccgttggagaagcccggcaagaaagtcagtctctccgacggcctggcccaatggcagaaagacctccgagaatacggcttcaatcagggctttacgattaagtagggattcggggttgggtcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctttgcggaactgacgaatcgtgcgctccacaccgcccaagaacgtgtaatacaaaccggcctgcatgcaggtcttggtgttggtgcccagaatcgtatctggtcgcgtaatttccacttccggcagctgggccgtatctccccacagagcggccgcaccggcacggatgccggtggtgatgacgccggaatcgaccacgcccttgtcgctcacgtgtgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggtatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacgtcgaagacggcgcaaccacagatgcgagccttgcctcgcgcgcaaagaatccgaaaaaaagcggcccgaagtggtggctgatctcactgattgccgtcatcgtggcagtggcggtcgtcatcggcgtcacgctcgctttcggcggtaagaaagatgacaagtcggcttcgtccagcaaccaatatgccgacaccgtgaccatcggcctcaaactggcccccaccaatctggacatccgcaacaccgccggctccgcgcttgaccagatcctgatcggcaacgtatacgaaggcatcgtggcacgtgactccaagaaccaggtcgctcccgccatcgcctccagctgggagacgtccaaggacggcctgacctacaccttccacctcaataagaacatgaccttcttcaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggacgccaagtatgacctgaagacgcaggccgtcggctccggcccctacaccgttgccaagttcgtggaaaacagctcgatcacgctgaaggccaatgagaagtactggggcaagaacaaggccaagacgcccaccgtggtcgtcaagtatctggccgacgacaacgccgcggtcaatgcactgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgccaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccatcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgcgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggttttcgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttggcctgctcatcgccttggccatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgacgtgtttccctcgcaagggttcccgctggatggctggggcgcacccggttcggcgatatcagcgttggtattgccggctgtatcggtcggcatcatcgtgggagcatcgcttatgcgatacacgcgcgcggccttaggggatttagccagttccggctacatcgatatggcatgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgctccaccgcgtgctcgacccgcgtctgaaaaccgctaccgccattacggaggtgaccgcatgagcaatgttcgtcgtgcgacgactggtggtcgacgggctgccttcgtcatcgtcctgcactccatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcgcgcaatgcggcgctcgccagttcttcggtagtggtagttgatgcgttgatttccgttcccaccgtgttgattgcgttgattctggctgtgccgttgggagcgtcaatcgcggtgattgtgatcgcctgcggcttcggatatgggttgaatctggctcgtgtggctcgccccgcagcgttgctggcgtcccgctcgtcatatgtggaatcggccttggccaatggtgccagcgggtggcgtgtgctcataagccatgttatgccgaatattctgccggtattggctgtgcaactgtcattgtcggcgggcacggcggtgttggctgagtcggggctcacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggctgaaaatcacgattggcggcaaaccaatcgtctctgatgcggatatgaccattgccgacggtgaacgagtcggcttgatcggttcttcaggctccggaaaatctatgattgccaaggcgatgctggggttgctgcccctgaccgctgtgactaatgggtcgattgatatgggcggcacggaaattatcggagcttccgaacgtgcgcttgccgacctgcgcggccggtatgtgggtgcggtgttccagaatccggctgcctcgctgaacccggtgatgaccgtggcgcagcagatcgccttgccattgcggttgcactatgatctgaccaaggccgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacacccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcggtggctgaaccgctgagtctgcagcgacgtgatctgaacaacaccgatatcgacgagcgggtggccgcggctctgaccatggcaggccttgaaccggcggacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccgaggccgccggcgacacgcgcttgtcgcgggttgtgctatggtgtgagacatgcagattatctcatgttgttgtcgctaaccgacgcccctgggcgagcggtcagtgacgcataacttgagatagagcattcgaatcgcggcaaatctgtcgcatgaattttcatgaaatcgatggcacgagcgtaaccgtgtaacgcgcgagtcgtggttaacatgaaaaactgattcacttttcggattcaccgtacagtgagcgggaatactcgattttcaaaccaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacatcccgcaggcggccggcgtcaaagccaccatcgccgtcaaagtcgaatacttcaaccccggcggctcctccaaggaccgcattgccgaacgcatcatcgacgccgccgaacagtccggccagctgaagcccggcggcgtgatcgtcgagcccacctcgggcaacaccggcgtcggcctggccctggtcgcccagcagcgcggctaccgcacgattttcaccctgccggacaaggtttccgaatccaagcgcgcggtgctgcgcgcctacggtgccgaagtcatcgtcacaccgaccgacgccggcccggacgacccgcgctcctactaccaggtcgccgaacgactggccaacacgattcccggcggcttccgcccgaaccagtacgacaacccgaacggcccgctgagccactactacaccaccggccccgagatctgggaggctacggaccacaaggtcacgcacttcgtggccggcattggcaccggcggcaccatctccggcaccggcaagtacctcaaggaagcctccaacggcgcggtcaaggtcatcggctccgacccggaaggctccatctactccgcttcctcacgcgacgaagtccaccagtacgacatcgagggcgcgggggaggacttctaccccaaggctttcgaccggaacatcaccgacgacatcgtgcgcgtatccgacgccgaagcctttgaaatgacccgccgtctggccggcgaggaggcgttgctggtcggcggctcgtccggcatggccgtggccagcgccatcaagtacgcgcttgccaatgatttggacgagaaccagattgtggtggtgctcgcccctgattccggccgcagttatctggagaagatcttcaatgacgactggatgcgtgccaacggctacggcgacatcgtggaacgcaccagcaagccctccctcgccgagcagtaccttaacggaactccctctgatgagggagctggggacggactccataactagctatcaaaagaatcaataccaacatccgcgctaactaaccgcacctgttttaccttcgaatacggaacaatcccgaaaggaacccaatatcatgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggtggcacctaccgcctgctctccaaggtgttcgtgccgtggggtgtgggcctcgacgtggtggacatcaccgatctgaaagccgtggaaaccgcattggcctccaagcactaccagtatgtgtgggtcgagaccccgtccaacccgctgctcaacatcaccgacatcgcggccaccaccgaagttgcccacaagtacggcaccaaggtcgcggtcgacaacacctttgcctcgcccgcccttcagcacccgctggccgatggcgccgatgtggtggtctactccaccaccaagtacatcggcggccactccgacgtggtcggcggtgccgtggtggtcaacgacgaggagacccgtgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggtgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaatctggtgcgtatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaagggtcggggattttccgttatcgattaaacatggatcgaatcagctggcgttgccgccctgccatccggtggcatccgcaccagccgggcgcaacgcctgaccggaagtcggtgtggtgccatcaacgaccacacgagtgccgatggtggcaaagtcgtacatccacttggcgtcggccacctgcatgttgatgcagccgtgcgagcctgggataccctgctgcacatagatggggtgctcgccccacatgtatgcaggaacaccgtgcagggcctcgccgccgttatagtaggaaatccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggtgccctgatatgcagtggcagtctggttcgtcagatcaacatgaacccacttatcgccatttgccgtatcgaagttatgaggcacctcgacctgcttgacatcatacgggctgtctttcacagccacagtggaatcagtggactggttctgctcgatggcggtagccagacgttcgggggcgtccccggcgccagtcacttcaataccatccacgccgagtgtcttatcggcaccaatttccacgccgccttcgtctttcggcgtgatgtagacctcgcgtgtcaccttgggaacagccagttctttggttacgctgtcactggtgacgtacttggtgatggcatcgcggtcgactaccagactcatggtgccttccgccttattcaccgtgggcttgaggaatgaggcaatggtatcggccgggatggtgacgctcttgttcacgccgttgtctacggtcagtttgaggccaagcctggcattggcgtcaaactgtgtttgctgtgcgctcgcgtcatcaatcggattctttgcggtctgtagcttgaccggcaccgtcgcattttcgcccggggtcgcgacggcctccttgactgcagcattgacaacattggtatccgggcccttgccgtcctgacccgcggtgtagtcgaactgtttggtgctcttgttgtagacaacggtggcaatctgcgctcggtcggcctcatcgaccaggccggcggtgacgaattgttcggcagtctctttgtccgtggtggcggtcagagcgatatgcggctgatcgaaaatattgagcttggccacgtcgccggtcttcgcgttcaacagcgcatccacggttttatccgtgtcgacggtgacgccaaggtccttcagcgaggctttgacgctgttgccttcggcggtgaacgtcaccgtggtgttattcagccgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccataacatgttcacccacataggctgtattatcggcatggttattggtgccattgtcactttgctgtggtgtggcggtacctgaatccgcggctgcgaacagcccatcggtggccacaggctgcagcaccgccgtctcctgatcgtcaggagaggagaaggaaaatgtatcgttggccatcaaaatgccccgtcttagttctctcaaagcggcatatcgtgcgatatgccgggaataacgttccttgacgcataataatacggaagggctacgtacatcgttgcgaggtattccgttatacgatgagatccagccgcggtcggcctacactggtcatttatgacagcacatcaggcggcgctggaggcgctcacacgatacttcggctatgactcgtttagacccggacagcaaggaattgtcgaggctttgcttgccggacgcgatgtcttgggcgtgatgcccaccggcgcaggcaagtccgtgtgctaccagattcccgccgcgctcagcccgggtgtgactttggtcatatctcccttgatttccctgatgcgcgaccaggtcgatgcgctgaacgacctcggtctgccggccgcgttcatcaacaccactcaaactcccgacgagcaggcgatggtgttcgcccaagccgccgccgggcagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgccgggacatcgtgggactgctgggattgcggaatccggccgtcaccgtcaccggattcgaccggccgaacctgtattttgatgtggtcaaactggagaccaaatacaaggccgcatgggtggcgcggtatgtggccgaccatccggacgaatccggcatcgtctactgcgccacccgcaagaccaccgaagcgctcgccgacacgctgaaccagatggggcatccggctgtcgcctaccatggcggcatgtcgccggacgcgcgtgaggtggcccagcgcgacttcatcaccgacaaggtgccggtggtcgtagccaccaacgccttcggcatgggcatcgataagtccaacgtgcgttacgtcatccaccacaatctacccgaatccattgaagcctactatcaggaggccggccgcgcgggccgtgacggcgagcccagccgatgcacgctgctgtggaatgagtcagacatcgtcacccggcgtcggttgctggataacgattatgagaacgagcgattgactcccgaagagcaggagatcgttcgccagtccaagcgccggctgctggacggtatggtcggctactgccgcaccaccgactgcctgcaccggtatatgacccggtatttcggtcaggaattgtcgccgaatgctggttccgcggcgggtgaagacattgcggcggactcttcgcagtccggcagatgcggtgcctgctcgaactgcgaaagcacgttcgagaccatcgacgtgacccgcgtggcgcaggcgatcagccgttgcgtgcatgacgtggggcagcgcgtcggttccggcaagatcgtcaagatcctgcgcggttcgcgggcacaggatctggcatggctgaacccggagcggatgcccaccttcggcatgctcaaggacgtgaacgaagctcgcgtgcgcgacgtgttgagccagatggccacggacgggtacctgtcaatcgccgaagggcgtatgccaatcgtcatgttcggtgcgcgggcggccgaaaccgccgctcccgacttccactatgagatcaaacgggtggaacgcaagtcggcggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaacgcgcaatttctggcggtcaacggcgtcggtcaacacaagctcgacctctacggccagcgcttcatgcaaaccatcgcctcgttcaatgccgggagtgcgtcataacaatctcctatagcgaaccgcggagtatttgcgggcgttcttgggctggcgcgactacgatgactgttcgatacttcatgaccgaacactcagtaagtagaaaggcaacagcatggcagaagacaaggccgaaaagcccgtcgtcgaatcattccagcttgatcacaccaaggtcaaggcgccgtacgtgcgttacatcgacaccgaaacgggccctcacggcgacgtgatctccaattacgatctgcgcctgacccagccgaacgagcaggccatccccaccggcggcctgcacaccatcgaacacaccatcgccgtgctgctgcgtgaacgcattcccggctacatcgactgctcgccgttcggctgccgcaccggcttccacctgctgacctggggcacccaccccaccgaggaagtggccaaggccctgaaggaatcgttggagttcatcgcgtacaaggccacgtgggatgacgtgcccgccaccaccgagaagagctgcggcaactatcgcgaccacagcctgttcaccgccaaggaatgggccaagcagatccttgaggaaggcatcagctccgacccgttcgagcgcaaggtcgtctgattcgtctgattcgatccaattctgattcggctcccgctggcgggagccgggggcgaagccgactgagggtggctgtcctcaactcggctggactgtccggctcctgcggacgggagtcattgtttattagtgtccgtcatgcaacgcggaggggatttcttgtgcctacggcatggtaggttggccgtcagttagtcgccggtcaccgtgccggcaacccggcatgtcggagaggtgagaagtgactcagtcgaacgctgcaaacaaggcgacaggccgccgtttccgccacgccaccatgcgcgatctgccgcagatgcagaaaatctacgcacgcgcacgcgcgttgatggccgccaacggcaaccccacccagtggggcaacgaatttccgcgtgaatcggtgattgaggacgacatcgccaaccagcgtacgatgctgctggtcgacacctgcaatggccacgaacgcattctggcccagttcgccctgtgcccgggcgaggatccgacctacgccaaaatcgacggcgcctggctggacaacgacgcctatgtgaccatccaccgcatcgccgcatccggtctggtgcgccacgcggcccgcgactgtatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgtcgccagcgtgttcggttccgcggtggagctggtcaggtaaggtccacgtcgtcgcgcacgtacggtccgtcggccgcccgttcaaactcgtgcatatcgcaaaaaccgtacgctgaaagtaactcagcgtacggttttcacgaaagcagccatcggctatcggtcagccgatagacctcagtcctcagtcgcagcgaccttggtgtcagccccggccttctgctcaaggccgagcttggagcgcttgcggctgtagccgaagtacacgatcaggcccagaccgaaccagatggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtgcggtacttctcgtgcacgtggccgaagaacttcgggaacaggccgtcacggctcatggcgtagcagatacgggactggccgtacagctgtacgagcatcaccgtggtcatgccgatgagggcgcctaggttcacgatcaccgcgagccagttcatgccggtctccagaatcacgccggccaccggggcgtcgatgtacttggcgaactccttgtagggcaccacgccggtcatgatcagggtcatgatgacgtagagcacggtggaaacggccagggacagcagaatgccgcgcggcagcgtcttgttcgggttgatggtctcctcagcggaagaggacacggcatcgaagccgatgaagctgaagaacacgatggaagcggccggcacgatgccgtacggctgggtggagccgggctggaaagtgtagatgccgtacggggagaacggctgccagttggacggcttgacataccacacggcgcacacgatgaacagcacgatgatggcgagcttgatgagcaccatcacgtcattggtgcgcttggtctggttgatgccgatggagagcacccacgtgatgatgagcacgatgacgaaaccgggcaggttgaagtaggtggtgacgtccgggttggtgccgtaggcggcggtcagctcgaccggcaggtgcaggccgaagccttccagcagtttgttgaagtagcccgaccagccggcggacactgtggccgcctgcagggcgtactccagaatcagatcccagccgatcacgaaggcgatgagctcgccgaacgccagataggcataggagtaggccgagccggacaccggggccatggcggcgaactcggcgtagcacagaccggcaaaaccgcagcagacggcggccagcaggaacgatacggacagggccgggccggcggtcagcgcgcccttgccagtgagcacgaagataccggtgccgatgatcgcgccgatgccgagcatcgtcagatcgaaggtgcgcatcgtgcgcttgaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcggcttccgagaaaccgcatatcggtcattagtgtacgactgccgggcgaaaacagacgattgcgactacacgtcacattctcgcgcaacaataggtgtctatgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgcactggccgcgctcgccggcggcgccacatggctcggcaccgcgcaatcgcatgaagcactgctgctgcgcaaactcggcatcggccccgaccgctgccatattttgacttgggtatacaacggcaccgaagtcccgttcgacgagctgatcgccgccgacatcgacgtatcggtcggctccctgcccggcatcgacgcggtggccgccgccgcacgcaagctcggcaagcccgcccgcgtacacgtcaaggtcgattccggcttcggtcgcaacggtttcacgccggccggattcgacgccgcgctcgccaaactcgtgccgctcgccaaagagggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaagctcgaccccgccacgctgctataaggtgcattaccgccatacggtggcaccccgtaatcccttcttcccgaatatgtgccactgacatgtgctgagcgtcacatattcgggaaatcggccccaatctcccgaatatgtgctgttgagttgacgtcagtggcacatattcgggaagtcgggattactgcggccgatatgtgtgcctatgcttggaatatggaaacgactttggatggggaacaggtgctgagcgatgagggctacagcgccttcgacgaggagcgatgggcacccgagccgcccaaatccaagtcgcgcacggctttcgaacgcgatcgcgcgcgactgattcattcgtccgctttgcggcgtttgggcgcgaaaagccagattctgattgccggtaccgacgatttcgcccgcactcgactgacgcatacgctggaagtcgcccagatcggtcgccaaatcggcgcattgctcggctgtgatccggacgtggtcgactgcgcctgtctggcccacgaccttggtcacccgccgttcgggcacaacggggagcgtgcgctcgccgacatcgccagcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccgacacccgaagggggagcggtcgaagaaattctgcgtctacccggatgacgaaccggtgttccgctggctcaaaatcggcgcgccccaggccgccaaacccatggaatgccagatcatggacctttcggacgatatcgcctactccgtgcatgacgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcacagcttaagaacattacgtccgatttgatcggccgcttctgctggtcggtggaaaccgccacgcgcgacacgtatgggcccgggccgttgacccggtattcctcgaacatcgtgattcccgagaacacgaattacgagatcgtggcactgaagggcatcgccgtgtacttcgtcatggcgcctcgcgagcgcgagccattccatcaggaggagctcaagatcgtatcggatttggtcgatgtgcttatggctgattcgccgctcccatccgacgctttggaaagccagttcctggccgattggaacgaatccaccaacgacgacgaacgcctgcgcgtcgccatcgatcaggtcgcgagcctgaccgacaactccgccctggccctgcactccatcttgtgctgagggcgtgttgggcgggcgcttcccttagtctcgctgcgcgagccagctcccctcgggtgaggggagctgtcgctgtagacgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgtccctcgctcggcgtgtggcactgcttcggctgcggcttgggtggcgacgtattcaaatacgtcgaacaatccgaaaacatcgacttccgcgaagccgtggaactgctcgccgacaagtaccatatcgagctgcactacgagaacagcggcaacggcccggcgcgcgagaacaccggctccaagcgcacgcgactgctggaagcctgcgaggaagcccagcgcttcttcgtctcccagatcttgaccaaggaagcactgcccgcccgcaagctgcttggcggccgcaacttctcccaagctgattgcgaacgtttcggctgcggctacgcgccgcaaggctgggataatctcgtgcgccacttggcctccaagggatttacgcagaaggaaatcctcgacgcgggcttggcccgtcaaggccagcgcggcatctatgactatttccgcggccgagtgacctggcccatccgcgattcgaccggccgcacgctcggcttcggcgcgcgcaagctgtatgaggacgaccagatcgccgccaaatacatcaacacgccggatacgcagctctaccgcaaaacccaggtgctttacggcatcgatttggccaaatccgccatcgtcaagaagcggcaggtggtgatcgtcgaaggctatacggacgtgatggccatgcacttggccggcatcgacaccgccatcgccacgtgcggcacggcgttcggcgccgagcacgccaagattgtgcgccgcctgatcgccgacgattcgctgggcgcggtccagctggtcgggccgttgaaggtcaaggaccagccgttgagctcgcgcatcgtgttcacgttcgatggtgacgccgccggccagaaagccgcgctgcatgccttcggccttgattcggccttcctctcccaaaccttcgtggccgtggccgacgacaatctcgacccgtgcgacctgcgcatcgagcgaggcaacgaagcagtgcgttcgctgatcgcccgcgccaaaccgttgtatgacttcgtgatcgacgccgccatcagccggttcgacctgacctacacgcccggccaagtgggtgcgatgaaagccgtggccccgctggtggcgcagattcgcgaccgctccctatgggacgcttacgcgcgcaagtccgcgggccgtatcggcgtggatcttgaggtgatgcgccgcgaggtgatgaacgcgcgccggcagatgcatgtacgcgatgaggacgcctacgcgcccaaacgtcgattcgagcgtgacgagccgcgtgtggaacccggcaccaacccatacgccaatccggccacgcgcaaggcgttggagcgccgtgacgccgccgaacaggtatatttcaagatcgacgacgccgtattcatcgccgaacagcagttcatggccgtgctgattcaggtgccgcgcgccatcgaccgcaccatgttcgggcagctgaccatcgaccatttcatgacttcggtgttccgcaccctgttccaggcgatcgcggccgccggcggactgccatccgacgataccccgcaggggctgtggatgcacaacctcactaaggccggcggaccgatgctgaatcaggtgatcaacgagctggccgtcatgccgttgccactgcctggcgacgacggtggtaatggcgcacaacctccgcagtcgaacgtgcctgggggagtcggcggtggtgcggccgccgtgcagctacgccctgccacgccggaagagcagcgctatgccaccgaactgctcacccgattgttggacatgggcttcatgcgccagatcggtttggccaaacgccgcatggcccagctgcccgacggcgaagagaagataaccctcctcggccagatcacccgcatggaaaccgcccgtaaagacctccaagcccaaatctacggcaacaccgttggctagtaatctctccctctgacgagggaggttactggccgcagtcgggcggggcgagagaagcgacgtcagatatatcgcgcagcatcgatgtcacatcaactattcgtttgatatcaactttttaatgacaaacgataaattatggtataatgcaagtatgagttgcttggtttgcgcaatgaagcggaggctcaatcatggcaacgacaaagaaactatccttcggtttggataaggccggtggcgcggccttgatcctggcccgcatcggtgccgcgctcctatggatcatcgcagcgctcgcggccgtggtgtgggtggtattcctcatttccccgcgctcgttcgccgcgaacttcggcagtgtcgacctgaatgtcggcggcgcgttcaccctcagcatcaagggcgacttgttggactactcctataatctgcagaacttccacgacggtcccgtcaacatggtagctaccatctccaccggtctggcgagaatggtggtctacgctctactggccttggcgttctccgaaatggccgcactgtgcaaggatttgacggtgtggcttgcagacggcagggatgccacgcctttccaaggcatggtgtccgaccggttgaacagggctggctggtatctgattgtcgcgccgattgtgggtctggtgaacttcatcgtatgtttcctggctggcacgggcggcaactggggcttatggatgagcggcatgatggtgatgattggcattatcctgttgctgattgcgcgcatcttcgattatggcatgggtctgcaacgggaagtcgacggtctgctgtgagggggaagagcgccgtaggcccgcgtggcgccggtccgaacagggccggtccgaacaccgagggcccgaatgaggacagcctgaacatcgttgattcgagcgagaccggcctgaatacggctgactcaaactccaccggtccggccggcataggccatatcgtcctgcgcctcgaccgcatcatggtcgagcgaggccgctcactcaactggctggccgatcaggtgggcatcaccaacgtgaacctttccaaaatcaaaaacaatcgcgtttccgccatccgcttttccgccctcgccgccatctgtgcggcattggattgccagcccggcgacattcttgaatatgtggatggcatttcgggcgatgcggacgatgcgaatagcaagtaatcgcacgcatgccaactcttctcctcctggcctgtgattgattgacaatcagggattacatgccaaatgggagagataaacatgtggaggttggattggatgggtgcagaagttgcgaattggccccatccaaattggactggtttgggtggggccaatccactccgttcaataatgaagcgcgataccaagcagcgtcgaacgaagggaaactcatgacgcagaatcgtgcggaactcaaccgtaatttggcccagatgctcaagggcggcgtgatcatggacgtcaccacgcccgagcaggcgaagatcgctcaggacgctggtgcctgcgcggtgatggcgctcgagcgcatccccgccgacatccgtgccgccggcggcgtttcccgcatgagcgacccggccatgatcaagggcatccaggaagccgtgtccattccggttatggccaaggtgcgtatcggacacatcgccgaggcccgcattctgcaggccatcgaaatcgattacatcgacgaatccgaggtgctttccccggccgacgacgtgtaccacatcgacaagaaccagttcgatgtgccgtttgtgtgcggtgcgaagaacctgggcgaggcgctgcgccgcatcgccgagggtgcagccatgattcgcaccaagggcgagcccggcaccggcgacgtgattcaggccgtgcgccacatgcgcaccatgaacaagcagatccgcgaacttgtcggcctgcgcgacgacgaggtctacgaggccgccaagcagctggccgtgccctacgatctggccaagtacgtgcacgacaacggccgtctgcccgtcgtgaacttcgccgccggtggtgtggccaccccggccgacgccgccctgatgatggaactcggtgccgaaggcgtgttcgtgggctccggtatcttcaagtccggcgatccggccaagcgcgccgccgccatcgtcaaggccaccgccaactggcaggacgccgatctgctcgccaagctgtccgaaaacctaggcgaagccatggtcggtatcaacgaggacgagattcagaccatcatggccgctcgcggagagtgacgggagtcgaagccggagaggacaacatggttgtagctgttgaatacatttccaaagaagaatccgcagacgccgaaaccgccacgcacggcgtgaccggtattctggccgtgcagggcgcgttcgccgaacatgcggcggtgctcgacaaactcggcgccccgtggaagctgttgcgcgcggccgaggatttcgatgaatccatcgaccgggtcatcctgcctggcggtgaatccaccacgcaaggcaaactcctgcgttccaccggcctgttcgagccgatcgccgcccacatcaaggccggcaaaccggtgcttggcacctgcgctggcatgattctgctggccaagaagctcgacaatgatgagaacgtctacttcggcgcgctcgacgctgtagtgcgccgcaatgcttacggtcgtcagctcggcagcttccaagccatcgctgatttcggccaagccgacgacccacagcgcatcgcggactttccgctggtgttcatccgtggaccctacgtggtgtcggtcggccccgaggctacggtcgaaaccgaagtcgatggtcacgtggtgggcctgtgccaaggcaacatcctcgccaccgccttccatcccgaactcacggacgacgtccgcatccacgagctcttcctgtcgctgtagccgattcgtctgccgttagactggtattcgaccgacgaatcaaggagacgatctgccatgcagttcacgctgaaccggcgcagcacggtgccgatgtaccggcagctggctgctgagctgcgtgaacagattgtctccggcgcaatggctgagggctatcgtctgccgcctgaacgcgagttggcctcacgcctcgaggtcaatcgcaccacggtattacaggcctatcagcaactcaaagatgagggactcatcgcctccaaagtaggcaaaggcacgttcgtgctgccgttgcagcatattgagactgcccggattcctgtagtgagacatgagccgattgacgaggagccgaaaccgagcgttgtgcggccgccatggtcggtgttgttctccgactattccaaccgattcacctaccacgacattgcctcggccgagcgggcgcaacgcggcgataccatcatcgactttgccaccggctcgcctaatccggcggatattcccgacgatttgttgcgttcagtgagcattgaagcgtttgagtcgcgcgaattcgacggtcagccagaatcgcctatcgaaggattcgatgaactccgcgcattacttgccgagcatatgagcacacgcggcgtgcagtgcgatgtacgaaacatgatggtgctttccggttccgagcaaggcatcgatcttatcgtgcgtgcattcgtcaatcctggcgactgcgtgctggtcgaacaatccacgttcttcccggcattgcagaccttccgctcggcggatgcgcgcatcatcggcgttccagtggacgagcacggtatgcgtacagacctgttggacggctattgcgcgcgattccggcccaagctcatctacaccgtcccgacgttccaaaaccccaccggtaccacgctgccgcccgaacgacgcagcgaactcatcgacgtggcgcggcgctatcagtgtctgatcgtggaagacgatgcttacggcgatttgtggtacggcggggaatcgtccgacgcacatcgccccataccgcttaagggcatggagaatgcgggatacgtgatgtatttgtcgacgttctcgaaaaccgtcacttcgggcctgcgcacgggatgggttgtggccgacccgcatgtgattaaccggctggcggctctgcggcgcatggtcgaccagcatacgagcacgtcatcgcagcgcatctgcctggaactgcttaaagaaggccgcgtcgccgaacatttgcgcggtttgattaaggcttaccgcattcgacgagatgcagcaatcgcagcattggagcggtatgcgccggatgaagtgtattggaccgtgcctgcaggcggctactatatttgggtttccttaccggacggcgtgcgctctctggatgtattggaatcctgccgttcccaaggcgtcacgttcatgccgggcagcgtgttcgacgttgacgaaatggatgattcccacatccgtctcaactttgtgcgcccggatgctgctgacattgataccggcattcgaatcattggcgagacgatagcacagatgtagccaagtgactggctcattgcggttgtcgagtttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgcagaaatcgccgattggggcgtcgcgaccgaaagcaacgagtacttcatcaccgaacagcgtcgtcagtccttggccgaggctcagtccggtggcgatgagtgggagaagcatggcaccatcggcgccgtggcgcgtgatgccgaaggcaatatcgccgccggcacgtccactggcggcatcaccaaccagatgcacggtcgtgtaggcgattcgccgctgcccggttgcggcacgttcgccaaccagtccacggtggcggtgtcctgcaccggcatcggcgaggcattcatcaaggtggtcgccgcccatcaggtgtcggatcgtgtgcgtttcgccggcgagaacgtcgaagatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatataacatgaatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggattccatcctgccctcctgcgcttgtattcgctatgggggatagcccctattattccctgaatctgcacgattccccctcatccttgagggtgattctaacggcaaaggcatcggcctaatggccgatgccaatcagcgcgaaaccaccagcgtgacgctgtacggcttgatcttcatcgccagcaatgaagacggcgacggcaatgtgtaagcccgacgttccggcacaatcgcccccgaagcctcgccgcggtatccgatagtggtcttcgccgtcggattggcgcttaacgtcgtcacctccaaacgcaccggtcgcgatggcgaggcgcccagcccggccagtccgcgcgcgatttccaacgtcacatccaccggggaatcggagatattgacgattttgatgtaacggcaggcgtcatccctgtcatgcccggtggcgctgacatacagatgtttggcggggcgtgacgcggtctgctcgatggacacggcatacgtcgtgtcgcccagatgcgtggaaaacagccgctccacctcataattcaccgtggggttcacatgcgccggattgaattcgataagattctgcgcccaccccttagccggaatatgcgcgagcagcggcgcataggaggtcatgcgcaccacgtcggaattgcgctcgcagccggtcaggaacgcggcctcgccgagtgccgacttccacgtgttcgcgccttgttcggtctgtggttggccggcaaaatagccgttggctgaatattcgccgaaatagacgccggcgccacaacgcgggtaagcgtcgaatcgtgacgcctgggatgcaaaccattcgggggagtggtaggaatgctcgtcgacgataatcgcgtcaccggtggcggaatcatgtgccccggaatcggttgcggccaacgctcgcgcatggtcccagctgcgcttcatcgccggctggaaggggaacagtccggcgctcatcacacacagcatatccgggtatcgttcatgaatggcctcgctgatcatgtcaaacttggccacgtagtcagccccgaagttttcgttgcccacgccgatcatgtccaagccgaacggctcaggatggcccatatcacgccggaccgcggcccacgagctggactccggatcgccattcgcgaattcgatgaggtccaggtagtcctgaatcacattgttgcggaaggtggccgaattgatatccatgtggcgcggatctcggccgggcgactggcatgcgatgccggcgaacagagtaggcagcggcttggccttgaggtcctcgcacaggcagaaatattcgtagaaaccgatctgatagctctgcgaatagctggaaccatccggcatcttgaacgaccacatcgaatactgttggcgtcgcgcggccagagagccgacggtatccttccagcgatactcattgccgggcgtcacaccttcgacgatgcagccgccggggaatcgcagaaacgctggatgcaacgcctgaatggtctccaccaaatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcagtccggttacgtcggcgttgaaccggtaccagccgtcacggccgatgacgatggcaccatccgacgaatccggactgatcgaaacgccggaatcctgcgcatcggccccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccaaggccggcggcggaacagttgatgaaatcccagaaacgcagggaatcagcctgcgtacgccaccgttcggcaccggccatacgccacgtgtgatggtcgagataaacgccgtcaaaactgtagttgttcaccatgttggcgttcagcccgccatccgcaccatggttgatgtcctcgaagaacacgccgtacagtcgcccgcttgtgtgatgggtggggcttcccacgctaatccgcaccatggtttcgattgtagagggaatggagcggaaaggtaaacggaagagttcgctcaccgttcatgttgcggtcaatccaagtcgactgttcgccggtatacagccggtaacctcgaaacaggaatggaaaatacggacgactaggagcgcggctgtgcaatcctcggtgggaatacgtgagcgcatcgaccacgtgtatccgtcgctgcgtccggcggagcgcgccgtagcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccgactatggccggttctccaccgcgctcgacgaatccggtcgcatgattcgcgaccgcgtattcgagaactgagctgctgctttatcgcgccttgggccgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgttgccgtatcaagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccttgccttcactggcaaaacgatcctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataacggctatactctgacttgagatgtgctgaataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtactcaaacgagtcgggctcggccatcgtctcagccattacccgcgccagatgtcgggaggccaacagcagcgcgtcggcatcgcccgggcgtttgtgaccaagcccgaggtggtgttcgccgatgagccgaccggcaaccttgactctaaaaccaaaaccgaggtcatgacgatgatctgtgcattcgcccatgacttcaaccagaccatcgtgctggtcacacacgatccgcagatggcttcatacgccgaccgcatcgtcaccttgctcgatggccgcatcaccagcgatcggctcaacaccgacctttcccgcccaactgttccgtccacgccgtccgcccaaagaacccaaggagttgaccgatgaagcacctctcccaccgcaccatcgccatcatcgtcgcgttgctctccacgctgtcactggcacttgccgtcatctcccttccgcaccaggcgtacgcagtcgacggcacagacggcacaagcggcacgaacagtacgtctcagggaagcgacggcgattccgcgccaatcgccggcccggtgccgaacatcatcgtcaccaacttcacctatggcggcgattccgtggccgccggcgccgatttcaacctcgacttcaccttccagaacatgggtcaggtggcggtgacgaacatggtcatcaccgtggacggcggcgagagcttcgccatcgcgggaggcacgaacacgttctacgtcgacgcgctgtggggcggttacgccatgacgcaaagcgtgccgatgcaggcgctcgcctccgcgaaaagcggtgcccagcccgtgaccgtgaacttccgatacgagtatgtggacgccagcgcccgctcctcaagccagtctgacgtcaagatttccgtgccgatcagtcagcctgaccggttcgaaatcagtgatcccgtagtgcccgaccaggtgatcgccggccaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcaccaccggcacgattggttacgccttcacaccgcacgcgtcaggcgagctgaagaccacgctcaaagtcacgtacgaggattccgacggacagaccaagaccaaggaattcccgctcaccatacccgtaaccgatatgcagccgatggatgattccggcatggccgatccgaacatggaccagaacgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctatcacaccagttaccccagcctcatcagtcgcaccagccggctcatcccacaaggcctgaaaggcccgaccatgcgattcggcgacatactgcggctctgcagacaaaacctatggcggcgtaaatcccgtacgattctgaccgtgctgggcgttatcgtcggctgctgctcgattgtgctcatggtctctttgggccaaggcattaacgagcagaacgagaagatgctcaaatcgatgggcgatctgtccatcgtcaccgtgtacaccaacggttatgccggtccgatggacgatggcggctcgtccaagatgggcgataccaagctcgacgacaaggccgtggaatccttccgcgcgatgagcggcgtatccggcgtgacgccgatgatgaacttcccttataacgtgacggccagagccggcgcgggcggccgttacatctatgattacgtgcagatcatgggcatcgacatgacccagttcgaccagatgggctacaagctcgtcggtggcgagaagccggtcaaaaaggatcaggtgcttgccggcgaatggttcgcctatggtttcatggacaccctgaagaacggcgaacaacgcaccagcacacgcggcggtcagtattcctcatgcacgtttgaccagaccaccggccagtgcgaggaagaccaggacgaggatccgttcttcgatccgctcgccacgcaaatcagtctgaccaccggcaccaattatcagggcgaccagtacaccatgaacatgtacggcggcggtggcggcacaggcggtgcgggtggcaacaccgcgggtcagtcggaaaacgtcacctttgatgtgcgggcttccggcattgtggcgggcgactacaacaaaggctatgccacctccgacggtctggtcatggatttgcaggcgttgaaggaactggccgccaaagtcgatccagccgccgccaaaaaagccaccgcctataatcaggtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggattggtcggctgcgtgctgagcggactgatatcgctgggcatcaacgttgtcggcgcgttgtatgcgggcggcatgagcggcggcatgtctggcggtatggtcagcggtgcaggcgggggctccggcgacggtaccggtggcggaacatctatctggaccatactctggcaggcgatagttggtggcgagaatgtgacccgttattcggtgattccgtggtggctgttcctgttcgtcgtactgttttccacgctgatcggcttgctgttcggcttcggcccggccaataaagccgttaaaatcccggccctagacgccatcaaaaacaacgagtgatcgcctctgtcacctgctccaccgttagtccataacgttcgttcagttcgcccagcggcacgcggtcggtaaattccttggctgcgccgaagttcagcacatgaggattacggctgccgtccgagacatgatgattcgcataatatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcggcagacaatgcggcggccgtctgctccgccaacggatacgcattgcccagtccgataatcgcgacgtgcgagcccgtctgattgacccgccaatccagcatgtgacgcacaccggcacgctgagccgttacgctaacggtcccgcggactgttgcggcagatatgcccccgctggcggagctgacggagactggcagcgaagttgactgggggcggtcagcgatctgcccacccgtcaccggcagcagcgtcgcatcccgttccgccgtcagaatcgcctcgcccggcactcgaatcaccaccggaccagcaggggcgtccgccgaaccggccggcgcggtagcccatgccagatcagctagatagtcgcgagccgaagtcggcaccagcatcgtagcccctggaatattggagaacatcgtcacgtcatacgcgccggaatgcgtattgtccgaaccggacaggccgcccagaaaatcaagtaccgtgactcgcgaacggttcaggctcatctcctggaagaactggtcgtacgcgcgctggaagaaggacgccgtggtggccaccaccggcgtgccacccgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcccggctcggcggcgaaacgcggttcgagtgcggccatcgccattttgccgtaatgcttgcgcggatcgtccggcttgccgattgcggcatccggattctgccaatgcgaggcctcgcactggccctcatgcggttcatgatcggacaggttgcagtgatccgaatgccacggctcgctgtggttcacgttatcggtgggatgcacgccggtgggggagtcgaacgaaaccggtgaggccgaggcggtttgccgatctgcgtgagtctcctcaccgtcatatcctgcgcccttcagcgtatgaatatggaccaccaccggatgatcgatatcgcgcacttcctcgaaagccgcgaccagcgcggaaacatcgttgccggcctccacataccggtaatccaagccaaacgcgttgaacaggttcggctgggcagtgccgccggatgcgcgcagacgggcgagcgggccgtacatgccgccgaaatcgccggcaatcgacatctcgttgtcgttgaacacgatgatgaggttgccgccttgctcggccgcgttgttcagcccctcgaacgccacgccagaactgagcgaaccgtccccgatcacggcgaccacattgccgatgccgctgcccggctcctccatgtcgcgggttttcgccaggccgcaggccaaggagatcgaagtgccggtgtgcccgagcacgaactggtcgtgttcgctttcgtcggggttggtgaagccggtcacctcgccgaaacggttcggatccatatacgcgccggcccgtcctgtgagcatcttatgcacgtagctttggtgggatacatcgaacacgatacggtcacgcggcgaatcgaagacgcgatgcagggccaccgtggcctccaccatgcccagattggagccgatatgaccgccgtgttggtggccatatgccagcagcgtggcgcgaatctcgcggcacagttcggcgagctcgtcgggggcaagggccttgacatcggccgggctggcaatgcggctcagcagatgggagtcgtcgccatgggaaggggtaatgctcggggggatgtcgtgaaggcgcgcggccccctcggcggcaccggagacggcgaaggaatcgcttgaatcaaatccgtttcctgacgcgttgcgcataccctcgaatctcccttcgctagtctttccgaagttgaatgctaacgcccggcattgtccgaggtccacatgacgaatcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgacgatccgcttgccgcgttggcggtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcgttctggacgaggacatccccggcaagcatgggctcaaggctggcagcgaagtggtgctgtacacgttcgtcggcaccgatggcgcgggcgtggccccgggcgagcgccgcacgatcctctccgagaaataccccggcacgatggccgagaagactgccgtgccgtccgccaacgtgttcgccaagcccgcaaacctcaccacggctgaggcggccgcactcggcaccagctggctgaccgcctactcgctgttgttcgatgccgccggcatcaagccgggcgactccgtgctcattcagggcgcgggcggcggcgtgtccactgcggccatccagctcgcccatgccgccggtctggaagtgttcgtcacctcgcgtgacgcggacaagcgcgccaaagcgctgaaacttggcgcgaacgccgcgctggagaccggtgcgcggttgccgcgcaaggtcgatgcggtgatcgagtccgtgggggcggccacatggggccattcggtgcggtcggtgcgtcccggcggcaccatcgccatctgcggcgccaccaccggcgaccagcccggtgcggagctcacgcgactgttcttccaggacattcgcgtgcagggctgcaccatgggttcgcgcgaggatttcgcccggctgctgcgcttcgtggagcacgccgacctgcatccggtgatcgattccgtggtcagcgggttggacgccgcccccgaggcgttcgccagaatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcggccagcgactgggagaccatgaagcgcgcctgcgatattctcgaccagttcggcgtcgcctaccacaagcaggtcatttccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtgatcggcgtgcccgtgcgctcccacgccctgtccggctgggattcgctgctgtccatcgtgcagatgcccggcggcattccggtggccaccaccgccgtcggcaactccggtgccaccaacgccggcctgctcgccgtgcagatgctctccgccttcgagcccgaactggccgacaagcttgaggattaccgtaacgaactgaaggaaaaggtggccgaatccaatgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatctgcggcatcgccggctggcctctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatacatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactactgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtaaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaagatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgagccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggcgaagcacagttcgtgcgcaatcgtctgagcctttggaccgcccggcatcccaaagcgatgcattggatgttgcagccggctgccggatggacaattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggctgcgatctggccgagcacgtaggcgggctcgttgttgtcggcgagcagcttcagcgcctcgtccttgcgagcggggtcgatggccagcaccatgccgatgcccatgttgaagatgttgtacatctccttatgatcgatgttgccagccttctccagcacgtcgaagatcgggagcacgggccaggtgccgagctcgatttcggcggccaagccgtccggaatcatgcgcgggatgttctcgatgaagccgccgccggtgatgtgggccacgcctttgaccacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagtggattggtggtgagctattcggcatccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcaatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttacgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtccgtggtgcccgagccggccgttgcgtaacgcacgtggccgatggcgcaattgcccttcagtcgttcgatttcgcgctcatcgccgaacacctgggtgagcaggccgagtccacgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacatcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcacctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagcgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgttcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgttgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagctggcaccatcgtcgatgatgatgtccggctgtatttcgtccagcaggtgcagggccgcctcgtgcgcctgttccgcggtccagtctcggctggattcgaccgtgattccttcccggcgcagctgttccgccactcggggatccgtggaatccgggccgcaatatacgccgacgattgcgccggcggccttaagcttgcgcagcagaatcgcggtctttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcgaacaggcatgtcgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaactatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggctgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgggcggcgaaaagctatcaagggccggtgaccatcgaccgatttgggcgcaaggtgcccaagagcgcggtcgggtcgattggtttgggcgatttcacctcgtcgtcggcacgtattcgtgaggctatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacggggcccaatcgtatggatccgattccaccagcgaaaaagatggagagcatgatatccagcgtgcgctgctggatgtgaaacgtaaattcggccgcaacgccgtcatcaaagccatggacatggaagacggtgccaccggtcaggaccgcaaccgtcagatcggaggccatcgcgcatgaccctgcaagagacccgtgcgtacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctctcgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacaccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccatgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgcccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccagaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacgctcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcgtcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagcgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccgggatgaacaggtcgtccacggcgatgctgtcgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagcacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcacgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaaggtatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcagtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcgaattcggcggcgtgcgctcgctgagcctgctggagactccgggcgcgctggacgtggcgctgatgccgggggtctgcttcggtcaggcgggcgaaggctgggtgcgcatcagtctgctcaagcacgccgccgagttgttccaggtcgtggcccacgtcgatcgtgtgctgcggagcgcgtgattcaatattgggcaaaatgcggcagcccataccatttcatacgcgttcaggcagcgcggccgacgccattgcagcgcggtggtttaggatgaggcaatgcgcgaaaacgggattgaagagagcattgatcgtccgctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgccttccaaggcgtggatgtggtgcatatctatatgccgttcaaattcggccgtcgtgccgctaaagtcgcccaccaaatgggcattcccgtgactgccggattccacctgcagccggagaacgtgctgtattcggccggcccgctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgggacgcggccctgttggcccgacgcatcgattggtggattgcacatcaggccgagcgcgccgaatggggcgaaaaatacgccgaatacaccaaggcgcattattccgtggaagcctcggtccacaagttcgtggatatggaacgcaaggcgataggggagtaggagccttctcgtttgcggagaggtctttccctcagtccgcctgcggcggccagctccctcatcagagggagctacgaaaaaacctccctctgatgagggaggtggcatcgcgaagcgatgacggagggagagattagcgaagggttttacaacaactcaataagctgatcgacctcttcatgcgtggtggcccagctggtgcagatgcgcatcacggtatgcgtgtcgtcggccttctcggtaaagccgagcttgacctcgcgctccagacggtcgatagtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcagtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgaaccggtggcggtcagcgcgtagccgagtcgcgcgccatccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcagggagaaaaaacaaaacccttccgcgaacggaagggttttactggggtggccaacgcggctcgaacgcgcgaccttctgaaccacaatcagatgctctaccaactgagctatggccaccatagtgccgtattcagcaagctgaattcgcgcaacaggtgaatactatacacaactttgcggatgtgtgctcatcggtgtgtcgcgatggaatcaagtggtcggtttcattcttggggccaggctgcgggctgtctcagatggcgggatgtggatgagtgggtcttgtgcggcgattgatgaaaagtcaaggcacacgacggtgtgatggtacgaccggggattgcagaaatgattacgtgagtgttcgcaatgtgagcattatgtttcatatcaaccgcgacccgcctagtttcatgcgatgttacctacaccaaacaagggaagagaaacaccatggaaaaggttaaagcctttgcagattggctgaccaagtggtttacggtcatcgtcatcgtctgggccgtcttcaactacttcgtgccggccgccagcttgtggggcaaggcgtacaccggctacatgctgggcatcgtgctgttcggcatgggcctgaccctgacgctggacgacttcaagcgcatcctgacccagccgctgatggtcatcgtcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgcccgttgtctaaatgaaagtgcaacacccgttagattggaaattgcctagaaaaccttcgccttgtcggaaatctctccccacatgatcttcggttgcgaaaaatcgcccctttgcctgcggcatctgtgacactggtaattgtgatttacggttatgttcgggtgagtagtgacaagcaaacactggagaatcaacgatttgaaattgagcgtttcacctgtgtcgaaggactgaaagtagatgaatgggtggaggagaccatcagcggcactaaagctctagacaaacgaaaactgggtccactattggatagagtaggagaaggtgatcttatcgtctgttcagagctttcgcgtttggggcgtagcctgttcatgattatggacgtgcttggggaatgtatgaacagaggatgccgggtgtggactatcaaggatggttaccgtttgggtgatgatatccagagcaaggtattagcgtttgcattcggactgtcagctgagattgagcgcaacttaattagtcagcgaaccaaagaggccttggcacgacgtcgagcagagggtgtgcgattagggcgaccagtgggaagcttatcagcaacagtaaagctgtcaggctatgaggcagacattcatgccatgctggagcaaggctgtaccaaggctgacattgcccgtaaataccacgttcaccgttctaccgttggtaggttcattaataaccatatgtctgatttatgactacaatttcgcggaatgctgcatctcaaggacttttaaatctttgaaattgcaacattccgcgggattgaccactcgttgatcacttcacgcgcttgatgccgagaacggcaacggcggcgatgatggccatcgcgatggtggtcgggaacacgaagttgtaggagcccagaatcgtgacgatgctggaggtaattgccacgccaatggcctggccggcgcaggtggcgatgttcatgaatccgaggtccttgcctgcggtctccttgttcggcagcacatccacgttcagcgcctggtcaacggacagatacatgccgtagccgaaggaagcgataccgccgaagaggtacatgcccatcgcggtcgggaaaatccatggcatggccagacccacggcgaatacggcgcaggcgaccatgatcggggccttgcggcggccgagggcgtcggcgatcgggccggagatcagagaggcaaccatcgaggcgatcatcgtgagcacggaaatgacctgaatggtggcggcggcttgggtcttggactggccgatgtggtcttgcgggatatacagctgataactgaagatcatctggtaggcaacgatgagacaggtgcggcagatgaaggcgcggtagaaatcgccgcaatccttcagcggcggggtaagggactcaacaacgaccttccacagcggtttgccggcatccttgtgcatgttcttggaagagggttcacgcggggcgataaccacggcaagcacgccggcgagcagtgcgcacaggccggtgcacacgaagccgacttccatgttggtgatgaagagggagccgatcagcgtgccgatgccctggccgatcacaccgccgccgccgatggccgcggagatcgtggcgcgggattcctcttcaacacggtcggaaatcagcgcgtagatcggaacctgcaccatgttgagtccggtgagggcgagcacatagcagatgccaataatcagagcgctggacgggcggctcagcgaccagaagcagatgccatacacgaaagcgccggtgaagatccaaggcgtgcggcggccccacttgctggcggtgcggtcggacagagcgccgacgaacaaggcgatgaaaatggaggcgacggagcctgcggagttgatggcgccgagcacggcggtggagttttcgatgcccagatcgcgcagacgctgcggaaccaggatggacatcgtgccgtagaaggcgatgccggataggacggcgaaggccgtgaaggccgcggtatagcgccacttgttggttttggaggacgggctcggggccacgcttgcagttgtcatgattgcagctttcccttcgttgagggattacatggagaggattacggattactcggatttcatgtgggtgcgtgcgggggccctctgtgtggaagggccccgcacgaggcggtcatcagcggagctgaatccaagcggacgtgtcttgcggaagcaggccgtcctcggtgagcgagccggaagtccagagcaccttgccggcgggcagcgcggccggatcggcgccgaagttggtgatcgaggcccagccattggcgcgcttgtaggcgatggtacttccagtgaatccgttggcaccgtcaggtttgccagaagaacggtcctcgggtaaccaagcgaggctcaaatcggtggtttgcagctcgtggcgcagcgcgagagcgcggcggtacaggttgagcatggaatccgggtcagcgctttccacatcaacggcgaaatccttgtaccacttgggctgcggcagatgcggctcggcggcaggggtaccgtcggcgcgagtcgcgggggagaagccgaaggagccgtcggtgccaaactcatcggacgggtcggcaagattcggcgcatccgcgctgttccacggcagcggcacgcggcagccgtcgcggcccttggtggacgcggcctgcgaggtgcggtggccggacgggtcttccacacgatcccacggaatatccgccacctcgaacaggcctagctcttcaccctgatagacgtaggcggaaccgggcagcgccatctccataagcacggcggcgcgggcacgcttggtgccgagctccttgtccagcgggcaggtggtgccatctcgcagcacccagtccttggcgagctggtggtattcgctggtcggcacctgcggcagaccgtagcgggtggcgtggcggaccacatcgtggttgctcatcacccatgtggcggaggagccggagtgttcgacgctggcgataccctcttcgatggcctggtgcatggcgtcgcgaatccagtccttcttggcgaactcgaagttgaagatctgtcccagatcgtcgggactggcgtacaggtactggcggttgggttgcacccacgcctcggccacggcgaacgccggaggattgtactcgttgaagaccttgcgccactcgtggtagatctcatgcacttcgtcgcggtcgattaccgggtgcgtgccgtcatccggctggtcggacgtgcaccacaccacgtagtcgtcgaggtcgtcgcggtcgagatccttggccaaaccgtgggccacgtccacgcggaaaccatcggcaccgtggtcgagccagaagtgcagcgtggtgaggaagtcgtcgcgtacctcgcggttgttccagttccagtcgggctgctccttggtgaacatgtgcaggtaccactggccgtcgggcacgcgggtccaggccgggccgccgaagtggctctcccagttggtgggcggctggtcgccgttcgggcctttgccgtcgcggaagatgtagcggtcgcgttcgggggagccgggggtgtctgtttccacggtgtcccgggcattgcgagggcttgataaagtcaaccctgagactcgcgccaaagtggaggcggctgccgaacgcctgcatttctcgttctcgaaaacggcattctcgctggccagcggcaaatccatgcgtgtggccgtgcttatgcccaacgaaatcagcagctggttcaacgcgcatacctttgaaggtatttacgaggtgctttcgcgcgagggatatgacgtggtgccctatgtgatgtggggcgacgctgaccttgaacggtttttccataccctgcccggcacgcagaacatcgatgccgtgttcatcgtctcgttcgtgttggacgtcgccaaacaacgtgtgctgtcctctctgacggtaccggtcgtcggcatcaataccccctctactgatgggtttgacgcctcggtgcggattgatgacatcgccgcaatgcgtggtgtggtacggctgctgcgctcgttcggccatgaaagcgtggcatacgtggagcagccgatgcagccttcccctttcgtatgcagcgactcggtgcgcatggaaggtttcctcagagcagttgacgatcagaggtacgacgacgggcatgtgctggtgattccttctgcggaacaggcgacgatgggcaatgaggctgccgccgtctctgatatcgcggcgcaacttatcggttccgatacacaacccaccggtatctgtgtggagaatgaccgatgcgaggtgctgctgctcaaggaactgcgccggttggggtggcgtatccccgaagaggtttccttggtcggctttgatggtgaaccgctgagcgatgtggccgatttgaccacggtgcgtcaggacccattgagtggcgggcggctggctgcaaacaaggcaatggctcttatgcggggcgagacgctggacgagcctcatacggttatgcctacttcgctgctgatgcgtgccaccactgcgcgccttggccggtgagctgatagggcgcgtggaacatcggctgcgagtctgaggtctgatgactgggtgtttgcgggggcggtttccgggctgcgggcaatttgtagtggctgcgctgtagtctgaactgttctgcaaacgcgaaggcatgcgcatgtcaggcaatggcatgcaagaaaatgcaaggaaaagaggcataccatggtcgacagccatgacgcggaaacatacagcgcgaagggctcgcgcctgatctggatcgattgcgagatgaccggactcgacatcttcggcggcgacgaactggttgaagtctccgtggttcccaccgattttgatttgaacgtactggacaagggcgtggattacgttatcaagccttccgagaaggcagtaaaccatatgaatgatttcgtgcgtgccatgcacacccgttccgggctcatcaacgaatggaagaccggcctgagtcttgccgaggccgagcagaaggtcaccgagtacgtgctgcgcttcacgccggaaggcgtgcgcccgctgctggccggcaacaccatcggctccgacaagaagttcctcgaccactacatgccaggcctcatgagccacctgcactaccgcagcgtggacgtgagcaccctgaaggagctcgcccgccgctggtacccggccgtctacgagaaccgtccgccgaagaacggcggccaccgtgccctcgccgacatcatcgagtctttggacgagctgcgctactaccgcaaggccttcatggctccggcacccggcccggacgatgccgcctccaaggccatcgtcgccgacatcgtggccaccagcattctcaataagtagtccgccgtacttggctcccctcacagaggggagcttagagaggttgatatgcgccaaaccgaagccttggacattctgaacgccggcgcgaacgtgttcctgaccggtgcgcccggtgccggcaagacttatgtcttgaacgagttcatccgtcaggctcgggccgatggcgccagcgtggctgtcaccgcgtctaccggcatcgcctccacacatatcaatggccagactatccactcgtggagcggcgtcggcgtggccaccgccttgagcccgagtctgctcaaactcatcagatcccggcgcaaacgcaagattcaggctacggacatcctcgtcatcgacgaggtctccatgctgcacgcatggttgttcgacatggtcgatcaggtctgccgcgaagtgcgccgcgacccgcgcccgttcggcggcatccaggtcgtgctgtccggcgacttcttccaactgccgccggtttcggtgtccgggcgcaaccgcgacctcatcgcccccacgcccgaatttatctccagccgagaacggtatgcccgtgccgggctcaatccggaaggcttcatcaccgaatcgctggtgtggcccgaacttaacccggtgatttgctatctgaccgaacagcaccgtcaggacaccggcgaactgctgaccgtgctcaccgacattcgcgaaggcgacgtgacccagtccgaccgtgatgtgctcgtcacccgtctgggcaaactgcccgagcccggccaggtcgccgttcacctgttcccggtgaaccggcaggccgacaatctcaacgacatgcgcctgaaccaaataatgcttgaaccgcatgagttccatgccgaaaccgctggccccgccaacctggtcgaccgactcaaaaagaacatgctggctcccgaacgactggtgctcaaagagggcgcggccgtcatggccctgcgcaacgacaccgatcgtcagtacgtcaacggctcgctcggcaccgtgcgcggcttcgcgcaggaaaacaagggcggctggccgatcgtggaattcgaaaacggcaacatcgtcaccatgaaacaggccacatgggaaatgatggacggcgacaccgtgctcgcctccgtctctcaagtgccactgcgttgcgcgtggggcatcaccatccacaaatcgcaaggcatgacgctcgaccgtgcggtcatggacctgaagcgcaccttcgcgccgggaatgggatatgtggcgctgtcacgagtcgaatcgctgggcggactgtatttggctggcgtcaacgaacgcatgttcctcgtctcgcccgatgccgtggtactcgacggcgacttgcgcgaagcctcggccgcggcctccgaccagttggccgacgaaggcgcaaacgcgttcaaacccgccgagccggacgaattcgccgccaatcccaatgacgacttcgcccaagctgccttgttctgatggtcgatgtatcgaatgactactaattggagcgtttctgcgtttcaaggggctgattttgggttttcgggacatctatctccgtttcaaggggctgatgcccaagtagacaacgatcaaaaatggcggaatgacgttggcatgaagccgattctacttccgatttagcggatgaccagccccttgaaacgcaagtagatgtccccaaaaggcgaaatcagcccctcgaaacgcaagtagacgccgctggcatgccttcgttgaagaattgggcgactaccatggaataagaggtggtagttatgatgctatccgagatatttcgtgaaaacaatgaggttcgcggggccgcccgagctggtgctggcgcaatacgcccgccagcggtggccggtttgttctaccccgcctaccgcacagcgctcaagcaactcattaaccatcagctggattacggccgagagcttctgaaacagttggaacccacgcttccagcgggggttccgaaggccgtaatcgtgcctcacgccggttatgtctattccggtacgacagcagcgcttgcttatgccttgctcgaacgagggcgggggagcgtgagtcgtgcggtaatcgtggggccgactcaccgtgtggccgtgcgaggcgttgcttgctctaccgcagcggcgtttgaaacgccgctgggcacggtgccgatagatgttgttgctgagcgtaaagatttaggcttggaatcggcttccgatgagccgcttcgttccggtacacatgctcgtccggggcaccggctcccgcaatgattgtcaatgaccccacacatgcgcaggagcatgccgtggaagtacaaattccgttcctgcaaaccgtgcttggtccagacctcactattgtgccgttgaatgcgggcgacgccacgccgcaagaggtgggcgatgtgttgcgtgctttgtggggcggaccggaagcgggcgactgcgcggctgcatcggttcgctggtcgcctaccgttcgctcggcaaggacatagctgcacatgcggtggacgccgccacccgtgacccacgtttcaacccggtcaccgctgcggaatacccgttactcaatatggagatatccgtcttaggcgagcccgagccgattaccgtgaactcccgtgatgtcgatttgcgcagcaccggttcgaagaccgagagcttggtacctactcagtccgggcctggaactgatgcgttcaaacgggacgacgaaaacgacgaacgcccggtacgatcacgcatggaactagaggctgcactgcgccccggcagggacggtctgattctcgccgaccgtcgtggccgcagcgccacattcctgccacaagtgtgggatgagctgcccgattcgcatgacttcgcctctcatctgctcgccaaggctggcatccgcccgtcctacgactggaccgatggcgaaatcgactgccaacgctacgaggtgacggcctatgccgagcactaacacagcaactgttttctcacccaccggtgtgagcctccatagttcttcgcctactgcccctactgctcctcccgctggcgggagatggcgcgaagcgccggagggtggtcatcgagaatcagagggtggtcatcgggaatcgcacggttatacggtagccacgcatggccgcaatcccgccataggacgctggcaaacgcaattccacgacggtaccaaccgcgctcgctgcgaactatgcccgcgccgctgcgtcctcaagcccggccaacgcggcttttgcttcgtccgctcaaaccacgacggactcatcgtctccgacacctacggccgcagctccggcttcgccgtggacccagtggaaaagaagccgctcaaccacttccaccccggttccagtgtgctgagtttcggcacggctggctgcaattccggttgccgattctgccaaaactgggatattgccaaagcccgcagcttcgaccggctcggcatggaagccagtccggagaaaatcgcgcaggtcgcggccgaccggggcatcgattcggcggcgttcacctataacgatccgatcgtgttcgccgaatatgccatcgacacggccgaagcctgccgagcgctcggcatccatcccatcgccgtgactgccggatacatgagcgccgaagcccggcccgacttctacgcggccatggacgccgccaacatcgacctcaaaggcttcaccgaagagttctattggaaagtgaccggcactcatctggccgatgtgctcgagaccatcgactatgcggtcaacgaggcacgcacaccagaaggcgaacacgtgtgggtggagctcaccacgctactcatccctggattcaacgatgacgacgcccagctgcatgctgaatgtacatggatacgcgagcacttgggtccggacgtgccgctgcacttctccgcattccaccccagttaccgcatgatggacgtaccgcccaccccgcacgagactctgacccgcgcccgagacatcgccctcgaagagggactcaattatgtgtacacaggcaacgtgcatgatcgtgaaggcgataccacgtattgcccaaaccctgaatgccgggccaagctcgtggaacgcgattggtatcgaatcattgccaatcgtttatctgccggatacggtggcaatgggcactgccccgtatgcaggactgctatcgccggacgttggtaatctgcctcaggtcgcccgcgcgattcaccgcagatcgccaatacgcgcggcaatcgtcctcatcgatttgaggctcgcctcatagcgcgcggctgccacaatcagaatgatgccgcccaaagcaagccacaatgccggccagctacgcagcatcgggcgtacttgcggcaaacgcacacccacaatcagcgcggccgctccggacaggccggcgataagatccaccggggcatacggttgcgggttggtccatgcaagaccgaggagtattacgccggcaagaatggtggcgcatgtctcaataacctgtgatgcggtcagccgtcccgacgaacgcccgaatcgctcttgcgcgactgatggttggttcggctgggccattgccggattcgggtaggggcagggagaagcataggcccggcccggctgttacggttgatacgggcaggccgcttgttccgggaccgacataggcgattgcgcaaacggtggcatggccattggctgttgcgataccgcttgttgtggaactgccgttgggaattgcgggggctgcagcagaaaattgcggggcccatgctggggccggttgatacaccggctgctccgaggattccggctgattcccctgttgctcggtcggttgcgtcatcgtgcccttctacccttctagccgtcattgttgcacgagtgagtccgaatgccaagatgaaggtcggaatagtgcgaatagcaggcgggcttgtcggttcacgcgaatatcgtggaacacatgacttccaatacccttcgtatgtcaaccatgttcctgcgcaccctgcgcgaggaccccgctgatgccgatgtcgattcggccaagctgctgcagcgcgccggctatatccgcaaggccgcacctggtatctggacctggctgccgctcggtctgcgcgtgctgaacaagatcgaggccatcatccgcgaggagatcaacggcatcggcgcccaggaagtgcacttcccggccctgctgccgcgcgaaccctacgaggccacccatcgctgggaggagtacggcgataacatcttccgtttgaaggatcgccacgaggccgattacctgctggcccccacccacgaggagatgttcacccttctggtcaaggacatgtactcctcttacaaggacctgcccgtcaccctgtaccagatccagaccaagtaccgcgacgagttccgtccgcgcgccggcctgatccgtggtcgtgaattcgtcatgaaggacgcctattccttcaccatcgatgaagaaggcatgcgcaaggcctactacgacgagcgcggcgcctacgagcgtatcttccagcgtctcgacctgaagtacgtacctgtgttcgccatgtccggcccgatgggcggctccgcatccgaggagttcctggctccgatgccgatcggcgaagataccttcgcgctggcaccttccggcaaggcatggaatgttgaggccttgagcactccggagctgccggaaatcgatgcttccaccactcccgccgcttccaaggaagccaccccggatgccaagaccatcgataacatgatcgagcgtgccaacgccgaccacccgcgtactgatggccgtgaatggcaggcttccgacatcctcaagaacgtggtgatcaccgtcaagcaccctgaggatgaagagcatgacgagccgtggcgtgaagtgattgtcgtcggcgtgcccggcgaccgtacggtggatatgaagcgactggaagcccagttcgcgcccgccgaacttgaggaagccactgaggaagacctgaagcagcaccccgaactggtgcccggttacatcggaccgatggtgcttggcccgcaggccgaggctgctggcgtgaagaacccggttcgctacctgatcgacgcgcacgtggtcaagggttccgcttggttcactggtgccgatgagaacgaggtcgactactacaacctggtgtacggccgtgacttcaaggtcgacggcgtggtggaagccgttgaggttcgccacggcgacatgagcccggatggttccggtccgttgagcttcgagcgtggtgtggaaatcggccaggtgttccagctgggtctcaagtactccaaggcactggacctgaaggtgctcgaccagaacggcaaggccgtgccggtgtggatgggctgctatggcatcggtgtttcccgcgtgctggcctgcatcgccgaaacacaccacgacgaagccggcttggcttggccgtccgtgattgccccggctgccgtgcacgtggtggccaccggcaaggacgccgtggcgtttgaaggtgccgagaagctggtcgccgagcttgaagccaagggccttgaggttatttacgatgaccgcaagaaggtgtctccgggcgtcaagttcaaggatgccgagctgatcggcgtgccgctggtcgccgtggtcggccgcgattacgtcaacgacggcaccatcgaactgcgcgaccgcaacggcgaaaacaaggtcgccgtgcccgccgccgaagccgccgacgcgctcgccgagcgcttcgccgccctcagttgagtcccacttactcagcctcggcgttaatcgcatcaagcgccattctgcccagtcgcagaatggcgctttgctgtggataaccgaaacttatccacattcttaaaaattcaactgcgtcacagtatccacatttgccagttgcccttgtgcacttcaaacgtcatgcctcacagtggaggtaccgctggggcgtgcaagccggcaatgaagccggagacaggctccggcggtccacatccaaacaacaggccagcaggccgaggaaaggaccgatcatggcaaatcaacaagcagcagtgaccgtcaccggctttgtggccggtgatccgacactaggcggaaccgagagcttccgcgtgctgacattccgtatgggcagcacgcgcagtcgactcaacccgactaccagacaatgggaggattacggaaccgcatgggtgggcgtcaaagcgttccgtgctttggccgtgaacgccgccagttcggttcgccgcggtgaccgcatcattgtggtcggctcactcatcaccgagcagtggaccaatgagcaaggcgaaccgcgcagtagaaccgttctcgaagccaccaacattgggcatgacctgaccttcggcaccacgtcgctgatcaagccacagcgtgccggtaatgggaacggaggcaatggtggcaacggtaacggcaatgccaacggtgccgtcgaaggtatggatggcggaaacgggcaacgagcatcgtcgccgtacgttaggccaacgcaatatggcgcgggcggtgccgcatccggtgtgggtattgacccgtatgcgacctcgtcggaatctggccccgtcgaatttggggtcacctccgattccggccaatcgccgtcgccatcaaccgagtccgcggccgtggccgatgccgtcatgtcgcaaccggacgccgacaccaatcaaccacagcccgtggcccaacaaacctacgtcgacggtttcgccgaatcttccaatcccagtgattccgaattctgagtgccaaccatacatcatgaaaaaccgctgtgttcgcctgtaatcgaggcaaacacagcggttttcctttacataacggggattaccaaatacgcacacggtccttgggcgcgagccacatggcgtcgccttcggtcacgccaaaggcatcgtagaagaggtccacgttgctggcgatgccgttggtgcggaattcggccggagaatgcgggtcgatctgcaggtactgttcggccagctcgtcgcggttcttggtgcgccagatggaggcgtagctcaggaagaagcgctgcaggccggtgaatccgtccatttcgggggcggtatcgagcagtgccttgatggcggcgggggagccgtcttcttcggtgtcggacttacctgccgccttgccgagcgcgaatgcatacgccttgagcgcgatgttcacgccgcccaaatcgccgatattctcgccgatggtcagcgcgccgttcacatgtggtgccttatccggctcgtcagcgtacttctcggccagctgcagcggcacaaagctgttgtactgggcgatcaatgcgccggtacgggcctcgaagttcttgcgatcctcgtcggtccaccagttgttgagcttgccgtcgccgtcgtactgcgaaccctgatcgtcgaagccatggccgatctcgtggccgatcactgcgccgatgccgccgtagttcgccgcatcctcggccttcgggtcgaagaacgggggctgcagaatcgcggcagggaacacgatgacgttcatgcttggctcgtagtaggcgttcaccgtctgcggattcatcagccattcgtccttgtcgaccgacttgccgaccttggccagctgatagccggtctcgtacaggttcgcggccttggcgttctcggcgggtagcgcatccgcggagacactcagcgccgaataatcgcgccagtggttggtgtagccgatcttcggcgtgaacttggagatcttctccagagccttggccttggtgtcttcgcccagccaatcggaattggtgatggacacgcggtaggcgtcaatcagattggcgaccagctcttccatgcggcgcttcgagctttcggggaagtgcaggcgcacgtattcgcggcccacatcttcaccacaaatgccgttgaccaggctcaccgcgcgcttccaacgatcgcgctgcttcttggcaccggagagcaccttgccgtagaagtcaaagttggtggtgtcgaagtcgcgagacagggaggaggcgaagcccagaatcatgtgaacacgggcccacagcttaaggtcggccagatcggcctcggcccagaacgcatcaagaccagtgaggaagctcggctcgtgcacaatgacgcgcgcgaacacagacttgaaatcgatcggctgagccttggcggcctcggtggcgtcataggcggtctgccaggcgtcgatccaagaactgagatcgaagttcttcagcgtggcggccaaatcggcgtaatcagtggggttgtaggtcttcaccgagtcgcgcgtggccacattgtcccaatggttggcggcgatcttcgtttccacaccaaggaagtggcgggccatatcaagcgcggcttcgctgggaaccgtggcgggagcgttgctctcgtcatcgccggtgttggacggcagctcatcgccaccgttggactcggcggcgggcgcgtatccggcgttcaccagctgggtggcgaccatcgccacgtatgcttcgcgcacgggagcatagtggtcttcgcgatagtaggcctcatccggcaagcacaggccggcctgctcaaggtgggcgatattgcggtccgggtcgccgggatcgccgtaaacggccaagccgaacaggtcggggccgccggctgggttgatggtgccgagcacgcgcgtgagagcggccttgtcgatggcggaatcgatgaggtcaagctcgtcgcggattgggtcaagaccggcggcctctatggcgtcggtgttgaggaatgagcggtacagggcctcagacttgacagccgggcagtcgtcggcgtcgaggatgtcgcgtacttggttttcggcgtcttcggcaagcttgtcgaaggagccgtagcgcgaacgatcgtcgggtaggcggtaggtgtcgatccatgggccattcacgtagcggaacaggtcattggtcggcttgatgacggaggagaacgatgccgggtcgatgcccgacgtcagcgtttcggtttcgttggtcatggccctaagcctaatcacggcgggggagaagcgctgatggtgcagatattgcgttatgggcattgcgctgtcagtgaactagacagattgcctaattgtggtgatggttcaaattagacaacttgtctatcatagtatgtggaatctgaacatggaccttgagctaaggagttacgatgagcaatccgaacgaggaccagtggaatggccagacgggccagcccaaccagagccagccgaaccagccgaatccggcgggtcaaccgggccaaccgcagtatggtgcgtatgacagcaatcatggcggccaatatcctccgcaaggtgcgccgggagcgcaagacactcagaatcagcatgcgcagaacggccagccacaaggcgaaccgaaccagaacccgtactacggcccgtacgcctacaatccgaactatggcccgaacggccagccggcatgggggccggacggtcggcggtatcaggcggacggccaatcgaatagccaagcggacgggcagccgaatggtccatggggcgatcaaagtcaacccggctggcagcagaccaactggtatgtcggcaatttcagtccattccgcctgatcgaggaatggctgccggaaaaagccaagaccaagattcgcatcatttacggcgtggtgggcgtggccgccatcgccttgggcgctgcgctgttgctggtgccgaacaagacgctggctttggccgcattgttgctcggcgtgtatttcgtgatttccggcgtggtgcgcatcgtcagcgctctcgtggagccgggtctgccgggcggctggcgtgtgctggacgtgttcgtcggcattctgctgacctttggcggcgtggtggttgtgcgcaactacggcatgaccggtcagacgctggcattactcattactttgatggtcggtttcggatggattatggaaggcgtgctgtcgctggttgaatcgtggcgtatcccgcattccggctgggccatcgcctatgccatcatctcgattatcgccggcttcgtggtgctgatgagcccgctgagctccgccgtattcatgattatcttcggcggatgcgccatggtggtgatggggattacttcagtgattcgcgcgttcactttcggcaagcgtcgcaagtaatctcacgcttcatgcaaccagtccccagacaatcaatccaaagcgcccgtgcaggctatgtgctgccgggcgctttttctcggccttggctattaatgggctgcgagtggatttcaggtaggcttctggcggttgacctcgggctggtctagagttgagaacaagtctcaacaaggtagaaagaatctcatgatcgaactgaaaacccctcgtgaaatcgaggaaatgaagccggctggtcgttttgtcggcggcattctgaaggaactgcaggagaccaccaaagttggtaccaacctgctcgaaatcgacgagttcgtccacaagaagatcgtggaccgcaagggcgccgaatcctgctatgttgactacgctcctgacttcggcaccggcccgttcgcccactacatctgcacctccgtcaacgacgccgtgctgcacggcgtgccgtacgactacagcctgaaggacggcgacctcgtctccctcgatctcgccatctctgtggacggctgggtggccgattccgccgtcagcttcgtggtcggcaaagacccggaccccgaagacctgcgcatcatcaagtgcactgaggaagcgctcgccgccgccatcgacgtggccaagcccggcaaccgtctcggcgacatctccaacaccatcggcgacgtcgcgcgcgaatacggctacccgatcaacctcgagttcggcggtcacggcgtgggccacatcatgcacggcgacccgcacgtgccgaacgacggccgcgcccaccacggctacaagctgcgcgaaggcctggtcatcgccatcgaaccgtggttcctcaagaccaccgacgagatcttccaggatccgaaggacggctggaccctgcgtgcctccgacggctcgcgcggcgcccactccgagcacaccatcgccatcaccgagaacggcccgatcgtcttcaccgatcgcaccaacctctgatcggcgtttggcgtatggtaggtgcctgattggcctgtgatgggcgatcagcgtctcattagccgtccgtctgttcgcggttttcccgcgaattcgagacgtaacaagccgaagtgcgtttgctttgatagcatgagcgcacttcggctttcgtgtatcgaccggcattcgccagcggtaacacagaagacatagagtaccgaacactagtgttcgcgaacgcgtgaacgttaatgtttggggtaagtggttcatgaagaggaaggtgcgcgaatggcaacggcacaacttgatgtcgattcgaacaagttcaacctgcccgtggttaaggctagtgcagggccggatggcatcgtcgtttccaaactgcgcaacgatggctgggtaacgcttgatcccggattcctcaccaccgcgcagtgcgaatcgaaaatcacctacatcgacggcaagcattcgattttgcgctactgcggttaccccatcgagcaactgtgcgagaactccgattttctggaggtggcgtggctgctgcgccacggcgagctgccgagcagggctgagtatgagcagttctgtgcggacatcaatcacaagacgatggttggcgaagacttccgtaccttcatgggttcgttcccgcgctccgctcacccgatgagcgtgcttgcctccgccatcaatgcgctggccacgttctacccggacaccaccgatatttctgacaacgaccagcttgatgaggccgccaagatcatcatggccaaggcccgtacgattgtgtcgtacatcttccgccgtcgtcgcgatgagccgatgctgtaccccgattacgcgcgcggctatgtggacgacttcctgcgcatgtgcttcgctgtgccgtacgagccgtttgaatccgacccgctgtatgtgcatgctttgggtcgtttgttgattattcatgccgaccatgagcagaactgctcgacctcggtggtgcgtatcgccggttccgcccacgccaacctgtattcggcggtggccgctggcgtcaatgcgctgtctggtccgttgcatggtggtgcgaatgaggccgtactgcgccaattgaaggcgattcgtgattccggcaagtctgtggccgagttcgtgcgtgatgccaaggagaatggccagaagatttccggccttggccaccgtgtatacaagtcgtatgatccgcgcgcggcgattgccaggaagtatctggaaaagatcatggagcgcgaagatacgcagaagctgccgtctgacgagcgcgcgctgttcgccgtggccaccgagcttgaagatattgcgctgaatgacgaatatttcgtatcgcgcaacctgtatccgaacgtcgacttctacacgggcttgatttatcgggcgatcggcttcgatccggccatgttcaccacgctgttcgcgctgggccgcattcccggttggattgcgcagtaccgtgagatgttggccgacccgaataccaagatcggccgcccacgccaggtctacaccggtccggtcgagcgcgatttcgtgccgatggacgagcggtgattgttggtttgagaaagcgcttcgctggagattccagtgaggcgctttctatatgtacagcgcaaaccagctatgctgcgacggctgcataagaactagcagggctagttctgaaattgaaataatgtgtgcggtatcgaggcgcaccgagggaaggcgtacgaaggtacgtcgaccgaggggcaacgaagataacgctccattatttcaatttcagttcttgtgcagcttggcgttgagctcaattcccaccttgcggtagcgggcttcgatgcggccgttcaccgagttgcggataaacagaatgttgtctttgccggagagctcagcacccttgaccacttccagcggttcgccagcggcggccttggccttgtcccagatggtgatcttagtgccggcggtgatgtacagaccggcttcgacggtgcagttatcgcccagagagatgccgataccggcgttggcgccgagcagcgagtgctcgccgatggaattgcgcagcttgccgccaccggacaaggtgcccatgatggaggcaccgccaccgatgtcggaaccgtcgcccacgaccacgccttgcgaaacacggccttcgaccatggagacgccgagcgtgccggcattgaagttcacgaatccggcgtgcatcacggtggtgccggaagacaagtaagcgccgaggcgcacgcggtcggcgtcgccgaggcgcacgccggtgggcactacgtaatcgatcatgcgcgggaacttatccacaccgaacacgttgacagtggcggcaggagctgcggcaggcagtccggcctgggaggcgaaagcgagagcggcttcggtggaggcgcgttcgacgtcggccttgcgcagcgtgaagtcttcaacggcgaaggggccgtagttggtccacaccacattggcgagctgggcgaagatgccgtcgaggttcagcgtgttcggcttggccatgcgcatgctcatcaaatggagcttcaggtaagcgtccgcggcattactgatcggctcgtccaactggctgacgacgaataccggcacgcggcgaatgccacgggcgtcggcctcatcgtgagccaaagtaccgaaattgtggttcgggcgatcggactcggccggtgcctcaccgagattcagttcggggtaccagacgtccagggtggtgccggcggcgtctacgctggccagaccccagccccatgcggtacgctcttcgctcatagttgctccttattgttgtacgcgctagtgcacgcttgtggacgcgcgatgcgattaatgattcccaccttagccttatgtgcgcctaggtgagggacgatgcccgcgaaatggcttgaaatcgtatttcccggtaaaaaattaccgagtgtgattggcgatgggatgataggttctccggtgaaattcgctggtgaacaactcgacaaggaggtgtgcgatgtgatgttgcatcattcgggagcataggctgtggccatgcgacgcccggcatcatagagtttgcgcttgagcgaatcgggctcaagaatcactacgcggccatcccaggaatactgcaatgcccaccagaacacagcgcgttcgggagcatcgacgatgacttcgaactgtgtgccgtccggtgaatgtttgatttgagggtcgtcgaaccattcgaacacgttgttgagcatggattcgtctcgtacggccatgcggatgcgaatcggggcatcggctacggggtatggacggtggcgcatgaagttcactgcgtcaaaatcagctggtgctggtttttccagtggcactgtgccgttcctgcctttggcgctgacgttggcgattcggttgaccacgaaaatgcggaggttgtcttcgccatgcaggtggcagatgaggtaatagcgtccgttcttgtacaccatctggtaagggtcggcggtgtaggtaattcggcctgcacccgtacggcttttatgcggtatcaaggtgccatccggtccgtaatcacggtattggaaggttacgccgtggccttcttcgatggcttgattcagctggtcgatagtggataggaactcaccgttgatatgcgtgtaggtggccacatggtccaggtagcctactgcctgcccggcggcgcctgcgagctcgcggattttaccgatgaggtcgtccatggtgtcgaggctgatgcgagatagggtaagactgtctagtagcagtcgcatttcggcagtggacaggaatgcatcaagataccagccgggttgtggattcttgcattcgatgccggcaaggtcgctttcggtgagatgcccgatatgtctgccgagaaattccgtggaggtcagctttttgagctggtttcgtatggtcttctcggtcggcagctcgcttggatcttccagctggtgtttacgggcaagctcatcgagtatttgccgcacggtcaggccatgcccaaagtaactgtgacgccacagcacctcgaagatttcgagggtggtgttccctgcataggatttgcgttgcgccggcttgtctgcatccatacattaaggctaccgcgcgcttcgtctaggatggaaacgttgggttgaaatacattcgctggaaaggaggctcgcccatgagcaaagggtatggtgtgtttggccatgttcccgataatgcggatgacgatggcctcctgccttatgaggatgatgattccggcgtttcctggggccatgcgttgcgtcgtcgcaatccttggaaaagaggagacgacgaagatgccgattacgacgacggtcggtatgacatagatgacactgatgacactaatgggggcaggggcatctatgccggtaaaagcggcggagtaggcggcatttctggtgagacgggtggaatacttggtagctcaggcgcggccggcagcagagacgtaacgtttggtggaacggacagtttgtccgccgccgatgcggtgatgccctatcgtttcaggcaaggacgttccgtatggttcgacgatgaggacgaaggccatttcgccgggtctgcgaagcgtgccgaagcccatgccgtccctatccttgcgttacgcaacgatgtggaatcgtcatcgtcgaatgccgtgctcgctcgtgcccgtagcattgcgcgcaaagcggccaccatggttatcaatccggtatacagcgaaaatcatcgaaccgggtatgccgagcttgacggtattctacgtggcaccaccagcccatcgagtaggtatcgtaccagcgtgcaattcgacctcgatacgggagaagccgtcggtggcaagtgctcatgcccggcttacggccgtggctatggcatgtgcaagcacatgattgcgctcgccttcatattctgcgatgatccgcagcgttttgaaggctaccgtgccggggccgcacgaccgtctcggacgctgattgactatatggagcacgccgataggcaagacgctcaagccaaaattcgtcgtcgcaatgcggttatgcgtcggtttgatgccacgcaagggaaaaacggtgcaaatgctcggcgtacaaaaagcggatacggctctcgtgccggcacccgaggcggcgggtatcagggtgacagcgagactgtgggcttggggcaggtgcagcttgtcccgatattgagtttcatcgacggcgtgtggagcgtggagttcaagatcggctcggcttccaatgggtccagctatgtgctgaaatcgattccgcaatttgtgcttgccatggcgaacggcgactatgcggattatgggcagaagcttgcctttattcatacgccggatatgctcgatgatgattcgcgccccctgctggacgtccttgatgatgcgatggccgtgcgtcgtgcggccgagcagcaggacaggtattacgggcatatcgccatcgaccgtcatctgacgctttcagcaccggaagtggcccggttgctgtccgtacgtgagggcagaggcgtacagctcgtgctgaacacatggttctccgggcagcctgcatcggtgccagttgatggtggcgagccagattttctcatgcgcattgcgcggcgtgatttcaatacgtatggtccggatgccggatacctgcttaccggagtgccagcggtggaaaccgtgattgacggcggcaagaatgtatggctgttgctcgcctccactaatccggccggtgcggtatccgccatggtggcgggctctcagcgtaaaagcgcagcaggatgccgattcgtccgttgcccgaaacgattgattccgttgcgaggactattgggagacctgtttgaacccgatggcgagggacaggtcattgccggcgatgacatcgccctattcgcacgcacgctattgcctcagctggttggtgccggactgttggaggccagtgagattcctcgcgagctggctgaattaagtcctacggaatgcagcctccagttttatctggatcgtgatgagcatggtgtgcaatgcgaggtcaaggcacgctacggcgatgccattgtcccgttgctacccgatggcccgacggtgcatgctgagggcgagcgttccatccccttgtctcggggcgtgattgggcgtgatttcgacgctgagcatcttgcgattgatgtagtgcgtgaattctttaccatgcctgaccagcgcaagcgcgttgcggccgccactcatcagacggtgaatgggttccgaacgccggccgcgcgaaaggccaccaaaaaattcgtgtctgatgcggccactatcgatcgcgatgacaccacgcagatcgttcgtctctttgacgagggattgccggcactaaaggaagtgggggaggtcttcaccacaccggcttttgaccggctgatcgcgcccaagccaccaagcgtcaaagtcggattgtccatcaaaggcaacttggtggagatatcacccctcgctgatgaagtgccgccggacgaagtgggtgccttgctatcttcgtaccgtcggcgtcaacgattccatcagttgaaggacggcacgcttgtcaaactcagcggcgcgaatctcagcacgttggaccgattggccagcgacctcgatctgagcgagcagcagctcaactccggactgatcgagttgccgggcggtcgagcattcctactggatggtgagctgccggatgacggctccgatgtagtcaaggacgcttcgttcaccgaatacatcgacgatctcaagatcatcgaccctaagtcgtatgaagtgccggatagtctcaagcatattctgcgcccttatcaggtcgaaggctttcaatggctgaacacgttgtgcgacaagggttttggcggcattctggccgatgagatgggcttgggtaaatccgtgcagcttatcgcgttgctcctgtctcgatatcagcggaataccggcgagatgggcgacggcagccttggcccatcgctgatcgtgtgcccggcgtccttggtgtacaactggggtgccgaattcaccaagttcgccccgagcttcaatgccgtggtggtggccggtaccaaagccgagcgccgtaccgccatcggccgtgcgttccgggcggatgaacccaccgtgctcatcacctcatacgacctgctgcgccgagatgtcgatgattacaccgccaatgagcaacgtttcaatgtcatggcattggatgaagcccagtacatcaagaatcacaccacgaaaatagccaaagcggtcaaggccgtggccgccgaccatcgtttcgccttgactggcacgccgatcgaaaaccgactctccgaactatggagcattttcgacttcctgatgccggggctgctcggctcatataagcgattccatgagcgttatgagttgcccatctccaatgcccgggccgcggatggcagcacggctgaaggtcgggccgccgcacaagtcaatcctgaggccgctcgggtatctcgccaattgcagtcgttggtgggcgtgttcatcaagcgcaggctgaagtcccaggtgttgaccgatttgccggacaagctagagaccacgctgaccgtgcggcttgccggcgaacagcgcaaactgtatgcggctcacgagcagcggctcagaatgcagctcgaacacagcgaagaagccgatttcaacacgtcgaagattcgcatcctcgccgagttgaccaagttgcgccagatctgctgcgatccgaggctgctgtacgccgatgccaaggatcaatcggccaagcttgccgccatcaccgaactggtggaaacctgtgtgaacgaaggcaagaaggcgctgatcttctcccagttcaccagcttccttgatctgatcgccgaacgtttcgacgcgcaaggcctgcgctactacaccatcaccggctccacgcccaagaagaagcgtctcgaactcgtcgaccagttcaatgcggacgatacgcctgccttcctgatttccctgaaggccggcaacaccggactgaacctgaccggtgccagcgtggtcatccacgccgacccatggtggaacgccgccgcacaggatcaggccaccgaccgagcacatcgtatcggccagaccgaagacgtcaacgtgtatcaggtggtggccaaggacaccatcgaagaacgtatcttggagcttcagcatactaagagcgagctcgcccgccagttcaccgacgcttccttgcttgccgacgaagccggcaccggcgccagcgccctcaccgaagcccccgcctccatcgccaccctcaccaaggacgatctcctcaatctgctggggtgacagagcttctttgtgcactccccatcccgattaagaacatgtgtattcatgggtttgcggatgtgtaggtgaatggtgaaagtgtttttcgatatttttatatcgatattcgatatattatgatggtggcatacggtgcagtgcaggttcatccattgatattgatattggattaaggagcatagccatgaacgctggtatcgcattcatttctcgtaaatctcgcaaaacagacgtcgcttggcgctatgccattgccgtggtgcttgtcgtgtgttgtattgggctcgcatatgtggagattgttgtggcgccgtggtttatcaatgaggtggtgtctatgtttccggagaccacgttgcttaaagaaccgtccatgttctgggaatgggcgattctgctcgccgttcaggcgactttgctgtgcacggcggccaaattggtggtaccggagcgtctgttggctcaagcagctggactgctggatatgattcgtatcgtcgcgcttatcgtcgtgttttcggtaaccactaccggtaacatcacaatctgcctcatgaatttcggaactccgggctttgtatatggcgtggccctatgcagcctcgctgcgatcatcgccatcatcgtgctgctgaaacggcggcgctacagcacctgctccatgccgatgtaatatggagtgagtcccatgcgttcgtagaaggcttgggctttggggttgcaggcccagacgttgagcgttacgttgtggcagccggattgacgggcgaagtcgagcacgtagcgatacaaggtggagcctacatggtggccgcgggaccgctcgtcaacgcatagatcatcgatgtacagggttttgatatcggtcaggatattgctgttgaggtgctgctggaacacgcagaatgcgtagccaagcacttggtcggtggcgggggagtcggcgttatgttcggcgtcattgccgtcattggcagatggcgcaaccgccacgaacacaggggtctgatcgttggccagaatcgccttcaattcctcgtccgtgtatttcttgacaccgcctttgaacagatccggtcggccggcatgatgcacttcgagcacctgccgcagcagttcgtcgatctggggaatatcggccgccgtggccctacgaatcgtcatgtcatccattgaactcagtctaatcgggcagtctcgaccggcagatgattgttgcccgcgataagagacacggacgggcaagatgggtgatcgttcgttcaggctctcattctcgccgcaacgtcacggtagtctggagtgcgtgaatcgcaagaaacagccagtggagaagtatgagcggggtacccgttcgtacacgatgtcgcatattcgtggcaaagacaccaaaattgaggtactggtacgcagctacctgtttcgcaaggggttgcgattccgcaagaacgacaagcgttaccccggacacccggatgtagtactgccgaaataccacgccatcgtgtttgtcaacggctgtttctggcacatgcatgaaggatgttccaaacattcgatgccgaaatcgaacgtggaattctggcaggcgaaactactgcgcaatcacaatcgagacatcgcgcagcgagccgaactggaggccgctggctggcgtgtaattaccgtatgggagtgcgaattaacgaaagccgtgcgcgacgaacgcctcgtacggctgtatgagcagattgttgaaggagatgcagattcagcggaataatttcagctcccctctggaggggagctgaaatcaggattcaaacgggaacttcaggccccaacggtcacgaatcgcatccatcagctccatgatgcggatggtgtcggcgtgcggcatcgcctcgcattcgatcttgccgtccagcagcgcgttggccgcatcggccacctcatactcataaccggtcaactgcggcggcaccgcaatgctgcgcacgggcttgtgggcgttgtcatagatgtcgatggactcgggattgttgatattggtgaccaccagataaccctcggtgccccacacatagccgccgcggtcggaggaaaccagcatcgaactggtggacacggccatcgtgccgtcgctgtaatacaacgtggtggaattctgcgcatccacaccggtttcggcgggcaccatcgacgtatcgaaatgatcaagtgtacggccatggtcggcgccgaccgccatatccaggaagttcagcggatacacgcccacatcgagcagcgcgccaccggcacaggccggatcggtcatacgtgccttgccggacaccggatagcacaggttggcgctcgccgctttcacctcgccgatctcgccggactcgataacttcgttgatgagcttgcggctgggcatgtagcgcgtccagatggcctccgtgcacagcatgccggtttcctcggccacggccagcgcctcacgtgcctgcccggcgttcgcggtgaacgacttctccaccagcacgttcttgccggctttcatacacaggatcgcctgttcggcgtgcagactgtgcggggtggcgatatacaccagatccacatccgggtccgccaccaactcctcatacgatccataagccttgtcaaaatgccattggtcggcaaaagcctgcgcgcgcgtaatatcacgggccgctaccgcatacgggtgaatccatgaggaatacagtgaatcttcagccatctgggtcagggtgccggccatggtgtgagctatgcggcccgcacccagaatcgcgacgttgattttttcgccgctggcctcgaactcggcgcgcttgccattgaatcgactcattattcctccttgaatgcgggttggtgcactcaatcgacctacagtgattatagaagaagaaaccttgtcccgtgaggcggatagaaccgaaatatggaaaacgaagcagcgcagcagccccaatctccggccgcgtctccagtcatgtcccgccgagcgcgtgaggccaatcccttccgtgccatggtattcggcgaacaagcagacaagatgatcgcccaaggtaccagcgtcatcaaattaagccttggcgagcccgatttcggcgcgccgcccgccgtacgcgacgccatgcgcgaacagtacgacggccgggccctgccgtacaccgccgccatgggcctacctgaactgcgtcaggccatcgccgacttctaccgcgagcgtcatgaccttgacatcgaccccaagcgtatctgcgtgaccgccggcggttcggccgctctgctgttggccaccgcgctgaccgtggaccccggtgacgatgtgattgtggccgacccctcctacccatgcaaccgcgaacttgtgcggtcgtttgaaggccgggtcatcgatgtgccgacctcggccgccacccgcttccacctgaccgccgacctgtgcagccagtactggacgagcaagaccaaggccgtaatgatcacgtcgccgtccaaccccaccggcaccaccatcgacttcaacgtattggacgaggtgtgcaagttggccgccagccgcggcgcatggcgcatcgtggacgaaacctaccttgatttggctgaccgggagccggacggtaccgaagtcaagtccgtactggcctgcgaccccgatgccatcgtatgcaacagcttctccaagttcttcggcatgaccggctggcgcctcggctgggcgattctgccggacgagcccactgtgctggaagcggttgacgatctggccaccaactactacctgtgcgcccacacgcccacgcaacatgcggcgctcgcctgcttcacgccggaaagcttggcggaatgcgaagctcgtcgtcaggaattgctggcccgtcgccgcattgtgattgacgggctcaagcgcatcggtttgccggttgaggtggagccgaatggcgcgttctacgcctacttcgacatctcccgcactggtctggatgcctggacgttctgcgaacgcgcgctggatgaagcccatgtggctctgactcctggccgcgacttcggcgcggccacggcggatacgcatgtgcgcctgagctatgccgcctcacgtgaggccctgaccgaggggctggaacgtctcggaacgttcgtcgaatcgctgtgaacggcgcggcagccggtgtgattgttgtacagtagtcgagtttgtgtgatgttcggctggcctcacggtgttggttgccggccgaacgactcgccatggtggcgcacggctggctgattgcgatggtcggcccgttgttcggccatcacgggttaggtaaggtcaggaataggaatcatggtcaatctgcgttcgcataccacgcgacttggtgtgcttgatatcggttcgaacactatccacatgcttatcgtcgacgccgcccccggcgctcgccctgaccccgaggccagcaccaaatccacagtgcgcctgatgaagtatttaaaggacgacggctcaatcaagaagtccggcatcgaggcgattctggaagccgtgtcccagtgcatgcggctggccgaggaatacgaaatcacccagctgctggttatggccacctccgccctgcgcgaggcgccgaacggcaacaaagtgattcacaagatcgaggaactgattggtcagggcgtcactgtgctgtctggcacggatgaggctcgcctgaccttcctggccgcccgccgttggtatggttgggatgccggccgactgctggtgctggacatcggcggcggttcgctcgaagtggcgatgggctccgacgaagagccgaccgtagcgctttccgccccggctggcgcgggccgcgtcaccactgaatttctgccttccggcatggccacgcccgacgagttggaagacgtgcgtaagaacgtgcgcaagattctggagccgatggtcaaggttttcccgcaatccaagcacccgaatcatgcagttggcacctccaagaccttccgctcgctggctcgcctgtgcggtgcggtgatgcgtgcgccgggccgcgaagattcatggattatgactcgtgagcagttggaagactggattcctcgtttggcggcgatcgcgcctgagcagcgcgtggctttgcccggcatcacgcctgaacgcacgatgcagattgtgggcggcggcgtggtggccgacgagatcatgaaggccctgaatattcaggaagtcgagatctgcccgtgggcgctgcgtgaaggcgcgattttgcgctggctcgaccaattcggccgcacccgcctcggtttctagtcctattgaggggaatcacccaaccgccacggtagccaacaatgccgcatgatcagagccctcgactttgaccaccttgcattgtccggccttcatgccctgatcaagcaccacgtggtcaataccggcgaacattggcacagccgcacggttcgtgggccatgagaacgtaaacccatgtccggattcacgtgcggcatccacgaaccggtcgccaagaaaatcacggaatggcgtgtgatcgtaagtggcgttgaaatcgcccatgaaaatataccgtgtatccgtatgctcgcgcatcagacccaactcatccagcgatcgcttccactgccgccagtagccgggtacgggagcggtggtgtgcacggatacgaatcgaatctgctggccacccatatccaccgtgccgccgggcatgaatgaggcgctggaattcacgtcatcgtcggtcggatcggcaagtggcgtggccgaccagaggccgttaccgaatacgccgtcagacgatgagacctgcgcatacggcagataatgctcaataccagcctcattgagttttttgacgaaatcctcggtggtctcctgcaaagcaagcacttcgacgcgctgatcgcgaaccagctcgacgatggcttgcgggtcggcctgccccttatacacattgaaggtcatgacgcgcgcgtaggcatcgctggtgttgggggaggctgcggccacggcgttctgcgcggcttgggggagtggatcggtcgagtagaagaacggatattgccaatagccattgcatgcgattgcggcgatggcgattagtgcggcaaggatacgccgcgacacgatggccaacagcagggcaatcaagccaagcaacgtgaaccatggcgttgccgataccacaatcggcgcaaatggcagttcctgtaaatcggcaggcagcgcgcgggcggcagcgccggcaagggcaagaagcgcgaacatcgtggcgagaaaaccaagcagacgatgccgtttgtgtggcttcacggcagacttggatactgggcgtgccgtggctctggcagagcgtggcttggcagcggcgcgagctcgtacgcttgcgcctgtggtagtactccgtgcctttgccatgctgccctttcctccggcttgtttactgttactttgcttttcgtgcgatttgccactgtaccgtgtacggcttgtctttcagtgtcttttcgccgtgcgcaagagcagttcgcaccaaactggcacgaaagaccgggccatgacctgatgtcgggttcctccatgtggcttgctcaggttgccggatggcttgcgcaagctgccacgcgaacatgatgcgactgggcgtgtggccgtgtacaatgaaacgtcgttgcccgagtagctcagtggatagagcaccgctctcctaaagcgggtgtcgtcggttcgaatccgatctcgggcacttggcttcggaaacatgacggtatctcagcctctattcatcggtgatgagccatgggcattaggcatgtgtaaacgtataggttccactatccatcatcccgtcgtgtgaaactatgcaaagacatgtggggcttcacggttgtcgtgagggtccatggctatcgaatacacggaagagaagcggtttactgttgagcaggttgaggcgctgttcaagtcggtaggttgggaatcggcgcagtggccggaacggttgttcaaggcattgcagcattcggatacggtgatcagcgcatgggatggcggccatttggtcggcttggttcgcgtgctcgacgataccgaaatggtggcctatatgcattgggtgctggtagatccggcatatcacgggcagcatatcggcagccatctcgttgaactggtcaaggctaagtatcgcgactacttcttgctggaagtcatgcctgaggaaagcaaaaacgcaccgttctaccagaagcatggcttccacctgatggacgatggccgcgccatgcaaatcgtcaatcgcggctgacgggctggcagtgcggacggcgcaagagcggcggcatgcgccaatcgtgggcaacgtacgtagtcgttgacggttatcccgtagcaatgttcacaatacgaccccttgtccatacagtgaaaataacggctgacgttcgacgttgctgcgctatgactagagaccatgagtgaagacaaacagtatgacttctatgtggccggtccgttctttgatcctgaacaaacggcaagtatggaacgtttggaaaagatattggaagaccatggcaaggtactgttcaagccgcggtttgtcagccagatcgaagaagtaggccctgaaggatgctttgcggacgatatccatggcattaatgctgctaaagccgtggtcgccaatcttatggacgaggacccgggcacgatgttcgaaatcggatatgcgcatgcgctgggaatcccggtgtacggctatttcgaaaaccttacgccaatggatcgtgtcaatctgatgattgcgcaagcggtcgaactggtgttcgtcggtcctgatgatgtggcgaaatacttggaaaccggcgagcatacggaagtcgattacatccagttctaaacagctctaacaggttctctgcaagcagggttggcggcgttctcgtacatagtcatgtacgggaacgccgcagtggtatagggatattccaacaagcggcataatggggtcgtgggaaaaccagtcggatacaagtgaagtgtctgaatttcgtaaggagtgccgttatgagtaaccacaatcccatgaatattgccaccgactttgccaaggccacgggaggaaccgctcgcaaagttgttgctttgaccgataaaggtccgttgaatggctttaagaaattcctgtcgcgcggatcgatgattgatatggcggtaggtgtggtgatgggctctgccgttaccgctgtggtcaattccatcgtcgacaatctcatcagtccattaatcggcatgattggcggcgtaccggatctttccggactgctgaccatcacgttcaacaactcgactgtttcatttggtgcgattcttaacgcgctgattaacttcctgcttgttggcgtggcggtgtatttctgcgtgattttgccgattaataagcttcgtgatctcactgctgcccaggatgaggctgacgctgaagaacaggggcctagcgttgaagagcagactctcgccacgctgcaggagattcgcgacgagctgaaaaaggccaataactccgccgagtaatctgctgaatgtacggtgcgacagatttacctggtttgcccgaaataacggattgccggggccatttggtctggacaatccgttgtttcgcgcgtgttttgtagcatccgtggagttacatggggagtatgactgaaaacatcgctgataaggccataaacgatactcgtatcgtcaagcagttcaccaatcccgtcaaggagccgattgacagcgacatcaacctgttcgatctgctcgataaccgcgccaagcgcgatcccgaaggtgccatgatcgaatacaagggcgatgatggcacttggcacccgtacagcgcccaagtattccgtgacatggtcatcgacttggccaagggcctggtcggacttggtgtcaacaagggcgattcagtcgccatcgtctcgcgcacccgctgggaatggaccgcgctggatatggcgatcatgtccatcggcgcgctcaccgtgccggtgtacgagaccaactccgccagccaggtcagctggattttcaacgattccaaagtcacgctcgccatcgccgaagatgacgggcagcgtgacaagatcgaatccgtgcgcgatgaggtgcccaccctgcgcaacgtgttcgtaatcgaggccggcggtctgaacgccatcaagacctacggcgaaagcgtcaccgacgccgaattctgggaatacaaggaagcctcccacggcgacgaccgcgccaccatcgtctacacatccggctctacaggcaccccgaagggcgtggaactgacccaccgcaacttcgccttcctggtgctttccgcgctgcagtacatgcctcgtgccggcgcatggcccaaccgccgtctgctgctgttcctgcccctgagccatgtgttcgcccgattcctggaattcttcagttttggcggcacgatttcgctggccttgagctccaatatgaagacgatggtcaaggacttcgagaccttcggccccacgctgctgcttgccgtgccgcgtgtgtacgagaaggtctacaatgccgcctcccagcgcgccggcaccggattcgctggcaagatgttcatgcgcgccgccgagaacgcgcgcgaatggtccaaggccgagcagaagggtgagcagctgccgattaccggacgcatcgcccacgccttctacgagcaggtggtgtacaagaagattcgcacgattttcggtccgaacgccgacttcgccatcaccggcggcgctccgatggactccgagctttcccacttcttcaacggcatcggcatgccggtgctggaaggctacggcatgaccgaaacctgcggcccggtgtgtgtgagcttgccagaggacaaccgcatcggcaccatcggcatgccgatgtgcggtatcaccgccggcattgccgaggacggcgagctggtggtcaaaggaccgctggtgtgcaagggctaccacaacaaccctggggtcactgcccagcagatcactgatggctggctgcacaccggcgatctgggcgatatctccgaagatggcttcatctccatcaccggccgtaagaaagacctcatcatcaccgctggtggcaagaatgtgtcgccgggtctgcttgaggcttccgtgatgacctcgcctgtggtcaaccagtgcttggttattggtgataagaagccgttcgtggccgctctggtcacgctggatctggcggatgccaacaattggctggaatcccagggcgccaaaccggaacccgatctggcctcgctggccaagaacgccatcgttcacgctgaggtggagcgtgcggtgaacgccgccaacgagggcgtttcccgcgccgagtcgattcgtaagttcgagattctgccagacgaattcaccgaggccaacggcatgctgaccccgagcctgaagacccgtcgcgcgcaaatcgttgagcactatcgcgagctcattgacgacgtgatctacgtgccgttgaagaagtagctatcaactccctctgatccaaaaaataagctctctctgacgagggaactgtcagccgcaggctgactgggagagaccgcggctagcccgcgaaacaacaaggccgggtgcgacttgcacccggcctcagcttattcagtccaaaatcgccgaaacataatcggcggcggcctgatccagctccgcatcgccgatggtggcggtgccctgcaccaggaacggctcagcatagttcatgccgaccttgtacgccacgacctcaaacgggcttagcagctcctccatggtgtggctgtactcgccgtccttgcggtacttggcggcgtcggaaccagtggtgaccaccagtttgagctccttgcccttcaacgcatgggctccggcgtaggcccagccggcggtgatgacctcgtcttcccattccttgagtagcgcgggggaggagtaccagtagaacgggaactgaaggattacgcggtcggcagcctccagcagctcgtgctctgtgtcggcgttgacggagaagttcgggtattcggcgtattcgtcgcgcacgatgatgtcgtcctcgccctgtgcggcgagttcggcaagcagacgggcgttcactcgcgagccgtccttcaggtgcggatggaatacaagaatcagcgttgacatgggatttcccttctataactgctaccaatgtggcctaatcaccactatcgtatgccgggaagcagaactcagtccagtccggactcgggtgcgagccgcgggatgccgcgccgggaggcaactcagtcgaggttggactgcgtgcctgcggtggcttcgttggcggcttgctcggcttgtgcttggtcgagcttggcacggacgtcgttgagcagaccctgggcgcgcttggccaaggcctcgccgatctcccattgacgcatcgactggtcaagattgaggccgccggtttccagtgcctggacagcctgaatcagcttgtcgcgcgcctcctcatatggcatctgggcgatgagctcgcgttccttgtccgtcagggacgtggcgggggtgttcttgtcggtgggtgtggcgttttcggtcatgatgttctccttatatatacggtatatatgcgtggctgcgtatggcgtgtcacgcggttgcggatgtggtggttgcggtaatgacacccttcttcaaggtgacggtgatgccatccccagggcttacctgcgaagcatcgtctagtacgtggccatcggcggactgcaccaccgcatagcctcggttcaacgtggattgcgggctgagtgcggtcagtgaggcgtgagctcgctcgacggtgagctgggcatcgtccacgatgcgtcgcagcccgatatcgagccgttgcaacgagtcgtcaattaagcgctgatgaggctcaagcatggtgtgcggctgtgtcaggctcgggcggttcgcatatccctcgataagtcgaatctcgttctccacgcgcgaacggacccgcagtcgcatacggtcgatggcaccttcgatgagctgcgactgctcacgcacatccggcaccacgcgcttggccgcatcggtaggggtggaggcgcgcagatcggcgaccagatccagcaatgtccagtcatcctcatgcccgatggaggagattaatggtgtagtgcaggcatacgccgcacgaaccacacgctcatccgagaaaccgatgagatcctcaaacgagccgccgccacgggccacgatgatcacatccacgctcgggtcggcatcgagttgtgcaatggcctgaaccacctcggccgggcattgctcgccctgaacatgcacatggaccaccttgaaggttacggaaggccaacgaaggttcacattggtgatcacatcgccttccgcacgtgcctgaggtgcgcaaatcaggccaatagtcttcggaaactccgggagaggcagtttgtgatcggcatcgaacaggccctcgcccttaagctgcttgcgcaattcgtcgatcatggccttgaggctgccaccggctccgaccttgagaatcgtgtccccgcgcaacgacagcgaagtgcgcttcatccacaggttcggtttgccgtgaatcaccacgcggtcgccctgaacgaactggctggctgcggccgcgaacctgccgaagccattgacttccatggcgatatcctcgaagtcgtcgcgcagcgtgatgtaggccgagccggcgcgacgggtattgatctgcgtgatctggccggtgacccacgcggacggccatcgttccacggcaccgtagaacttctggctcagcacgcttaccggccacggattttgcgcggtggtttcagcggcgcgtgcaggcagctgatcgatagggcgaggctcattcggcagattgatggcgccccaatcgggcgcgaaagtgccttgacccggctcaaagccagacgaggccagtgaagcggcggtcggtggacggccggtagatgagtagcccattgcagtagtcatgcactccactataagtgcgttggttgatgacggtaaaaatttaccgtcgcctgaaaacggtgtgatgatgaatgcaagaaccgtacgaagcgatgtatcagccgatgatggagatggtctggtgcatcagaagaaaggagtcattatggcgaagaaacgggtgctatgaagaggagtgagatatgcgttgcactgacgattgagagtcgtcagtgagctcgctgtgcgacacgcgagcagaaaacagttacgctaatcacacacttgtggttttggcgaaaaatagccgaaaaaccctataaatagttcgacacgccactgttgagcactagatataggggtggggatgccgtattcttctagaggttcaagaaaacgatatcaatgtaatttcgtgtggcccacgtcgagtgcggccaaaatgcggaactcaggagagtgttcgccttataggaaaggggtgcccgatgggcgcacaggtgctggaggaaaccgtcaccgataacgagaccaaggtggccgccaaggcctccaccgtgctcgttgagaagcgtgatggtcgtgtggtcgacttcgaccccatcaacatcatctctgcggtcaagtctgctttcggcgacctgaacaaggaagtcggccccgaagaagatgccatgatccgtggtttcgccaaccaagtcgaaggcgaaatcaaggggcgttacaccggccccgccaaaatcgaggacatccagaacctcgtagagcacgccctcattgacgcccacctgtacgatgtggctcgcgcctacaccaattaccgtctcgacaaggacattcagcgtgccaaggccactgatgtcaacgaggccgttgctcgcttcattaatcatgacccgaccctgattcacgagaacgcgaacaaggattccaacgtctactccacccagcgtgatctgctggccggtgccgtgtccaaggccgccgcgttcaacatgctgccgccggcggtgtccaacgcccacatgaagggcgacattcacttccacgatgccgactattcgccgttcactgcccagtccaactgctccttgccgaacttctgggacatgttggccaatggcttcactcttggcaacgctccgatggcttccccgaagtccatcgccattgcggccacccagattacccagatcatgaaggacgtggcctccagccagtatggtggccagaccgccaaccgtgccgacgagcatcttgcccagtatgccaagaaggattacgagaagttccttgaggaagctcgtgagaccatccccgacggcatgccggttgaattcgcccgtcgtcaggtcgagagcgccaagaagaacgagcccgccaagctgcatttcggttcccgtgaaccgctgccgatggacaccccgttccacaccgacgttgacgaacttgagcaagagcgtgaaatcctcgccaagattcgtacccgcaaggccatctatgatgccatgcagaccatggaataccagatcaactccaaccgtgtgtccaacggccagaccccgttcgtgactgtcggctttggtctcggcaccgactggttctctcgtgaagtgcagcgcgcaatcctgctgaaccgtattcgcggcctcggcaaggaacaccacaccgccatcttcccgaagctcgtctttactgtgaagcacggcgtgaacgccgacccgggtgacccgaactacgatctgaagcagcttgccctcgagtccgccaccaagcgcatgtacccggatgtggtgttctacgagaacatcgtcaagatcacaggctccttcaaggctccgatgggttgccgctccttcctgcagggttggatcaacccggagaccggcaaggatgaagaagacggccgtatgaacctcggcgtggtcaccgtcaacgtgccgcgtatcgccatcgaatcccacggtgacaaggctcgcttctggaagctgttcgacgagcgtatggaagtcgcccatcaggccctccagttccgcatcatgcgctgcaaggaagccaccccggtcaacgccccgaccctgttccgctttggtgcgtttggtcgtcttggtgccaacgacaacgtggaccagctgttcaagaacgagcgtgccaccgtgtcgctcggctacatcggccttgccgagaccactgcggtcttctatggcaagaactggattcgcgaccacggctgggatccggaaggcaaggagttcgcgctgtccatcgtcaagcgcatgaacgagctgtgcaagcagtggagcaaagcggagggttaccactattccgtgtactccactccggctgaatccctgaccgaccgcttcaaccgcatggaccgtgaaaagttcggccgtatcgaaggcgtgactgatcacgacttctacaccaactccttccactacccggtgtggttgcagcccactccgatggagaagctcagctacgagaaggacttcccgtactacgcttccggcggcttcatcaactactgcgagtacccgtgcctgcaggacaacccgaaggcgctcgaagccgtgtgggattacgcctacaacatcggcatcggctacctgggtaccaacaccccgatcgaccactgcttcgtgtgcggcttccagggtgacttcgagccgaccgaggaaggcttcaagtgcccggagtgcggtaactccaacccggacaagtgcaacgtcaccaagcgcacctgcggctatctcggcagcccggtccagcgcccgatggtgcacggccgtcacgaggaaattgcccaccgagtcaagcacatgagcggcgaaaccggtcgtgtgacgctggatgacggaaccactcgcgagtggttcgaagagaccaagtagggtttatacttgctcccgctgacgggagctgtagagcgtaagcgagactgagggcggtcatcctttatggtgttgaccaccctcagtccgtctgatgacggacagctcccgccagcgggagctaatgctttccgtaaggagggaatcatgccggagctgcatacgaccaagcccgaacccaagcgccatgactttgcggccggcgagaccgggcgtggcccctccgtaccctccaacggtcttgccaacgatccgaaagccggtcaatgggatggccggcgcatgtccaagcggatgatcgccgactacaaaaccttcattgtcaccgacggagaaggcgtgcgcaactccctttacgtctccggttgccccttccactgcgtcgactgcttcaacgcctccatctgggatttccaagccggccacgaatacacgcaaaaacttgaagacaaaatcatcgaagatctgaaagccccatgggtgcaaggcattacgttccttggtggcgagccattcctcaacactcccgtgctggtgccgctcgcacaacgtatccgccaggaattcggtcataccaaagatatctggtcgtggaccggctacacatgggaagaactcatgcgccccggagaaaccccagacaagcttgaattgctacatctcatcgacattctcgtcgacggccgctacctcagagaccagaaggactcgctgctgcaattccgcggctccagaaaccagcgcatcctcgatgtgcccaagtctctggaagccggcgaaccggtcatctgggccaagctccacgatcaagaacgagatatccccgaaatctatttgaaagaccgcgaagccggcgaaggccaacaggcctcgtagtagcagttctggaatgccgcactcagcaatatcgttggaactgttgggaaaaggccttcccgtgagcgaaatcgcctcgcctcgtgccatgttgggcaggtggtcggactaatattccataagaagtagccgggcgaagccgtccgcagggtatctgccagccgtcccgaaacggttcatgatgcctcaaagcgtgcactcccggaagtcggaattaagaggaacacatggttgacatcgccactgacgcgagcgtaaagcccgcttcacacccgaagcccctgcgtgtgggattggacatcggttccaccaccgtcaaggccgtggtgcttgatcagtccgattccctgggagacaccctcttctccgattaccgacgccaccacgccaacgtgcgtgccaccgtggccggcctgttggtcgacatccacaagaagcttgtggacctcggacgcggcgacgaaccgattcgcctgtctatcaccggttccggcggtctggcgcttgctgacaatctgcatgtgcctttcattcaggaggtcatcgccgaaaccgaggcaatcgacaaggaatacccgcaggccgatgtcatcatcgagctcggcggcgaggacgccaaaatcacctacctgaaacccacgcccgaacaacgcatgaacggttcgtgcgcaggtggtaccggcgcgttcattgaccagatgtccacgctgcttgacactgacgccgcaggccttaacgagatggccaagagctacgagaacctgtatccgatcgcttctcgttgtggtgtgttcgccaaaaccgatttgcagccgctcatcaacgatggtgcggccaagcccgatttggccgcctccatctttactgcagtggccacgcagaccatcgctggtctggcttccggacgcccgattcacggcaccgtcatcttcctcggcggtccattgttcttcatgtctgaactgcgcgccgcattccagcgcgcgcttgagggcaaggtcgacgaattcatcgtgccgaccgacgcccacttgtacgtggcctacggttcggcattgcaggccgacgtagactccgacgatcagggcaattatttcgaggcccacacgtgcgacgatatcctgaagcgtctggacgagctgaagaacctgccttccaacacgcctaccatgccgccgctgtttcccaccgaggccgatcgcgaggacttcaacaagcgccaccacaaggaacacatccacatcggcacccttgaaggcgcgcacggcccgcacttcctgggcatcgacgctggttccaccactattaaggccacactcgtcaacgacgaccgtgaaatcgtctggtccagctacgccaacaacgaaggcagcccgctgaccgccgccatcaacatcgtcaagaagattcagtctgagctgcccgaaggcgcgtggatcgcacgctcctgcgccaccggatacggcgaaggcctcatcaccaccggcctgcacttggacgagggcgtggtggagaccatggcccactatcgtggcgctgaaatggtcagccccggcgtcaccgccgtcatcgacatcggcggccaggatatgaagtacttggccatcaccgatggcgttatcgattcaatcgccgtcaacgaggcctgctcgtccggctgtggttcgttcctgcagaccttcgccatgtccatgggcctgacgattcaggaattcacgcaaaaggctctggcttccacccatccggtggacctcggttcgcgttgcaccgtgttcatgaactcctcggtcaagcaggcgcagaaggaaggcgcctccatcgaggacatcgctgccggcctgtgctactccgtggtgcgcaacgccctgtacaaggtcatcaagctgcgcgattccggcgaactcggcgacactgtggtggtccagggcggtacgttcctcaacgacgccgtgctgcgcgccttcgagctgctcaccgaacgtcaggtcacccgcccgaacatcgccggccttatgggcgcgttcggcgccgccctgaccgcccgcatgcactacgaggacatcgcggacgacgacaacgcgcacgtcggcgcggacgggcgttccgtcgacgcggcggcggctgaggagtccgccgccggcgacgagccgaacgccgccgcgcacgccggcgaaatcgtcgtcgacggcgtgcgccacaccgtctcgtcaatcctcaccggcgaagccctcaacgaaatgtcgatgaccaccgaacgcgacgtgtgcaagctgtgccagaaccactgcaagctcaccatcaccacgttctccgacggctcccgcttcgtgaccggcaaccgttgcgaacgcggcggcgatgccaagaagaaacgctccgaccgtccgaacctgtacgactacaagtacaagcgctgcttcgcctaccgccgcctcaccgacaagaacgccacccgaggcgagattggcattccgcgcgcgctcaacatgtacgagaactacccgttctggttcacgctgctcacctcgctcggtttcaaggtgatgatctccggccgttccagccacgaactgttcgaaaccggcatcgaatcgattgcctccgagaacatctgctacccggccaagctcgtgcacggccacatcaaatggcttctcaacaagggcatgaagacgatcttctacccgtgcgtcagttacgaggacaacctcgtgcccaacacggacaaccactacaactgcccggtcgtcgccaactatccgctcgtcgtcggcgcgaacatgcccgaactgcgtgaccccgacgtgcgctacatgcacccgtacttcaacctcgccaaccacgagctcatggtcgaccgtatcgtcgaggagttcgcatgggcgagcgtcagccgcgaagaggccgaaactgctgtcaaggccgcctacgccgaagacaaggtcttcaaacacgacgtccagcaggaaggcctcaaagccctcgcctacatgaaggagcacgactgccgcggcatcgtgcttgccggacgcccctaccacatcgacccggaaatcaaccacggcatccccgaaaccatctgcgcgctcggcatggtcgtcctctccgaggattcgatctgcgaactgcagccgggggagaagctcgacctgaccgacttcctgtccgaaggcgaagaggacccgcgcaagaagaacgcgaacggattccgccacgtcgacgaccgcaaggtcaccgtcaaccgcatgccgttgcgcgtcaccaaccagtgggcctaccattcgcgcctctacgcggccgcgcacttcgtcgcctcctatccgggcctcgaactcgtgcagctcaactcgttcggctgcggcctcgacgccatcaccaccgaccaggtggccgagatcctcgccgacaaggccgacgtgtacacgctgctcaagatcgacgaggtctccaacctcggcgcggcgaagatccgcctgcgctcgctcaaggccgccgtcgaggaacgcgaggcgaacaaggcgcgcatggccaaggccgcgctcgccacgtccgacgagtccggttccgccgagtccgacgccccgcgcaacgcggctcacgccgccgcgcaggccgccgcccgcaaggcgcaggagcaggccgaatccgatctcgccaccgcgcaggccgcgctcgccgaagcgcaggccgccgtcgccgccgccgaagcgaaggttaaggccgccgacaggcccgtggacgcggccgatgccggcagcgacgccgccgcccccgcgaacgcgccgaagtccaccggattccgcaagaccggctccaaggcgcccacgccgggccgtcaggtcctgctcgacgcgacgatggccgcgaacccgaagctcaccaaggcgatgcgcgacgcgtccaagcgcgccgcgaagcgcgacatcgccgatgtgcgtctcgccgcgctcggcgacggcaccacgaacgatgccgcgaacgccaagtcgaagtccgcgaagtcgaagtccggccacaacaacgcgaccatgtcccgttacgcgcaccgtgagaagttcgtcaaggacatgaagaaggactacacgatcgtcgccccgcagatgagcccgatccacttctccctcgtcgaatcggtgatccgctccggcggctacaagttcgacatcctcaagcacgcctcgcgcgaagacgtggggactggcctcaaatacgtgaacaacgacgcctgctatccggccatcatggtcatcggacagctcatcgacgcgattctcgaaggcaaatacgatccagacaaggtgtgtctcgcgattacgcagaccggcggcatgtgccgagccaccaactacttcggcctgatccgcaaggccctgatcgacgcgggttacccgcagatcccggtcatcgcgatctccacgcagggcctggaggacaatccgggcttcaaggtgacgcccgcgctgctgcaccgcaccgtcaaggcgctgatcctcggcgacctgctcatgaagtgcctgtaccgcgtgcgcccgtacgaggtggagaagggcgcggcgaaccgcctgtacgagcagtgggacgtgatcgtgcgcgaggcgctcgaacaccacggcttctcgaagacggccgcgaagaccccgtggctcaagcgccgctacctgccgtaccccgtgctcgcccgagagatcgtgaagagcttcgacgctctgccgttgaaggacgtgccgcgcaaggtgcgcgtcggcgtggtcggcgagatcctcgtcaaataccagccggatgcgaacaaccatgtcgtcgacgtcatcgaatcgcaggattgcgaggccgtggtgcccggcatcatggagttcatgaccacgcgcccgtacatcaccgactggaacgagaagtatctcggcaccggcggcaacaagacgttgtacgcgctcatgcgttggagcctcgaccgctacaacgcgccgatcaaggcggccatcgccacctctcacggcaagttcaagcaagacgatccgatgcccgaactcgtcgagaaggctgccgaggtcacgtcgatcggcgtgcaggccggcgaaggctggctgctcaccgccgagatcctcgagcttatcgaacagggatgcccgaacgtgatctgcgcgcagccgttcgcctgcctgccgaaccatgtgaccggccgcggcatgttcggcaagatccgccgcctgcacccggaggccaacatcgtgtccatcgactacgatccgggcgcctccgaggcgaaccagctcaaccgcatcaagctgatgatcgcggccgcgaagaaggcgcacaaggcgaagttcgccgacggcgacgagccgcagggcttcactgccgccgactgacctcaaaccgacgtccaaccgacgcccggtcggcaccagaccggcgcagaccgggcaaaccggtctgcggcctacgacaaggcgggtgtcccattccgtatggaacgggacacccgccttattcgttctggtgcttttcggccggcaccggtcacacccgtcctacccgagcctgcctgccgtgaaccggtacagcgcgtcccatggcaggtcggtcacgtcgatcgcttcggcgcgctggctcacgagctcgtcgtaacgttccgaccgcatctgcgccttcacgttgccgcgcacctcgtccagcggagccttcccgtcgacgccgtcctttgtccagtcgtgctcgtcgtagtagcgtcgcacctcgtcgtcggacaggctcatgccggggttcgactcgtcgcccgtataggcgttcttcaacgcggacagttcgtagctcaggtagctgtcgatgtcgaagccggtacggccgtagacgatgccgccgtccgatttcagttccgcgttgccgctgttcacggcctccatgcgcgcgacgatgctcgcataggagtcgtcggccacctgcccgagatccacgccgatgaggtacgcggcgtgccgacgtcgcagttcgtcgatggcacggctcgcgagccaacggcacgggacctcgccgtcgtgcgccttatcccagccgtcctcggccgggtcgacgccgtacgtctgccgaaagtacagccgcgccgcgccgtgttgcgccttgagcgccgcgacgtactccttgcgttcgatgacggtgtcgccgaagacgatggtggggaacatgtcggaatcctcgcttgcattggagccggtatcggagccgatgccggcggatgcgcccgcgcccgcaggcgtgcctgcgggcgcgaaggcgccgtcgccgtgcgtgacgacggcgacggtcaatgtgacgagcaggaccgccgccaccgcgactgcggcgatggcggcggcgaaccggtgcctacgtggcatcggtcacctgcggcgacgggccgcggcggccagtccgatgccggcggccgcggtcagcgcgaccatcgcggccgcgccggccacgtcggcgccggtggcggtcagcttgccgccggtggtcgcgccgtcgctgccggaaccggtggaaccgttgccggaaccggaaccgttgccggaaccggaaccgttgcccgtgccggaaccgttgccggaaccgtcacccggcttggtgtcggggccggggtcggggtccgggtcgggcgtcggatcgggatcggggttcggatccggtttcgggttcgggtccggatcgaccggcttcttctccaatccgtcgatggcgtcacgcagtgcgttctgcgcggtctcgacctgttcggcggtggcggcatcgtcgtccagcacggtctgcgcggcgtcgcgcgcggcgacgagcgcggcccacgactcatccgtgtagtccgactcggccaatcccagagcctcctcgaccgtggccttcagcgtggacttgtccaccggaacgggttcggggcccggcgtggaggcggccatgtaggcgatgaccggggagatgtgcgcggacggcttgttcatgccggacacggacgtcgcggtgacgcggatccaatcgcccgcctcgaccgcgatctcgcccttgtcggcgacgcagttggcgaactcctcggaacgctgcttggagacggtcaggtcggcgaagcacaccaccttgtcgtcgtgcatgagacgaagcgtcaacgccttgccgttgctgccgtcctggcgcaggtacggctcgtcctcgcggatggacaccttcaccgtgccggccttcggcgccttccacgccatggcggagccaccagcggacgcgggcgaatcgctgatcaggccatggatggcggagcggtcggtgggcaggctgtggttcgcgtagtccacgcccggaccgtagtaggtctcgtacatccagttcggatacgtcgcgtcgaagtcggcgatatccgaccacacgccgtcggcctcggtctgacgctgcccgtaccagatcggaccctgcacgcgcacctggaagtcgttcacccaatcccacgtggtcttcgacttcaccacgtagtcgtcggacacggtggaacctttcgcggagaagcggagcacgtcgttctcggcgagttctgcgccggcctccaaccgcacgccgtcacggtacacgcccttatcggcgccggacggttcggccgtcaccttggcgagcagctgcgcgacggtcatcggactgtcggcggagaacggcgcgtagacgacgttcacaccgtcgacagtcgcggtctccaactcggacgagccgagcgcggcgggcgcggtcacctcgaagcgggcggtggaggagacgctggcgccgtcgtcggcgaacgtcaccgtgacgggcacggtgacggtgccgccgaccctgctgttcagcgtgaccgtgccgttcgccatgtcgacactcgcgccggccggcgcgttcgcgccgagcgcgaacgtcgtgccttccggcacagacgcggccgcgccgtccgccttcagcgtgaacttcggcgtgcgcttcaggtccgtgccggcgtcgccgcgcacggtcgggtacagcacgttgagacgctgcgcgtgcgattgcgcgacacggaacgtgacggtcgtctcgtcgctcgaaccgtccgcgtacgtgacgacgacggtgcgggtgacggtcgcgccgtactgtccggcggcgggcgtgaaggtgacggcgccggtggacgcgtcgatgacgggcgaggcctcgccctcatcgccgccgtccttgaaggcgaacgcgacgccgtccggcgcgtcggcctcgccgccgtccgcggtgaacgcggcggcgacggccgactgcgtgccgacgacggcgtccgtcgcggcgtacgagacgtcgtagcgcacgttctgcttcggcgcggcgggcgccttgtcctcatatgtgatgaccgggctgatgtgcagcgacggcgccttgactccggtctcggcgtcggcgacgatgcggatccagtcgccttcctgcacgtcgatcgaaccgtgctcggcgaggcactgcgcgaactgttcggaggacttctgatagacggacaggtcgtcggccgaacagagcgtctcgtcgttgcgcatcagcgacaatgtgaccttcttgccggcgttgtccgcgttctgacgcaggtacggttcagcgatcttgtcggcgaacgtcttgagcgacagcatgacggtgccggactccggcgccttccatgccatggccgtgggcaggccgtcgccgggcttgtcgatcagcaggccgtgcgtctgcttgcggtcgccggagagttcggcgagggtgccgttgacgccgacaccgtagtactggtcgtacacggtgttcggccacgagccgtcgtatgcggagatggtggtccactcgccgccggcggacgtgcggcgctgcgccttccagtcgaagtcggcgacgccttgctcgtagtccgcgacccaatcccacgtgatgcgctggcggatcgtgtactcgtcggtctcgtccgtgccttcggcggagaagcgcaggatgtcgccatcgcggaccggttcggagtcggcgagcttcgtctcgtcgtccttggcgttccggtcggagcctgggagcagggagagcaggcggtcgagcatgttcggttcggactcggcggacctggcgtcggcggacttgccggacttggcgtcggcgactcggtacacggccttgtccacgcccttgtcggcggacacgttggagagcagttccttgacggtcaccgggttcttgtcggtgaaggtcacgtggatgaccttggtcttgtcaccggtcccggaatcggtttcggttccggtctcgtacttggaggaggccatcgtgacggacaccacgtcgctttccacggcgcccagatcgggcctgcccttgactgcgttgccgaggaagtcgttctccaccgcgtagtcgttgaggtcggagacgaccttgccggcgttgatcgccttcgagcccgcgaccggacggtagccgtcgaacgcggctttctcgccggtgcgcgcatgctcggcgccgctcttgagggcggatgtcggagccgaaccggcgcccgcaagcactgcggacacgtcgtcggcctcgatggcgttggcgtcggaggtgggcttgttcgcgtagttgacgtacatgttgttgtcgtacgtctggccgccgttctggctgccgcggttccaggtctccgtcttcttcgtgttggtcgcgttgatgaagatgttgttctcgaacagggactgcgagttggaacgcttagtcagcacctggctgtcggcgtccacgtagacggtgttgttgtagatgtggttgccggggccgttcgacggcaggtcgaacacgccctgacggtcgttctgcgagatattgtatcggaacgtggtgttaaccgcgtaccagttgcagatcatcagcgaggcgaagctgttgccgtacgagtagttgtactggtacagcgtgccgtcgccgtagtcggcgtcccacgcctggccgtcgccgttgccgtgctcggcgttgaggttgttgtacatctcgttgtactggaacactggatccttgcaacgccacggccagatgccggccgccacgcgtccgccgtaggagccgggctgcgtgtagtcctgcgtgttgatgtgcttcgagacgctgtcgcccacattgtgttcgatgaccgggcggtcgcagtacatcagggtgatggcgtcgccgccggcgcccttgacgtagttgttctcgatgcgcacgttggtggaaccgtacttcgcgatgagggcgtcgtcgatggagccgtcgccgtagttcgcgtcgatgtagttgaggtaggcggtgtagccgacggcgatgccccaacgatccacgtccttgacggtgctgtttctgatggtgacgtggtcgaagcgtgagacgtgctccctgagccagacgtcggtttcggcgctcgtgttctccatggggtagtgggccatgaagtagatgccgccgttggccatgtgcttgttgtagatgttgccgtccacgtcgtggatgtaaaggttgtcgagcgtcacgttgctcatcgtcgcgccgttctcggcgatgccggccacgccggtgcggtccatgcgcgaggcgctgcggtcgagttttgtgccgtcggaatcaggggtgtcggtccacttccacgtgtcgatcggatcgtagacgtccgcgtcgtcgttggtgatctccaggttggagacggtgatgtacgacacgtccttgagtagcagcgtggttgagacggtgcccttgttcttgtggttgccgacgttggcacggtagtcctgctcccactggctgcctttgacgccgttcgacgcgatgaccggcttgccttcgtcggcgtcgccgtaggcggagatcgtgatcggcgcgtcggcgttgccggcggtgtccttgatgtgcaggtactggtcgttgaattcggagccgtattccagcagcaccgaatcgcccggaccgaggtccgaggcgatgtcgttgaccttggtcagggacttccagggcgcgttttcgctggtgcccgcgttggcgtcgtcgccgtgtgccgacgacacgtagtaggtggtgcctgatgacgtggtcgtagcggtctcctttccttgcgttgctgactgcgcgaacgcagcggtcggcaacgcaagcgcgacggccacgcccattgcggccgtcgcggctatggcttgtctgccctgacgggatgtcatgccgctttccttcctttcgattgtggcgcaccggcgtgccggtggggtgccgggcgtgtccgatatgtcctcggtccgtttccggtatggccttcggcgtggtttcggtgtggaaccggagcggtcgccggtgcgcttcggtgtgcgttccggtgtgcttccgacgtgcttatggttgccggtgttttgtatgggttgttgctgttttccgtgttctgttgttttctgttgtttttcttttattccggctgttcgccgtgggttgatggtgggttgatggtgtggtccggcctctctgccggacgtttctgtaaacaaggtttacaaatcaatgagtgtatccgacatcgcgcataacggcaaagccgtacggtgtggcgcggcgttgcggaggcgtggcgtgcggtgatgggggcgtggcggcgcggtgtggtgcgacggcgcggtgcggcgttgcggcgtgatatggcggatgtccggcgacgtgccggttatcggaaaaagatatagccgattcgcgggcgcgcggcgacgcgcgtcgcgcgactcgcctacgataccgttcatggtcactcccagaatcagctatgcgcacctgctcgccgagccgaacccgaagcatgtcgagagccttctgaagttcttcgaggcggggcgctccaagcgcggcaccggtggtttaggtgtcgagattgagcatctgccggtgcatgacgccgacgacacggccgtaagctactacgagccgaacggcatcgaagcgttcctcaaacggctcgctccgtattatgacgaaagcaaggaatactgggagaacggccatctggtcggactcgcgcgcgaaggcgttgcggtgtcgctcgaaccgggcggccaggtggaggcttccatcggcgtgcttcatgagccgggcgacctcaacggcctgtacgccgacttccggtgtgaggcggacccgatcctcgaggagctgggcttccgtttcgtcaactacggataccagccgaagtcgagtttcgtcgacgtgccggtcaatccgaaaggccgctatgacgcgatgaccgacttccttggccgcgtcggccagttcggtccgtgcatgatgcgctgctccgcctccacccaggtgagcatcgactatgtcgacgagaaggattcgatcgataagatgcgcgtcggcaccgccatcgggccgattctcgcatggttcttccgcaacaccccctacttcgagggccgtctcaacccgtatccgctgctgcgccagcgcatgtgggactacctcgacttccagcgcaccaacgtgacccccggcctgttcgaccagcgtttcggctgggaggactacgcgcgtgacgtgctgtccacgccgctgatgttcgccgacctgacgcacacgcccgaagcggtggaatcggggctgagccgcaaggagctgcatcgcgccgccttccgtgagaacgctggcgaggtctacccggaccgcgagctcaacgcgtacgaaatcaaccacatcatctccacgcatttcaacgacgtgcgtctcaagaacttcatcgagttccgccactgggattcgctgccgatcgaacgcgtcgaacggctcaccgagatcatcgcgtccctgtactacgtgccgtccaaccgcatccgtctcgaaagctacttcgacgggctcaccgaggaagacgtgttcgaagccaaggcgaacatccaggcgcacggccgcgaatccaacccgtatggccagccgctcgacttctggcgtgagttcctcggcctcgagggcctgctcgacgatattcccggagatccgaagcaccccgacgtgttccagcgctgaccgggttccatgccggccgtgattcgggccggagcgtcctggcgggcgttctggcccttgtcgtaccggccgcggcctgccaggtgccgggtgtgtttggtctaggattacgaaaaccccggtcggtggtcggctggccggggtcgcgccagaactccctgttcaccatcaccgccgacacgcacgaggtgcgccacaaccccgaatactacgtgatgcgccacttctccaagtacgtgcgccccggcgcgaaggtgctcggcaccaccagccacttcaactccatggccatcgccttccgcaacccggacggcaccatcgtggtcgtgacccagaacgcgctggaggacgaacgcccgttcgagttcgccgacccggccgacgcctcccgtggcttcaaggccacgctcgccccgcgctccttcaacaccttcgtcatcgagtgaccgcacggaacccagaaaggcgaacacaaccatgaccgcgaccacaccggaaaccacagtcgaaacgctgccctacaagaaccccgacctgcccgcctccgagcgcatcgccgacctgctctcccgcatgaccctcgaagagaaggtcggccagatgatgcagctcgacgcccgcggtggcgacctcgacgagctcatcgtgaacaagcacgtcggctccatcctgcacaccagccccgaggacctgccgcgcgccgtcgaaaccgtgaacaccaagacccgtctcggcatcccactcgtcatcggcgacgactgcatccacggctactccttctggcccggcgccacgatcttcccctcccagctcggcatggcgttgagctgggacccgaaggccgtcgaagcggccggccgtgccaccgccgaagaagtctcctcgaccggcgtgcactggacgttctccccggtgctgtgcatcgcgcgcgacacccgctggggtcgcgtggacgagaccttcggcgaggaccccatgctcatcggtgagatggcctccgccatggtcaagggctatcagggcggtgcccaggccggcgagacgctgccgaaggacgcgatcctcgcctgcgccaagcacttcgccggatactccgagacccagggcggccgtgacgcctccgaagcggacctgagccaccgcaagcttgaatcctggttcctgccgccgttcgaacgcatcgccaaggagggctgcggcacgttcatgctcggctacgagtccatcgaaggcgtaccggtcacgttcaacaagtggctgctcaccgacaagctgcgcggcgcatggaagtacaacggcaccctcatcaccgactgggacaacgtgggccgttccgtatgggagcagaaggtcaagcccgactacgtgcacgccgccgccgacgcggtcaaggccggcaacgatctggtcatgaccacgccggggttctacgacggcgccatcgaggccgtgcacaccggtctgctcgacgagtcgctcatcgacgaggctgtcgcgcgcatccttgcgctcaagttccgcctcggcctgttcgaggacccgcgtctgccggacgagaagcgcatcaaggccgtcatcggctccgaggatcaccgccgcgtgaacctcgagctcgctcgcgaggccgttgccctgctgcgcaacgacggcggactgccgttcgacgcggcgccggccgaagcgatccccggctccggtgacgcgcccgcgcgcaagcgcatcgccgtggtcggcccgctcgccgacgacgcccagaaccagctcggcgactgggccggcagctccggccaagtcggctggatgcccgacggtcatccgcgcggcatgatcaccaccgtgctcgacggcttccgtgcgctcgccggcgacggatgcgaggttacctacgcccgcggtgccaacgtcatcgacctcgtgcccgacccggagggtgagttctacccggacggccagccgcacccgaagatcggagtgagcgcgcccgttgaccgggccctgctcgacgaggccgtcgccgccgcgcgcgaggccgacctcatcgtcgccgtcgtgggcgatgtggtgcagctggtcggcgagacctgttccaccgccacgcttgaactgctcggcggccagaacgcgctgctcgacgcactcgccgacgtctcccgcgagaccggcaagccgatggtcaccgtgctggtgagctccaagccacaggtgctgccgcgttccatcgtgggcgattccggcgtgctcgccggccgttgcaacgatccgaagtccggcgccggatccatcctgtgggcgccgaacccgggcatggagggcggacaggccatcgccgagatcatcctcggcgaggtgaacccgtccggcaggctcccgatcaccttcccgtgccacgcgggccagctgccggtctactacaaccagatccgcggccagcacggcaaccgctacgccgaccttacgcaggacccggcgttcgcgttcggcgagggcgaaggctacacgacgttcgcgtacggtgagccgacgatcgtcggcggggcctcgaacgcggacggcacgttcgcgcagaccgacaccgtgcacgccgagatcgccctcaccaacacggggcgccgcgcgggcaccgaggtcgtgcaggcgtacgtgggcgacgtcgtcacctcatacagctgggccgaccgcgaactcaaggcgttccgccgcgtcacgctcgaaccgggcgagaccgcgaccgtcgtgttcgacattccggtctgcgactgcaccatcgccgacgccgatgcgaaccgcatcgtcgaacccggcgagttcgagctgctcatcggccactcgtcgcgccgcgacgacctcaagcgcaccaccttcaccgtcgcgtgaatctgctctgcgtgagatgctctcgcgtgagccggtcccgtgtgaatcggtttcgtgtgggcctcatatgtttccgcccgctccggtcgtatgctggagcgggcggtgtcgtttgtgcggaacggagcaatgatgcggaatactgatgagagggccatgccggaagacgatgggcgaatcaacggagtgaacctcggcggctggctggtattggaacggtggatgacgcccggcctgttccgtgcgagcggcgaggaggacgagatctggctgcaccggtccacggacccggccgaactggagcgcctgctgcgccgtcaccgcgacacgtacatcaccgaggacgacttccgcgccatctccgcgcacgggctgaaccttgtgcgcatccccgtgccgtttttcatcttcggtgacgtgcccgggcatcccggatgcgtcgaatacctcgaccgtgcgttcgactgggcggagagggccgggcttaaggtgctcatcgacctgcacaccgtgcccgggtcgcagaacgggttcgacaatggcggcctgaccggcgtggtccgctggcatacgacgccgcggcaggttgcgttcgcactggacgtgctcgagcgtctcgcgcgacgttaccgcgaccgccctgcgttgtacggcatcgaagtgctcaacgagccggtcgaccgtctcacttatctcatgtcgccgtcgagctcccgggcgaaggatccgggggaggcgcgggggagcggccacgttccgatgcgcttcctcaaacggttctatcgggcggcataccgatggctgcgcccggtgctgggcgacgggccggtcatcgtgttccatgacggattccgcctgaaccgctggcgcggctggttcgtacgtgagggcatgcgcggcgtcatcatcgacacgcacgcgtatctcgtcatgtcggaacggcccgaggtgctgttccgcatactgccggacgcatggcttatgcgctggtaccggctgttcgcggcgtggggcgcgcgccgcatccgccgtgccgcgcgctttacgccggtcatggtgggggagtggtgcgtggcgaacgggcttgcggcgcgcatgggggagtgcggggcgcaaggtgaggtcgcgtccgttgatgcgtctggtggtgcgttcgacggatatggtgcgttcggtgacggcggtgcggatgttggagacggcgcatccggtgacgtcggttcgcgcgcgggcgacgccggggacggcgtcccgtcgcccgccgcgcgccgccgcgccgtctacctccgcgtcgccgccatgcagctcgacgcgtggaacgtctccgccggtcaggtctactggagctatcgactgcgcggcggtcgcggcgagtttgaccgtctcgcgcctcccgcgcccggtatgggtgacggggacgccgccgtgatggacgacacgcgcctcgacccttgggatctgcggcatgtctggcatgcgggatggatggggtgatggttcgggatgacggtgattgatgacgcggtggcggaggtgatgtgcgagacgcgcgatttacggaagggtcagcggtatccgtcccataagggggaggggaacagcacatcctcgcagtcgacccacatggcgttgagatcgcgaccgggagagcgcagccagcgcagctgaatgccgtccatcatcgacaggcccgcctgaagcacgtgctccacgttcgcgccgtcgggtactgaccagttgatgttgagcgcgttcgtcacgctgcggcgctcgcggtccgcgaaatagtcgtgcgccggatgctttgaatcgagggcttcgatcgcgaaaccctcgacatgcccgccaagcagatcgccctgctcgaacaggtcgccgccgcgaaccagaacgtcgtggtcgtgctgtccaacggctccgtcgtctccgtggccccgtgggccaagaacgccaagggcattctcgaatcctgtctgctcggccaggccggcggccctgcgctcgccgatgtgatcttcggccaggtcagcccgtccggcaagctcgcccagtcgattccgctggacatcagcgatgacccgagcacgctgaactggccgggcgaggaaggccacgtcgactacggcgagggcgtgttcgtcggctatcgctactacgacacctacggcaaggttgtggactacccgttcggctacggcctgagctacgccacattcgagatcgatgacgtcgccgccgccaagaccggcgcgaacaccgccaccgtgaccgccaccgtgaccaacacctccgatgtggatgccgccgaaaccgtgcaggtgtacgtggctccgggcaaggccgacgtggcccgcccgaagcacgagctcaagggcttcaccaaggtgttcctcaaggccggcgaatccaagaccgtgaccatcgacctcgacgagcgcgcgttcgcctactggtccgaaaaatacaacgactggcacgtggaggccggcgaatatgccatcgaagtgggcgtgagctcccgcgacattgccgacaccgttgccgtggccctcgatggcgacggcaagacccagccgctcaccgaatggtccacctacggcgagtgggaggccgatccgttcggcgccaagatcgtggccgccgtggccgccgccggcgaggccggcgagctgacgaagctgcccgacaacgccatgatgcgcatgttcctcaaccccatgccgatcaactcgctgcccaccctgctgggcgaaggcggcaagaagatcgcccagttcatggttgacgagtacgccaagctcgcgaagtaagggctgaagcgaggcaatcgcacggcgtaatacagctggcttccctctcctgaggggagccagctttgtttaggctcaacagttgtttggagatactacaacacgccgattgttgtatgtgcaactgttgtatatgggtctctttatcatgaattgttgcgtatacaacaatgtggggtgaaggtacaaacgcacacggccccgcatggtacggaggacaatggatcagcatattctcagcatcgaaatgcgagcggtgaccaaagccgtcgaccgctatctcggtgagagcatgccgctttccgccaaggagaccaccggcggcaacgcgcatatcatcatgttcctggctcgtaaccggaatcgtgaaatctaccagcacgccatcgaacagaaattctgcatcacccggtccaccgcctcgcgtgtgctggccctgatggagaagaagggcctgatcgcccgtgaatcggtggcgcatgatgcccgttgcaagcgtatcgtcctgaccgataaggcggacgccatcgtcgccgatctcaaagcgaacggcgaacgggtcgaacggctgctggtggagggtttctccgaaagcgagaaagcagccctacgtgactacgtcagtcgcatgcgcgcgaacatcgaccgcgcacaacatgaatttgaacatcaaacactccctcagtcacctgtggtgatggctcccgaccaagacggagcggaggttgctaacacgaaggaggagaacgaatgagcgataccgcagaggcaatcgcgcaggcgcgcaaagccgtcgaaccggacaagcccaaacatgtactgcgcacgctgggccattcgattcgtgaatacaagaaagccagcatcctggctccggtgttcgtggcggtcgaagggtttctggaaatcctgattccgaccatcatggcttcgctgatcgatgagggtatcaccggtggcagcatgccggccaccgtcaagttcggcgtgattctgctggtgtgcgcgatggtttcgctgggtgccggcttcttgtccggaaagtacgcggccgtggccggcgcgggcttcgccaagaacctgcgcaaggaccagttcgagaaggtgcagggcttcagcttcaccaacatcgaccggttctccaccggttcgatcgtgactcgactgaccaccgacgtgacgaacctgcagaacgcctacatgatgatcattcgtctgggcgtgcgtgccccgatcatggtggtcgtggcctggctgttctcgttccgtatctccccgtcgatttccatggtgttcctggcctgcatcccgattctggccatcggcctgtgcggtctggccgtgctcgtgcatccggtgttcgagcgcgtgtttcacacctacgatgcgttgaacaacgtggtcgacgagaacctgcagggcatccgcgtggtcaagtcctataaccgcgaatccttcgaggtctccaagttcggccgcatctcccagcgcatcttcaaggacttcaccaaggctgagcgcatcatgagcttcaacagcccgctgatgatgatctgcatctacggttcgatgatcctcatcgcatggatgggcgcgcagcagatcgtcgcctccggcaacaaccccgccgtgggcctgaccaccggcgacctgaccgcactggtcacctacgccatgcagatccttatggccatgatgatgctgtccatgatcttcgtcatggtgattatttctcaggcttctgccgagcgtatctgccaggtgctgcaggaggaaagcacggtgcagaacccggcacagccggtgactgacatggccgacggctccatcgaattcgaccatgtcaccttccgctactccgacagttccgaaaagcccgtgcttgacgacatcaacctgaagatccgctccggcatgaccgtcggcattgtcggcggtactggttcggcaaagtcgtctctggtacagctcgtgccgcgactgtacgacgtgagctccggttcgctgaaggtcggcggcgtggatgtacgcgactacgatctcgaggcgctgcgcgatcaggtggccatggtgttgcagaagaacgtgctgttctccggcactattgccgaaaacctcaggtggggcaacccgaacgccaccgatgaagagattcgccatgccgcgcagctcgcgcaggccgatggattcgttcaggaattccccgataagtacgacacgtacatcgagcagggcggtaccaatgtgtccggcggacagcgccagcgcctgtgcatcgcccgtgcgctgctgaagaagccgaagattctgattctcgacgattcgaccagcgccgtcgataccaagacggacaagctgatccgttccgcgttccacaacgagattccggacaccacgaagatcatcatcgcccagcgcgtggcctccgtgcaggaatccgacatgattctggtgatggattccggccgcatcatggcgtccggcacacacgacgaactgctcgtcacctgcgatgaataccgttccatctacgaatcccagaccaagaaccaggcccagcccgaagaactggctgctgccgaacaggctgctgagtcatctaccgctgagccgtccgaaaccgtgacggtgacagtgcccatgcccacggccgataccagcgcagctgataccaatgcagccgataccaaggaaggagaagcacgatgagcaacgaccagagtttcaagaaccgcaagcccgccatgggcaaagccgagcctggcaccatcaagcgcatcttcagctacatcttccagtacaagtggcgcgtcatcgccatcgtggtgtgcatcttggtcggtgccgccgcgcaggccggttccgcgctgttcctccagtcgctcatcgacacgtacatcctgccgatggtgggggagtcgaaccccgactgggccccgctgctgcgggccatcagcctgatggcgtgcctgtatgtggccggcatcgtggcgtcctggctgtggcagtggctgatcgtcaccgtcgagcagggcacgctcaagaagattcgtgacgacatgttcgcccaccagcagaagctgccgatccgctacttcgacagccacgagcacggcgacatcatgagccactacaccaacgacaccgatacgctgcgccaggccatctcgcagtcgttcccgcagatgttctcctcgattatctccgcggtcgcggcgctgctgtccatgctgtggctgtccattccattcaccgcgttcgtaatcgtgttcaccgttctgctctacttcatcgtgcgcaagatcgtgagccgctccggccgctacttcgtcaagcagcagcagtggatcggcgacgtgaacgccttcgtggaggagtccgtcaatggtcagaaggtcatcaaggtcttcaaccatgaggatgccactcagaagaccttcgatgagaagaacgaggaactctttgaggcgtccgccgaggcgaacacttggggcaatgtgaccatgccggtcgtcggcaatatgggctatctgctctacatcctgctcgccatcgtcggtgccgccgtttcgctggccggcgtcaatgacatcggtctgaccggtgtcaagccgctcaccctcggcacgctcgtctccctgctgaccttgtcccgctcgttcatcaacccgatcggccaggtctcccagcagctgaccatggtgatgatggcgctcgccggcgcctcccgcatcttcaagttgatggacgaacccatcgaggaagacaagggcaccgtgacgctcgtgaacgtggaacttgggccggacggccgcaccatgaccgaagtcgaccatgagaccggccactgggcgtggaagcgtgagatcggcgacgatggtacgaggtctctgaaggccgccgaaaagctgcgcggttccgcctgcgaggtggcgatgaaggccaaggagcaggcgatcacctcgcctgatgggcgttatacgctgctgcgcggcgacgtgcgcttcaccaacgtgaccttcggctacaacccggacaagccggtgctgcacgacatcacctggttcgccaagcccggccagaagatcgcgctcgtcggcgccaccggtgccggcaagaccactgtgaccaacctcatcaaccggttctacgatatccagcaaggtcagattctgtatgatggcatctccgtggccggcatcaagaagcctgatttgcgcaggtctttgggcattgtgttgcaggacgtgaacctgttcaccggtaccgtgatggacaacattcgttatggccgtctgaacgccactgatgaggaatgcattgaggccgcgcgtctggtcaatgcggacagcttcatccgtatgctgcccgagggatacaacacggtgcttgagggtgatggatccggcctgtcccaaggtcagcgccagctgatttccatcgcccgcgccgcggtggccgatccgcccgcgctgattctcgatgaggccacgtcttccatcgatacccgtaccgaggaagtcgtgcaggccggcatggataacctgatgaagggccgtacggtcttcgtcatcgcccatcgtctgtccaccgtacgcaactccgacgtgatcatggtgctcgaccacggcaacatcatcgagcgtggctcgcatgacgagctgatcgcgcaaaagggcgagtactatcagctctacaccggcgcggtggagctggagtagtcggtacgcctgcaaaaaccgcacctcgattatcgggttgaagtaattcttatccggtagttgggggcgcggttttctatgttgagagccgtgtgttggcgcaggattgcgaatattggcggtatttgctgcgctcattgccatttgcttctcgttccccggagtcggcatgattattgcctcgattgtattcgctgtactgtttgtgctgtggatttggaaaggcaagaatccgttcctgggtcgttctttcgtgaccaatggtgcgtatatgtccattctgctgctgcaatttgtgctgtacttcttcaactttgcttgtgtgccgatttacaacgtgattggtgagcagatctacaacgtgccgttgaccacggtttcgctgtgtctaacattggtctacattgtggccacaattgttggatgcgtttctggtccagtaatcaacagactcggacgcatgcgcacactggttatcgctatcgtgctcatgattgtcggcttcgcaggatctgccatattcattactgagaagtgtggagtattgccggccgtgaattggtgcagacctaacacgttcatttaggcgctatgcagtgtcgaatgttctcggcgcggattttacgaagtattgtcagcaaatgcatcaaggcaatggcggcggtctgggcgggactacggccacgcataacagtatcgagtactcgaatgagtcctatgacgcgaaaactcggaccgtgacgatgcatgccgttatcgactggagtgatccgtaccgattcggggattcgaccggcagttttactgcgccgggcatcaccgttgtctttgacaagtccgggaaaatccagcgcattgactccacggtctggggattcccgcctgcccgataattatcggagggcctgaaacatgcacgttctcatcagcgctgcgggtcgacgatgctgcaaccatacggcgtcatacccgcatgacgtgagttacactatgtagtaaagttatttactgaaatactgcgtattgttacgtactgaggcgtggaaggctcaactatggtcacgatgaaggaaatcgcacagaaatcaggcttctcgcaggccacggtatcccggctgctcaatggggacccgacattgtctgtcaaagaggagacgcgacgtcgcatcatcgaggtcagcgagcagcttggctacgctaccggatcacgccgtatcgcattgccacgccgtgtggccgtactcgacaacgccacccgcgaggaagaactggcggacgcctatttcgatgaactacggtccgtgctcggcgacaatgccagagcccagcacatggaactcacgtcgttttcccatatcgacgatctgattgccgacgccggtgatttcgacggcttcatctccatcggaccgtccgtactctcttcggatagactgttgaagctccatctggtattgccctatggcgtattcatcgacatcaatcctgcgcccagcctgttcgattcggtacaaccggatttaagccaaaccattttggacgcattggatatgttggtgtcctcgggcaaacgacgcatcggctatatcggcggcgccggcttcacgatgggcctgcacgaataccccgaagacggccgattaaccgcattccgcaattggaccgagcgtttggggctggatgcggaaggcctgatttacgcgcaaggcgcgttcactgtggacaccgggcgcactctaggggaggaagcggttaacgatcatcgagatgacatgccggatgcgttcatcgtggctgcggactcgattgcagtcggcgtactgcaggcgtttaccgctgcgggagtgctggtgcctcgcgataccagtgtgatcagtatcaataaccaggccatcgcccagtacacttcgccgacattgaccagttacgatatcgaccagaatgagctggccgatactgcgattacgatgcttgccgaggccatctccagtcggcgcacgctgcaccaccataccttcatctccaccaccctagtggtgcgtgacagtttcgtaccagcacgataaagaagctccctctgtgcgataaagaagctccctcgtcagagggagcttctttatcgctgttagaacagttccagattcacgtcgagcgtgtaggcgcgatcggcgggcagctggtactgctcatggacgggcgcgccccatgaatcgtctccgcccacgcccatttgcgcggccaacaggcgcaggaacgtgtgacggaccggcggcaactcgttctggtgggtcgcctcttccagcatgagcgagctgtacggcaacaggctcgccgcgaaatgttcgctgccggcctggctgatacgcatgccgtgtccttgggcgtcaagcacttcggcccaacgcaagtcttcatggttgccggtctcctgcggcaccagatacggtgcattgtcttcggccgcggtgcgctcgaaaatgccgagcttgccaccgtgcagacggtcgtgataggtttcctcggggccaaggccgtagaagcgcaggttctcgtactgcttgggaagtgtccattccaatccgaatgccggcagcgtcggcgcatcggtggcaccggcatatcgggcggtcagatgtacacgtccgctggcggcatccacctcatagcgcacggcaacttgggtttcgcccggttcggccaacgtatgacgaatgccgccaacgggcaccaacctcgttgacggcattcgtctttccaggacaccgcaatcgcggatgcatgccgtttacgcgttgaatacgtattggtcaaggcggcgcatggcctccttgacgcggctcaagggcaatgcgagattgacgcggatgctgtagggggcctggaacatgtcgccgtcctgccatgcgacgcccacatcccagccgcgtttctccaactcgggcaggctcaggccgtggcgttcgcaccactgctcgcagtcgagcagcagcatgtaggtgccttccggtttggccaaactcactccttggaaatgcttggtgatgtagtcgtaggcgtaatcgacgttgccggtgagcaccgccttcagttcgtcgagccactcatggccttcgggccggtaggcgccgatcagcgcgtgcatggaaagcacgttcatgtcgttgtagtggcatttcgagcttttggccacgatgcggtcccggagtgtgggattgtagatgatgtggtagcttcccaccagtccggcgagattgaaggtcttgctgggcgcgtagaacgccacggtcctgttgcgtgcgtcctcgctgaccgattgggtggggatgtgctggtggttccccagagtcaaatcggaccaaatctcgtcggagatcaccacgcagtcgttggcccggtacacctccatggccttctcgatctcccaacgctcccatacgcgcccgcaaggattgtggggactgcagaagacggccacatggatgtgatgctccttgagcttcctgtccatatcctcgtaatccatgcgccatacgccgcgctcgtccagcgtgagcggactgtggacgatgcggtagccgttgttttcgatgctccgggtgaacccgatataggtcgggctgtgcagcagcacgccgtcgccgggggcggcgaacgcggtcagcgcactgatcacaccgcccaggaccccgttctcgtagccgatcgcctcccgggtcaatccggtgaccccgttgcgcgtggactgccagtcgatgatggagctgtaatagtcgtcggtgggggagaagtacccgtaggcgggatgcttcgcccgttcgatgatggcctgcgggatcgtgggcacggtcgggaagttcatgtccgccacccacatggggatgacgtcgaaaccctcgcgtggcgggtccggcgcgaatcccgggtcggtgcccagtccgtcgaccgcgatcgaatccatgccatgcctgttcatgatggacgtgaaatcatacgtcattgtccgacaatcctttctcggtccgtggtggccggtcccaatctaaatcgggctcctgacggtgccgtggccgtgggcggcgatttgaccgcgtggcgtgttaggatatgcaccgttgtgaggcagtgatccgttatcagcggggagtcttcggaagaacggcggcaatcgcccagtagaaccgacgggatcggcccgagacagccgaacacaagcggtcgcgcaggctcgcggctccgagtgcaacagttcggagcggcgcaaccggtgcgataagcgaggtggtaccgcggtgcggagcgcataccagcgctcgtcatcgtcctcgtaggcaggaacggcagacatggctgttccgggcggaacacagtcggttccggctgcgaggcgattgactaatcggcccacggttcggtacgtgacattcgtgaaaccagccggcacacgtcggcgcccggcaatcgccatcaatgacgctcctgtaggaccagtgcacagtactaacaggagatttacggtgagcgaaaacgtatatcccaaggcgagcgagggcggcgagaccgcgcacgtcgcgccgaaccccagcttccccaacatggaggagaccgttctcgactactgggacaaggacgacaccttccagcagtccgttgaacgcaacccttccggcgaccacagccagaacgaattcgtgttcttcgatggcccgccgttcgccaatggcctgccgcactacggccacctgctgaccggctacgccaaggacgtgatcccgcgctaccagaccatgaagggccgcaaggtcaaccgcgtgttcggctgggacacccacggcctgcccgccgagcttgaggcgcagaaggagctcggcatcgactcggtcgaccagatcgagaagatgggcatcgacaagttcaacgacgcctgccgcgcttctgtgctgaagtacaccaacgaatggcagaactacgtgcatcgtcaggcccgttgggtggacttcgagcacggctacaagaccctgaacatcccgtacatggaatccgtgatgtgggccttcaagcagctctacgacaagggcctggcctaccagggctaccgcgtgctgccgtactgcccgaaggaccgcacgccgttgagtgcgcacgagctgcgcatggacgccgacgtgtaccaggaccgccaggacaccaccgtatccgtggccgtcaagatgcgcgatgaggacgacgcctacgccgtcttctggaccaccaccccgtggaccgtgcccaccaacttcgccatcgtggtcggcgccgacatcgactacgtcgaggtccgcccgaccgaaggcaagttcgctggcaagaagttctacctcggcaaggatttgctgccgcactatgagaaggaactcggcgagaattacgaggtcgtgcgcgaactcaagggcaacgagctggcaggccgacgctactacccggtcttcccgtacttcgcgggtgacgaggccgaatccgaaggccacgtgcccggcccgaacggctacacgatcttcaccgccgactacgtcgacaccgtcgaaggtaccggcctggttcaccaggctccctacggtgaggacgatatgaatacgctgaacgcgcacggcatcaagagcaccgacgtgctcgacgatggctgccgcttcaccgcgcagtgccctgactacgagggcgatttcgtgttcgacgccaacctgccgatcctgcgcaacctgcgcgccggcgacggcccgctcgccgagattccggaagaacgccgcgcgatcctcttccaggagaaaagctacgtgcactcctacccgcactgctggcgctgcgccaccccgctgatctacaagccggtctcctcctggttcgtgtccgtgaccaagatcaagccgcgtctactggaattgaaccagcagatcaactggatcccgggcaatgtcaaggacggtcagttcggcaagtggctcgccaacgcgcgcgactggtccatctcccgcaaccgcttctggggttccccgatcccggtgtgggtgagcgacgatccgaagtacccgcgtgtggacgtctacggttcgctcgaagagctcaaggccgacttcggcgactatccgcgcgacaaggacggcaacatcaacatgcaccgtccgtggatcgacaacctggtccgcgtcaacccggacgacccgaccggcaagtcgcacatgcaccgtatttccgatgtgctcgactgctggttcgagtccggttccatgtcgttcgcgcagttccactacccgttcgagaacaaggagaagttcgaacagcacttcccggccgactacatcgtggaatacatcggccagacccgcggctggttctacctgctgcacgtgatggcgaccgccctgttcgaccgcccggcgttcaagaacgtgatctgccacggcatcgtgctcggctccgacggccagaagatgtccaagcacctgcgcaactacccggacgtgaacggcgtgttcgacaagtacggttccgacgccatgcgctggttcctcatgtcttcgccgatcctgcgtggcggcaacctgatcgtcaccgccgaaggcattcgcgacaccgtgcgccaggtcatgctgccggtgtggagctcctactacttcttcaccctgtacgccaacgcggccaacggtggggctggcttcgacgctcgccagctgcgcgcggacgaggtcgccggtctgccggagatggaccgctacctgctggcccgtacccgtcgtctggtgctggccgccgagaagtcgctgaacgagttcgcaatctccgacgcctgcgatgcggtctccgacttcatcgacgtgctcaccaactggtatatccgcaacacccgtgaccgtttctggaatgaggacgcttccgcgttcaacacgctgtacaccgtgcttgaggcgttcatgcgcgtgcttgcgccgctggccccgatggaagccgagtccgtgtggcgtggtctgaccggtggcgagtccgtgcacctggccgattggccgttcgtggtggacgagaagaccggtgaagacaccgaactcggccgtgtgctggtcgacgatccggctctggtggacgcgatggagaaggtgcgtgaggtcgtctccggcaccctgtccctgcgcaaggccgccaagatccgcgtgcgccagccgctttccaagctcaccgtggtggtcgagaacgtggacgccgtcaaggcgtacgacgatctgctgaagtccgaacttaatatcaagaatattgagttctcgactctggaggacgcctccgcccacggtctgaagattgttcacgagctgcgtgtgaatgcccgtgcggcgggtccgcgcctcggcaagcaggttcagttcgccatcaaggcgtccaagtccggcgactggcatgtcgatgctgcgtccggtgcgccggtggtctccacgccgtccggcgaccttgcgctggtcgaaggcgagtacgagctgatcaaccgcgtggaggaggagaacgccaccgaggccgccgcttcggtctccgccgctctgccgaccggtggctttgcgattctcgacacggcgcttgatgccgatttgctggccgaaggctacgcccgcgacgtgattcgttctgtgcaggacgcacgtaaggctgctgatctggacatcgcggaccgtatctcgctggtgctgaccgtgccggctgtcgatgtggccaaggtcgagcagttcaaggatctgatcgcccatgagacgctggctacctccttcgaagtgaaggaaggcgccgagctggccgttgaggtcgccaaggcgtgaggctgatgctgagctaaggctcttcaattggtctgaaacaattgcgggcatccgatatacagtgattcaatgagcactgcatatcggatgcccgcatttttcgtgcgtttatgcgtcttttcgacgcatccctattttgaaaaaatctaacttattcaagtttttcaaaatagaaggggaccggttctacctctcatggcttgtaaggtgtcgcttcaatcgttgttagctacacttatcgcgataagtgtagctaacaacggaaatggtagtgcccaagttgccggtagatgtattgcgtatgttcggccagccactcgtatcccgtctgccctgcttcatgtagtgccgatgcccgcttgggaacagcgtaagtttggggattgcttcgagttcttgaagagcaacactctttcacgtgccggtttgaatggcgagaatggcactgctcgcaatgttcattacggagatattcttattaagttcggtgattgcctcgatggcgaacgaagtgatttgccgttcattaccgacgataccgtgcttcccaaatatgctgggtcgatacttcgcgaaggtgatgtcattttcgctgacacggcagaggacgaaacggctggcaagtgtgttgagctgcggaaactacccaaagagccaactatctcggggctacatacgataccggcgcggcctcggttcccctttgggacgggctacctggggcactacctaaattccgatgcataccatagacagcttcttcccttaatgcagggaatcaaggtgatctccgtttcaaaggccgcactgcaagatacacaagtaagatttcctggcttgtcggagcaatctgccataggtgcggcgttgaatgagattgacagcctcatcacccttcatcagcgtaagcgtctgtggtttgctaaataagggtggataaggctctcatcacgatgtcaacgtctttgttttccaattcgcggatgacatgcagatatatttcctgcgttgtgttcatgcttgcgtgcccaagccgtttagagacgcttgcaattgaaacgccggcaaatagcaagagtgaagcatgggtgtgtctcaatccgtgtattgaaatcacaggtactccggcttgtttgcaatgccgggccagaataccgttgacggttgagttgtataccttgccatccacgaagataggcttgtcaccgggtaagctcttcaacagaacagacaactgcatgatgagttgccagtcaagttgtactttacgtaccgaagaagcattctttgttggaacaaagccacctccattcttgtaattccatgtcttattgacggacaaagtctggtgaacgaaatcaaaatcatcaggagtaagccccaatgcttcggagaaacgtaacccggtttttgccactagcagtatcaaccagtcccagttaggtatcggatcaagcttcaaatcagcaaggacagcatgaagttcgaactggttaagatatttcaccttcttctgtctcggctgttttcctttgatgattgcttttcttgttgggtctctctgaatcagaccttcatcaacggcatcgaggatggctcctttcagttggtgatgaaaatccattgttgtctgatgctcgtgatgctcagcgtatccgttgatgagtttctgatagctcacacgatcgaactcggaaagcttgagatcagggataagttttctcagccacgcctgtgtgagcttgtatttcttcattgtcacttcccgaatcgcgccttccttgtagacgtcgacccattgcgagtagtaatcgcagaacgacatttcttcgttgattgtgtttatgaccacacggggctcctttgccgaatagatagacgcttacgctgatgaagggtgatgaggtcgtcaagataatcaaataaacgggagatagctgcttgttcttcgacagcgggaaatgccaaaaaggtgttcatgaactcatcaacactaatgctgcggccatcgcgaatcccataagtcaccgtcgatagaccggcaatgaaatgttcggacataaaccagtgcttccagaatcgatctgaatgcgatgttggttccttcgctctaaaaaccgtgtatgcaggcgacgttatgccctcatactgcgaatgtgcgaagcccccttgaaatgacctgagatgaacaacgaagtctccgggaagcacacgcttatatccaatttcgttgctctcgtcatgcccgatatatcgaccagaatcatcgcgatatatcatgccttgattctgcgtcgctgacagaacaggcagtgtcggatggcctctatcatcaacgatttggaacacctcactggccttacgctgttcccaagcgggtgtagaattattgcatttgtattgcagtttgaaagtgtagaatgcaatgacgtactccgatctgattgagcatgatgctggtgaaacagagatacgttcgtatctggtaaacggtgatgtggtgccggttactatgcgtatccccgctaatttgcgagattctgctaaagaggccgcatctcttcgcgggatgagcttttcggcattcgtgagaacatgcatgattaatgaactagcaaagggcggcaagtgatgattgctctcactgctatgaccatacaaattattgacaacaatcctgatggcattcgaatttgtcgtgtggatggggagtcgcttgtcacggttgtggtgccccgggatatgttgagtgaggcgaaaagtcttcccgatttgccggatcgcggtgtgtattatcttcttgatgaagatcatggagttctgagccgtgcgtatgtgggacaaaccacgaaggggcttaatcggcttgatgcgcacaagactaagaaagatttttggaacaaagccatcatgttcctcgataatgatgtcaatatcgatcgtgatgttttggactctcttgagtcaacagccatagattatgtggacaaacatggctcttatgagaccgacaatgagtatactcctgctcctcgcatgaatccatacaaagagcaacaggtggaaagactgcacaataacatcctctttcgtatgcgagtgctcggatatgaccttgatcgaaaagaaaagacaccggttatggtgaacgccgtattccatacgaagaagaacggtgttcaggccactgggcgatatagccaaggtacaggtcgtttcactgttctttccggttctgaagtggatctcgtgcatccagttatcaaaaaccagggagccgtggcagctcggcggcatcttttcggaacgcagacgggcaaggcgactcttgctgatgacattgaactgtcaagcccttccgctgctgctgtatttgttcttggtggcagtcaaaacggttggaccgaatgggtcaatgaacaaggacagacccttgattacgtgtacagaaacaaggagcatatgaatgaataagcagcagcttgccgccaaaatctgggaatccgccaataaaatgcgttccaagattgaggcgaatgaatacaaggactatatcctcggctttatcttctataagttcctctcggagacggagattgctcgtctgcgtgctgaagactggggagccgaagacctcaagggcttggatgagaatgatgccgaaactgtacagtatgtacgtgatctatgtggctacttcatctcctacaacaacctgttctccacgtggattgccagccagggcgatttcaccatcgctgatgtacgtgacgcgctttccgctttcgaacgcaacattgatccggctcgtaaacgggtgttcgtcggcatcttcgacacgctgcaaaccggtctgtccaaactcggcaccgatgaaaaaagtcgtagcaaggctgtccgcgacctcatctacctcatcaaggacattccgatggacagccggcaggactacgacaccctcggcttcatctatgagtatctaattagcaacttcgcttccaacgcgggtaagaaggccggtgaattctacacgccgagcgaagtctctcagctcatgagcgaaatagtggcttggcatctcgccggccgtgaagaaatcaacatctacgaccccacgagtggctcgggctcgttgctgatccatatcggtcaggctgtggcccgtcgcaatggcaatccgaatgacatcaagtattacgcacaggaactcaaggagaatacctacaatctcacgcgtatgaatcttgtcatgcgcggcatcctgccggacaacatcgtggcccgcaacggagacacactgaaaagtgactggccgtggttcgataccgacgaaacgaaggacgagacctatgagccgctgtttgtggacgccgtggtctctaatcctccctactcccagaactgggagccgccggaagcgggcgaagatatccgtttcgaatatggcattgcgcctaagtccaaggctgattatgccttcctgctgcatgatctctatcatctgcgcgacgacggcatcatgaccatcgtattgccacatggcgtgctgttccgtggcggtgaggaaggcactattcgccggaacctggtggagaaacaccacattcaggccatcatcggcttgcccgcgaacatcttcttcggcaccggcatccccaccatcgtgatggtgctgcgcaaacatcgcgacgacgatcatgtgctcatcgtggacgcttccaaatacttcaccaaggaaggcaagaacaacaagctgcgtgcgagcgatatcaaacgcatcgtggatgcggtgacggggaatcgtgatatcgataagttcagccgtttggtgagcattgatgagattcggcagaacgattacaacctcaatattccccgatatgtggattcctctgaaagtgccgaaagttgggacgtgtattccaccatgtttggtggcattcccaagcaggatatcgatgcgctcggtaagtattggaacgtgttcccgggattgctccaacgtctctttgctgaggagaacggccattcggccaggctcgctgtgcaagatgttcgcgaggcagtgaatgctgattctggtgtgagtgcctatatccagcgatatcgtgaggtattcaccgattatcctgcctatctgcgtgatgaactggtgggtaatgccgccaatgtgagcattgccgccgaagaggagactctgacaaatgatctgctgcgtcgtttggctggtatccctctcgtagacgcctatgcggcgtatcaggtgcttgacgatagttggcaaaagactatctccatcgaccttgaaaccatacaggccgagggacatgacgccgttcgcaaagtcgatgccaatatggtcgtcaagaagaaaggcggtaaggatgtcgaagtgccggacggctgggtcgggcatattctgccgttcgatctcgtacaggggaaatttcttacctctgatcttgcggaaattgccacatttgaatctcggctgagtgagattggcggcgaaatcgctgacattcttgaaaatctggatgaggatgacaagagttcgactgatgccgtcagcgaggatggagattctttcgttgccgctgaattgaagaaagcagtgaaatcgattgggaagaatcccgagactgactttgaccgtgctcttgtgagtgcacagcggttgtttgatgaagagcgtgaagtcaaaaagaacgttaagaatctccgttcagcgcttgatgaaaagacccggaccgttattgaaggactgagcgatgaacatgctgatgacttgcttgctgccaagtgggtggaaccattgcagcgcaagcttgaggagctccctcagacggctgttgatgagttgattgcagcggtgaatgcgctgaacgacaagtattcgactacctactccgatgtgtgcgaacagatcgaacagactgaggcagaacttggcaatatgcttggtcaactaaccggcaatgagttcgacatggctggtattgccgagctgaagaccctgttgggaggtgaatgatggctgaacaggcaaaagtacccgcgattcgtttcgctggttttactgacccttgggaacagcgtaagttctctaatctgaccgacagggtttccatgcagtcaagcgatcctgatttgcctcaagtcgaatacgaggacatcgtttccggcgagggtacgctgaacaaagatttgcgcgacaaagaaggcggcaaaacgggaattaagttttacgccggagatgttctatacgggaagcttcgtccttatttgatgaattggctatacccgcagttcaacggtgtagctgtaggtgatttttgggtccttagggctacagagtgtgacagttcatttttgtatcggctggttcaaacggacagcttccaaaggcttgcaaatgtatcttcgggctctaagatgcctcgcgcagattggaatctgatttcacaatcgttcttcgccgtgcctgccgattacgccgagcagagagtaattgcgaagagcttagccgagctcgacgacctcatcacccttcatcagcgtaagtatgacaagcttgtcatctttaaaaaatcgatgcttgaaaaaatgttcccgaaagatggtgagtctgtacccgaaattcgctttgctggttttactgacccttgggaacagcgtaagattgactataaagaagtagtacaaacacgctcttgagttctcaaaccaccaccacaccagccagacaggaaaccaaccagaggaaggaacccgccgcgctgagcggcaacaggtgaataacttacacgcatgtccggattcacgcaaatcaaggcacgcaaaaacccaaggaatcgttgcaatcacacggttccctcggcgtgtcgcaaacagcctatttgcgctgttctgatatcagaataatccgttttgcattgccgatgcgtaacaaattcatgtgttcaacggcgtgtcgcaagaattcgattgcgtgaccatccaggttcaccttctcgcaaccggtcatcgcatatgcaaaaagggacttccctttacgggaagtccctttcagtagctattgaagctcgctagcctcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcaatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttgatcagcgccgagactttcttcttgggagccatattatggttcttctttctataacgcggttcgaatggtcgccgtcctcaggttcggctgtctgccatcatgctcggtcttgactcattatttatccgtgcatgctgcaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcatgcgttccgtagagaacgcttcgccacggcgaaaccgccaagtcgttatagtaacggctccggtggattatcgcaaatcgcgtgtcgcgcgcgtggcacgcgactcttctcagttagcccattccttgaatcgacgcatgccttcggctaggtcttcgtcagccagtgcgtaggagaaacgcaggtaaccgggagcaccaaaggcctcgccggggacggcggccacgtgggcctcatccaacagtgcggcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgcccccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacatcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccttccacatcagtgatctcgtcgatgtactgctgcttgcgggagcgtcggaccagcggctgttcgctgttctgactctggtcgtcggtgccctcgccgttcttgccgccacgacggcggcggcgacggcgagtgacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgggagtccgaggtgtcgtcggcgtcgaaatcgtcgtgatcggcgttggtatcgccggacgcggcgtcacgggaagcgtcacggtcggcggaggcgcggccgcgatcgtcgcggcgacggctgcgcggctgggcatcgtcatcgtcgtggctgcgcgagcggcgggagcgacgagacgggcgttcgtcggcgtcaacatcgtcatcacgagtgtcagcggtatcgtgcgcatccacggcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggccgatcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgatgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgataatcgagcccgtccacgttcacggtggccggctcgtaggcgttgagtcggttcagaatgtcggccgccttgtggatggcgttctcccccatccatgcacgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccattcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaagcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccactgcatcagccgctgcttatcggctcgctgctgggcattgtggtctctgcgatttccgctaaaagcggctggttcccagtgccgaaattcattttcgacccgatcgacatgatcggcgattcggctgtgccaatgatcctgatggcgttcggcatgtccctgcacggcaccaagccgctacagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacacgagcgtcagaatgccgccggtgccgatgtcgcgaatgaacacggtgaacgggtcgttggcgtcatcgaccacggcggccgatccgaagaatccgcagatcgacgtgatgccggcgataaacacggccaacgcaatgccggacacattgcgccaggcgcgcttagggttgtcgagaatacggcgcatggcaatcatcgtggccgcatccttggggcgcttggccttggccctggcgcgagcggtgatcacccacgtgccgataagattcaccagcgcgaagcacagcagcatgaaaccgatgatcacgccgtacatcaccgcctggccggcctgagccagcatggccgggttcttgaagacgatcatggccaccaccacgactaccacgaacagcaccatacgggtgcctgagggcaatgcggtggcggtgcgcgaggtgacacccaatggggtgattgccacgcggcgcaaggtgaccagcgacgatatcagcgccaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccatgagaatgcccatgacctcgcggccggtggcttggtcgagcgcgccggtcggctcgtcggcgaagaccacggcaggtttgacggcgagtgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggactggaagacgaagccgaagtcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagggcgagcgtgtgcatggtcggcatggcgaagccgggctgggctggctgggatggctggccggcctgaatggcacccggtccggccgcagcgggattcgccgacgcataaccggctcccgtgccggctggcatcacgccggtgacgccgtgcccggcctgtgcgcgggccatgctggcggtgtagtccatgaccaggtcatgggcctcgatgaccggggcccactgctgggtgtgcgatgccggctgctggaactgttggggttgctgagactgctgaggctgagccgccggtcccgacgccggctgaggctgctgcaattgcgatgctgctgtgttcatactcccgagcgtacggagcgaacgcccagccgaccatcgggctgcggtatgaacctttctggatcaccggcccgctcctcatccgcaaggattagagatacgcaaatgattaatgaccggcaaccactattcggtgccggtcattatgagcattgcattcaggcgctacgcgcattattgcgcggtagccagctcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcgaaggcaaacacggtggtgtaggcccacgggccgtggtcctcgcggtaggagccgactacctcgatgtcttcgggagtgatgttggcttcctcatagctttcgcgcagcgcgccctcgatgggcgattcgccgtccgcggtggcaccgccgggaataccccacgtgccgccttcggcgctccacgcggcgcgatgttgcatgaccacgtgggtcaccttgccactcaccgggtcgcgacgagccagcagaataccggaagcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgaccgtcgcctcggtcagtcccggctgtccggcaatagcggtggcgatgggttcggtgacggtcggcatatcgatgccggagaagtcgcgcgtggtggcgatttccgccttggaatagtcaatgggcttgccagcggcggcttcacgcaagtcttcgacggcagcttcgcgttccgaatccttgatttccttggccttgagcgggtaggcgatcacgcggtcaccggtcgcagcggcggcagtatcggccacatcacgatacgcacgatgaacggcctcggccttggccgcggccagaatcatcacgcgctgcttgatgctcaaatcgtcgacggtgacgccttcttcacgggcggccgcttccagcgcagcaggctcatccacatgcgagacgcgaattgtggggcagatacccgccgaatacagcacgtcacggcgaggcttggacttggaagcaagaattagtggaatgggcatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagccccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacaatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcatgggagggcgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattggattcatggttgttccttaaaaaggagctccctcatcagagggagcttgggtattcagctttcaccgttcgaccgcctcatcagagggagcttaggtcttgtcagtccagcacgcgcaggatggacgggtcgccggtgacgaagtcgagcgcctgcacggccttgacggtgttgcgcagggtttcctcgtcggtcaggtgggtcacgacgcgcaactgctgaatctcgccgtcgtagccgggatcggtcatggtgggcttcaggtcctggttcacaccgttgatggagacaccgttcttggcgaactcagcggcgatggcggccagcacgcccggcttgtcgtgaatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccgtgcacggaggccagcgggtggttctcgtcgatcagggccgggtagacgcgggcggagacgccggcctcgccgttctcgaccacggcgagcagcttgatgaccttgtgctcggcggtggcggcggcgatgtcgtcggcggtgatcttggtgatgccctcaacggacacatcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcaaactggagacccttggtggtcatctcgtcgagaatgtagttggtggtgccgttgacgatgccgagcatgctggtcaccttgtcgccgaccaaggactcgcgcagcgggcgcaggaacggaatcgcgccacccacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggtccttttcgtattatgacggatttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccgccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagccgtagcggccggccaaattggagaaatgggcataatcacatcttttcgggggcggtgacgccgaggaggtcgaggccgttggcgatgacctgctggacggcgtcattgagcttcaggcgggcggcggcacgggccggctccggattcttggcgatctccaaggccttgcgagcctcgtcgtcgccacgggtttccggatcggtcagggccatcggcaccacgcgctctacgttgtaccacttgtgataggtggcggccagctcttcgagataacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcggcggctgcgttgcggtccacgttcttggagcgggcgtgcgcgtactgcacgtagtacaccgggttgtcgttggtgtgcgaggcgagcagggccaggtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtcggcgccaagcatgtagatggccacgtcagccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcgtcgttgaggccttgatcctggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcggccgtattcgttgaccttgttgagatgcttgtcggtgtcggtcacggcaccggcggcgagtacggtgtccaccacggcggcggccgaggcggagtcaagcgtgatgttgatgaagccggggcctgccacctcgaccttggcgatgccgtcggcttcagcgagcgcggcggcgaacggctcggccagatcgcgcggcttcatgccggccttcttggccagctgcatggcgatgttggaggcccagtcgccatgcgcacggtccttcgggcgcatcacggcgagcttgtcgacgggcggaatcagctcgtcggtcaacgcgccggcctggccggcggcgacgaggttgtgggcaatgctggaaatcagttcacttaaggcttcaggactcattcttctaaggatactgagaacggcgacacttgcgccctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacgctcaccccgaggtgacgcgcacccgcatcctcgacgccgcacaacggctgttcatggcccagggctatgagcacacctccatccaggacatcgtggacgagctcggcgacctctccaaaggcgcgatctaccatcacttcaaatccaaggaagccatcctcgaagagctcaccaaccgagacaacaatatgcaggacgacttcaacgaatccgtcatgaatcgcactgaccttaccgccctcgaaaagttccgcgtgctatggcggcattcgatgaccaagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgcagagctgctttcgttgctgccgaattattggctgatgccgtatttctacccggtgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgtgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcagatcgaacagtatggttcgttctccgccacggccaaggccacgggttggtcgcagccggccatcagccagcagatcaaaaagctggaggcacagtgcggttcgactctggtgcaacgcacctcgcatggtgtggaactcaccgccaccggttcgatgctcgcccgccacggcgaggccatcgccgagcggctggagcgggcggcccgtgaggtcgaggattatcggcatcatcggtttgctcacctgcatttggtggctccaccatcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccgtgcgtggccgaagccatcgaagaggccaccgaacgtggcgcgctcggctacattcccgacccgtggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggtaactccatcgtggtaccgactccggcctatatgccgttcctaagtgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacgacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcggcgacccggccaactatttctttaagaaggccaacgtggcgttgacagacggccgtgaatgcggcgaggtcgggcgcggttgcgtgcgtatgaacttcgccatgccctacccgctactggaggaatgcttcgaccgcatggccgccgcacttgaggcggacgggttgttgtagaacagaattgcggctcccctcaaagaggggagccgaggaacggccgaattagtcgaagtcggcaccgagggcttcgagtttgccgcggaagtcggcatagcctcggtcgatcaggctgatgccgtgcacgtccgaggggcctgacgcggccaaggccgcgatcagatggctgaacccaccacgcaggtccggcacgtcaatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcgatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcgcccatcttctgcagcacgcacaccagatccatgatctccggctcagtggccgcgcccgacagttcggtcttgccctcggccagcacggccgccagtaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggcgttctccatacttctacgctacgattcagggcaatggcatcagacgccatgtccacaagcaaaggagcattcatgaccacagtcgccgtcatcggctgcacgcacgccggcacgttcgccaccacctcgattctcgccgaacaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtcggcgccgtggccatgaaggcggcggccgagtaagacggctgtacccaccgcaaaaagaaaccccggcgtgatgggcgccggggagagaaaggagagaagaagaagaaagaggttaagttatgcagcttgttcggccgtgattacatataacaacaccagtttcaatgcaacgtgggcactggctgggaattgtctgggaatcacggcccgtacaggctgtttcttgttttggagccgatttaccggctcgccttgatcttgtgggccagctcggcgtcccacatcgcgccggttgcggacatcaccgaatccgcgccggcgtttctgtatgcctgatagtcggccggcgaaaccacgccgcccacgccattgatcttgaaatcaagaccgagcttctcgcggatcgcggccagacgggcgaccatgtcgaggccggcaccacgaatcgcattgccacacacgccggagcgatcacggcctgcaccgggcagggcctgattgccattggcatcgaccagtttggcggaaatcgtattgatggtgctgaatccctgcacagtgccgtggcccacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtttctttgaccaggcgggcggtggtggcatggtcggcgatgtattcctcctcgctcatgccctccacacgcgagccttggaagctcgggaccagcacttgaccggggccggcggcctcgatggcggcgcgcatgtccggctgccaggcatccgggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaagcccatgcggaaggcggccgtggtgaaacggctgttgagcagcgggcctgcgggaatgccgaaaggcagattgaccggctggcccaaaaaggtggccaaggcaccctcggaggcaccctcgctggtggttccggcggcatcggcaccgttgccatccttcagcgcctcggcgaacgcgccgaacggcccttgctcatagttgtcttcgtaactgcggctgacatcgtaaaacggctcaaaatcactcatgcttcaacgataagccaacctgcatgcgcacacgcacactcaacccatcatcgcgccgacaaacgaaataatggcgaaagcggcattggctaccacaaagatgatgaacgtcggagctgcccagccaaagtacgtgtctggaatactacgattcgtacggtgatattggcgcaaacttaaatagtgcaaacacaccctagaagagataggagggaatggcactttctcgcgttgttggtggaagtatttgggatgctaagcgagttgccgcattggaaccagacgattgcgtgaagtgaccctatacgtaaaaggtctcactggcaagagccagtgagacctttgtctgatgcgatgcgagcgacccaataatctcaatcagacacagagccaacggccctgggcctgcaattatggactcgcctttcggcgaggctcaatgctggcctcgctgctgtcgcagctcggcacagggcctgctgaaagcccaccgggctttcagcaggccgatcgcggctaaataatgccgcgatcggccaacggccctgtccagtctgcgtcctcaggctcgcgggcggactcgattctttcttcggcccagtgtttggcggggatggtcttgggcttgaaggggaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagccccctcgtcagagggggctcatgcgtattgactcagagatcggcgggggacgagattgtgccgcggatggcggtggcggcggctacggccggcgacgccaaatgcgtgcgcgagcccttgccctggcggccctcgaagttacggttcgaagtggaaatcgagcgctcgttcggtaccagcttgtcggggttcatgcccaggcacatcgagcagccggcattacgccattcggcaccaaagtccttgaacaccttatcgaggccttccttctccgcctgcagacgcacacgggaggaggccggcaccacgagcacgcggtgaatgttctcggccttgtggtgacccttcatgatcgcggcggcctggcgcaaatcgtcgatacgaccgttggtgcacgaaccaatgaacacggtgtccacggcgatgtccttgatcggcatgcccggcttcaaacccatgtatgtaatcgcacgttcggcggcggcacgcttggtggcgtcggcgatcttgtccggctccggcacggaggcggtgatcggcagaccttggccggggttggtgccccacgtcacatatggaccaagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatattgcacacggtcatacgttcgtccatggtgaggttacgaatcgcctcgccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggacccgactcgaacatgacctagtcatgactcggttccgctccagacatgtctcttcggcatccacgaacgccctttcaacttcatggccaccctgtgagacacttccccgatttgccatttcactatgtgagatggcataatcgcccttattatgactgattcccgggaagaaccattgaacaacagcttgaccaagtccgagccggttgaagacaccaccgccaaggacgatggggaaatccattccggcgttggcgtccttgataaaactgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgaacgcgaagagggcgtgtgctcgatttccgccccgatccgcaacgcctccggccaggtcatcgccgccatctcgatttccggcccgaccggccgcatgggtgccgcccccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatcgtccaacacagcggaaggccaccgaaacctcgaatacttcgcgccgctttccgcctctatcaggaacagttacctgaataaaccgggttacctgaataaaccggacagttgactccatagcgacggcttgcgcagcaaatcatcgccctcgccctcgccaggcgcggtctggttcaccgcataggtataggcgcgtttggaactgggcttgcccaccagttcgccaaactccagcaattgcgtacgcggctcgtaagggtgacggatatcaaattcgatcaatcgcgtggcgcgtttggccggagccggtccgtacgtattgaatccgcaggttggcgtagcgataagcaacagaccctcatgttcgccgacgaaaccgttgcgatgatcatgaccagctacgacgccgaaatacccctcgcgcagcaattcgaattcgtctgacgtatcagggcaggatatgccttctcccagatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgtgccgaagccgccgccatgcacgtaatcaccggagtcaagaatgaccagacccagcacattgcgcgtatggtcaacgtccataaccggcagcgcgaaggtgcctggttcaccggaaccagtggcaccagacagcgtctgcacagcaccacccgctccacaggtgtatgcaatctggttcggcaaggtctcactcggcggattgacacaaccggggaactcgcgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccgttcccctacatttccggcggttccatcaacctggccgtgatcgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgctgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctgcgccgctactgccacgtaggcaccggcaactacaacccgaagaccgcgcgactgtacaccgatctgggtctgctgacctgcgacccggtggtcggccaggatctgactcgtctgttcaaccagctctctggttacgcgccgaagtccagcttccaccgtctgctggtggccccgcgtaccgtgcgcaccggcctgattcagcgcatccgccgcgaggaggacgccgcccgcgccggcaaggaggcctggatcaagatcaaggtcaactccatcgtggacgagaagaccatcgacgccctgtaccgtgcctctcaggccggcgtgaagatcgacatcgtcgaacgcggcatctgcgctctgaagcccggcgttcccggcctgtccgagaacatccgcgtacgttcgattctcggccgcttcctggagcactcccgcatctacgccttctgcaatgcggacggcccgcagatcggcgagggcccggcttccggcccggaggtctacatcggttcggctgacctcatgcaccgtaaccttgatcgccgcgtcgaggctctggtgcgcgtcaccgccccggagcagattgacgagctcatcaagtacgtggacctgcagatggccgactccaccatgagctggcacatgcagcccgacggcacgtatgtgctgcacaccaaggacgacgagggccgcccgctggtcgatagtcaggaatacctgattcgcaagcaccagcgtcgccccaattcacacaactgatttcactcgatgctccctgtcagcgcaagctaactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcaggcatcgtctccatcagcgaaatccaatattgccaccgatggcaccatcatcgcgaataccgcggattctgacggcaaggccacggcagcacacggcgcatcggacgcggctcccaccccggacccgacgcaggccgacagcccggccgcggtggacaacgtactcaaccgcatcgaactgtgcgtcgtgcatcgcccgaaatacgacgactggagctggccgaaaggcaaggtcgacccgaacgaatcgcaccggcatgccgccgtacgcgagatcggcgaggaatcgggcctgtccgtggaacttggcccctatctgggcgacatcgagtacccgctgtccgaagaaggcagcaaacagcgccataccaaggatcggtcggcggataccaagcatatccagttctggatggccacgccgatcagcgccatcgacaacctgcggcgtacccatgcgtttggcccggtgcatcgggcggacatcggcgaaatcgacgaagttttgtggctgacgccggccgaggcccgcaagaagctcagccattccaccgataaggacatcctcgcgctattcgttgatcgggtgcaggagggcgcgcttgacgccgtgccggtgattatcgtgcgccacggcaaagcggaagcgcgcaagctgtggaagggttcggacgcgaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcatttcctgattcatccaactcctcggccgctgccgctgcagctcatgccgcgcacaatggtgccgccggcagtctgggcccgggcttcggctcgttgcgtgcggccggagcggcattcggacctgctcgcatgggttcttcacgcccctcgcgcccggctcagctcgacccggctgtggccgatggattggccggtggcatggacccgcaggcgttgagcgagatgagtcatctgtctgctgccgcattgctggatcgtgtgcgccatagcgaagacccggcggttgttgagcgggtgctcacgttggtggagacggtcggtgtggatgaaatcgctgaactatggagcgatgccgagccggattcgctgcctggtgtgctgtggcgactgtatatgttgcgtacgtggatgcgatcgaatcgcgactcgatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgcgcggcggcgtttaccgatgtggtggcgttgggcttgcgcgtggaggcgcggcgcatggtgacccgggccgaggccaacggcgccttctcctcggatgccgatgagaaggccgtgcgcaccaaagccgcccgccttatgcacaccgccggcagcctcatggccaccgccaaggatttccagcacggtgccaacctctggcgtcgcggacggttggagtagccctgctccaggctccctctgatgagggagctgtcacgggcgatgcccgtgactgagggagagacccaccaaccgcaccccaacaatcagctaccagccaacaccacacctcccccggcgcggcgagccccatcgcaagctatactaagtatccgcgtcggaccgtgcttaagccccgggctccattttttgccgccgcgagcggcccttgcgccgacaggcgctttcgcggttcggcgcttcttttcttttacccgattcacgccccgaacgttgcgatgggcacgaccagtatgccgtcattgcggcgataggccttcccacctcggccggtaaggaacatcatgaactctggttcgcgaacttgggccatggggttgccacagattttgtcgcggaaggatttgagcttatccgcattgtcatcgttcaccttaaggtcactgagttttatttcgatagcaccccacctgccgtcagacaactcgataatgacatcaacttcaagccccttgtcatcgcggtagtaggcgatgcgattgttcgcgcccggcatggccgacagatatacattcaaatcacgaatgcacagcgtttcaaacagatcgccgagcgtctgtgtatcgcgcatcagagtattcggcgcggcacctaaaaccgcagcaggcaacgaaggatccacgaaatatcgcttgggcttggttcgcacacgactctttgcgcggagtggcggttcccaaccctccaaatccgtcagaaggtacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccatccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacgatcaacgcttcgagaccgggagagcgcggtccatgtcttgccgcaccatttcggcccaacgatttccactgcaccgaacgccttgagcagtttacttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatctcattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcgatatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcagcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacagcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcggcggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacacggtccgggaccatcggctcatcggccgggttggccgcgctggcatcagcagattcagcatccgcgctctccgcggcggcaagctccttctgaatggacggaatctcgccgtacagaatcttcgaggcctccgccaagttgccttcacgggtatacttatccgcctgcacgcgcaggtcgtcgagcttggcacgcaggtcgccgaccttgttgtggccagcctgttccgcatcccaacgcgccttgagaccgctgagcttctcacgggtgtccgcaagttcggcttgcagcttgcccagacgctccttggacgcaggatcctcggccttcttgagctgcatttcctccatttcaagacgggtcaccttgcgctgcagctcatcgatctcctcaggcgaggagtcgagctccatacgcaggtgagcggccgcctcatcgaccagatcgatggccttgtccggcagctgacgacccgaaatgtaacggttcgagagggtcgcggcggcaaccagcgcgtcgtcgccgatcgttaccttatggtgcgcctcgtaacgctgcttcagaccacgcagaatggcgatggtgtcttccacgctcggctcacccacgaacacctgctggaaacgacgctccagcgccggatccttctcgatgttctcgcggtactcgtccagcgtggtcgcgccgatcaggcgcagctcgccacgggccagcatgggcttcaacatattgccggcatccatcgagccttcggccgcacccgcgccgacgatggtgtggatctcatcgatgaaggtgatgatctgaccatccgcattcttgatttcgttgaggacgctcttcaggcgctcctcgaactcgccacggtacttcgaaccggccaccatggagcccaagtcaagggagatgagcttcttgccttgcagggtggtgggcacgtcgcccgccacgatacgctgggccaaaccctccacgacggcggtcttgccgacgccgggctcgccaatcagcaccgggttgttcttggtacgacgggagaggatctgaatcacgcggcggatttcctggtcacgtccgatgaccgggtccagcttgccttccttggcggcggccgtcaggtcggtggagtacttctctagggccttgtacgagccttccgcgtccgggctggtgaccttcgcgccaccacgcacgccgggtacggccttgcgcagggaggctgcggtgacgccgttcttctccaagatttcggccgactggttcggcttgctggccgcgatgccgataagcagatgttcggtggagacgtattcgtcgcccatctgctgcatttccttctcagcctgggcgatggcggcggtcagctggcggctggcctgtggctgcgaggtgctggatccggatgcgctcggcagcgcgaccaaagcgttgcgcaccgccgcgccgatggcctgcgggtccccgcccgcggcctcgatcagagagcgcgccacgccgttttcctggcgcagcagcgcatccatgacgtgcagggtctcgacctgcgcgtttcctgcggcggacgcactctgaatcgcgtcgccgacggcttcttgggccatagtggtgaacttctgttccatatcgtattcctccatatcatgcggtctgcgcagtgcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcaatcagaccagagtccttgagcatgcgggcgatgttcgcagcggaatcgccttggccgcgatgcgggcgcagcgcctgcaagtcggcggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccagatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcggatcagacttttctgcagctgcgcgcgctgttccttggggatggaagtggaggcgagcgcgccgaatccggtggagatgccgtaatgcggcacggtgtcgtcggccaaatgatcgataaccgcgcgactcagcgccatctcatgcttcgattcgtccgaaatcgccactttggcgccgccgcgcgctacggcgataacgtcctcgatgctcagcgctccaacacctacggtgaccgtctgctctgccatgctcatacctttctatatacgtgccgcattccgcatatacggcatatgcggcacatgcttcgccggggatccgcgactgcccgcattcgctcaccgcacctgcccaccaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcaacgctcgccgaaacccaacgcaccggttttgccgaggaacacggagacgtgacgcccggctttgattcatacgccgtcgctgtgcgcgactacaacgactttcccatcgccgggctggctctcactttcgtgagcggatcgctgcgccccgaacaggagcggtcgcttaagaccaagctgcggcttgccggcacggaactgtcccggcgtctcggcgcggtcggcagtttgacatgaggattcgcgagatcatcgtgctgggctccttcgccccgatcacgattttctcaactaagttcaccgattcgctgaccggcaacgccaaactcgccggcttctcgctgacagtgacggccatcatcagcctggtggtgatgaccgccctgcacgcacttctgccgggagcgtaaggcgcgttcttggttccctcagtcagcttctccgcctggacggttcccctcagagaggggagccagaacgagtcacgcccgaacgattacgttgcgcagatcaccgatgccttcgacgtgcacgatggtctcgtcgcctgggtcgaggtggccggaggcgttcggggtgccggtcatgatgacgtcgccaggcagcagcgtggagaacgacgaaatggcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcggacaggaggtatcgaagcccttggcgcgcgtccacgtggggtcgatgccctgcagatcgcgcaacgtcacatcattgacgcaggtgaagccgagcacgtaatccatcgcgttctcgacggtcacgttcttggcgatacggcccatcaccacggccacttccggctcgaagttcatgtccttggagcaggccgggtacacaatcgggtcgtcggggccgattaccgaggtggacggcttggtgaagatcaccatgtcttccggcgcgtgggcgatttcggagtggccggcctcgtgcatgaactgggcgtgggcctcatagttcttggccagaccgtaaaccttggaggggatgaccggggagagcagacggatgccatcgccgtcgaccgggtaacgagtgccggtgggcttgacctggtcgccggccagcggatggccgtccagttcgatgaggtagtccttgccgtccgtttcgtccttctgcacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcggcggtatcgcctagcgaggcatagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcgcatcgtcaagattatcttgagctttgctcttatcgctgctatcaccgttgcccgaagaggactgactatagaaggaatcggttttcgcctcatctatagccttgctggtgtacgagacaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccggggagtgagacaaggaacgagcagataaaaccggcaacagccaggccgttgtacttctggttcgcttcaggcggcacactgccgtaagaaccagaccatcccggctggccgttcggttggccgccttgcatatacgggttatagggcgtttgcggaggcacggccccgccgcccggatataccggagcactaccgctgccatagaccggaggaaccgatccgcctgccggagccgcccccggatagggcgaattgggcgctgccgatgcgggcgcgggcgcagcggcaggagtcactggtggcaaagcctgcgtaggcggtaccggctgattggccggcgcaaaaggctgggtgggctgctcggcaggtgtaaacgcctgcgtaggctgttcaacaggagtgaacgcttgagtgggctgctcgcccgctgcgattgcttgggtcggagcattgttggcggcggttcccgtttccgccgtcatcgcatttaacggctcagtcggattggcgtcagcttgctgccacggcacctggctgttcggattgacattcggatcagtcatgacatgcactccttcaactgcatcgcaccccacttgcgagatgcgcccctcgtcttacgcgccacattgtgcgttacagacaactgtactcctcgtggcgagccttaagcaccccaggaaatttggcttccaaaaacacaaaagcctgaaaccggctattgcctcagcaatattcagtcggtttcaggctcaatcgttaatcctctggcgaaacgacggtctacttcttcagtagcggtgcgacttgctcctcgtaagcggtcagggcggtgtcgatcacgttgtgcatgtcgtagtacttgtacgtgcccaggcgaccgccgaacacggtgttcggctcggccttggccttggcctcgtactgggcgtacagtgccttgtccgcatccgtgttgaccgggtagtacggctcgtcgccacgctcggcgaaacggctgtactcctcccacaccacggtcttgttcgggttctgggcatcgtggcgctccgggttgaagttcttgaactcgatggcgcgggtgtagggtacgtccgcgtcggagaagttcatcaccgggcagccgaagtggtcgccttcgtcgtagcgtacttccttgaagtccaccgtgcgccacttgaggtcgcccagctcatagtcgaagtaacggtccaccgggcccgtgtacaccaccggcacgcccgcggccttgagcgcggccttgttgtacggctgggactcgtcgaagaagtccacgccgagctccacggtgatgcgcgggtcgtcgatcatgcgctccatccacgcggtgtagccgtcggcgggcaggccctcccacgtgtccttgaagtagcggttgtcgtagttgaagcgcacgggcaggcgcttgatgatgtcggccggcagctcggacgggtcggtctgccactgcttgccggtgtagttcttgatgaacgcctcatacagggggcggccgatgagctgaatgcccttgtcgttcaggttggccggatcggtgccggccagctcgcccgcctgctgttcaatcagggccttggcctcggccggcgtgtaatgcgcgtggaagaactggttgatggtgcccaggttgatgggcagcgggtagacctcgccgtcatgggtggcgtacacgcggtgcacgtagttcgtgaagctcgtgaaacggttgacgtaatcccagacgcgcttgttggaggtgtggaacaggtgggcgccatacttgtggatttccgcgcccgtctcctcgtccatatacgagtaggcgttgccgccgatgtgatcgcggatatcgatgatgtgcacgcgggcgccggtgtgctccaccgcctgctgcgccaccgtcaggccgaacaggcccgcgccaacgataacgagatcgggatactgggtggtttcggaattgttcggcgcaccggccatagcaagcaacctttcacaggtcatgttcgttttacgaaagaccatgttactcggccaggagaaaatcaggcaatacgataaactatccgtctgcgcagctcggctaggaaacgtgccatactggatacgtccgcatatacaaagaggaagcacaagccttgccaaacaacgccattcccctcatttccgtgatcgtgccggtatacaacgccgaagactacctgcgctactgcgtggattccattctgcagcagtcgtatacgaacctcgaggtgattctggtggacgacggggccaaggattctagcccggccatctgcgatgagtatgcggcgcaggacagccgcgtcaccgtgatccatcaggaaaacggcggcatcgccaaggcccagaacaccggcctcgatgccgcgcatggcgagtacatcgcattctccgacaacgacgatatcctcgaccgccgcaatatcgaatacctgctgcacgcgctgcaaagcaccggggcggatatgagcaaagcccgctggcgccagttcggcgtctcccagctgggagaggtgtccaaagaggccgaagcaggcgcacaggcgcccggcacaatcaccgtgttcgagcatccgctcgccgcctaccagaccgtgttctgcaaaagcctgcgactgctcggcagcaagctcggccgcaacaccgaggcccgctacttcaacgaggcgaactggtgccgactgtacaagcgcgagctgtgggacggcctgcgattcccggagggccattacgcgcaggacatccgcatggcaggccccctgtacgcccgcatgggcaaagtggccgacatcgattgcgtgctctactactggcttcaggagcccggctcggtgacgcactcaaaacgaaccgccgcattctggcatgataacgtgctctccgcagccgaaaacttccagttcactctggagcaaggcatcaccccttgtaggaactacttcggcttgaccgccagcgtacgcgacgaaggaaaaggtctcaaggcgctcggctccgaagaactacatgacagcgactggcaaaaccatctcgatgacgtggccaccatgcgcgccctaatcagcaagctgagcatcggcgaacgcctgaaatgtgcagtgcttgccacgattcgctcctgcgaaaatgtggtatacgataaccgcatccactctatgaagtagaaaagtcaccgaatccagtaaacccctaccctcagttggctaggacgcgctggcgtacgtttctgtcatcgactacgaccagtcccagcaggaagaccggcaatatcggaagtacataacggccttggattccctcaaagacctcaaacctactcattgacgctagatcattccaggtcagtcccacaaagagcacaaacgctgctatctcagcagccgctattacgagagccagaatcaggaatcgatgtcttcccacccataaggctggtgtcatccgacccgtccagtgctgcttcaccgtatagaccgatgccgccagccaagccaccatcagaacagccgccattgcgacataccaagtcggcagataagcaaaagtcccgagaaatagcatggaatgtacgattttgccgatggtgagtgccggatgagacaacgcgacactcacattatgtgatacatccacctgcgccaacgaactgccgaacagcacgctccacggaagatacaacgctcccgtcagaaccgccgcaatccccacaagctccagcttgcgacgtacggtcattaccgcagaaggtaggaacagtaccgcgaccgacacaaacgcatagggaggtttttcacacgctaaggcccacgccagcacccccaataccgcagtgtacggaagagaaatcacacgtttgccctcggcagccacagcgatagccgccaccatgcaggccgaaagtgccacaatcataccgtcaatcatcaggctcgacgccacaaacgccgctggcggaataaccaacaacagcgccatcagcgatttccaacgcggcagcagcgcaatggcaatgcaccccataatcgcatacagaatgctgttggatattcgcgccgcctgccactgcgcgtacggccgcaagttcatcagcatggcgattttcaggccaatggcttggggcaagtaatcaagcggaaaatacgcgttagagcgattggtgtgtgtcccatccggcacaacgatgtgatcagccatcacatcatcagcactttgctgcgtttcccgcgacgaatcgccctgcgtcgccctactgattgactcaacaatcagaacgttcgcgaatcctggaatcgtcagcaaacgcgaatcaccctcaatggactgttgcttgacggtgttgccgtgcgcatcctttccctttgcaacaggattcaacgattgtcctgtggccaatgcgtacgtggacaacggatgcatatcaggatctggaatagtgagagggccaacctagacgatgaacatacaggcctgcagcgcgaacaacaccaggaagataaaatattgcacgcagtccccttcaagacatgtgccacatgcttcataacgccctaccttccggtcattcgtccacagtctaccgcacacacaccgcaagggcctaccaatacctggtcaatcccaacataattcgccacagcacatttagggatgactttatcttgggcttcattattacaatactcaagtacgttgtttatagaaatgagcgagcagagtgaacgacatccaaaacgatcaggaaccttcagcgcaagagtctggcacggatatgggaaaaaccgaagtcccagccgttccctcaaaacagaatgacgatcatcagagcaacaaattgccgctgcttttcgcgttgaactttagcatattgatggcttcaaagcccatggtcatgctggccaaagccatatctttcttgcacacactattgaagaagcgcccccgctgcccctacacgttgtacgtagtggtcatggcaatggttgacgccgcagcagtgctgttcatccaatggagcatgtacgaggaacccacatatgccgatccggatgcagtagatggcaccaccaaaatgttcaatagcgtggctgggcagctgacgaaattcgttgcccagatgtggatggaacacaactacgtctggctgctcaatttcctagtgctaggcatggtgtacctcgtactggtattcgttttgaaccgattctgggtggcgaccgccctattctccattctcacgtcaatctacgccgtggcgaatagcatcaaggtcgacctgcgcaacgaacccatcatcccttctgatttggggttcctctccagcggcaacggtggggaaatcacatcattcatccctaaagacagccagccactggtcaacggcaccattaccatgcttatctggctgactattatttgtctggcattgcagcttatcgatggtcgccgctgcgtgattccgttccactggtggcacccattccgcaatgtcaagaccatcatcggcaactgcacacgcatcatcgccgtagtactcagcgtttctctactgtggtcattcacttggaatctgggaatcaacggctcatggtcctacaaatgggcaaagagtctgggcgacaatcccctgctgtggagcacggttgttgacgccacctataacgggccaaccgtgggctttctgcggctggcacacgcaaaaaccatggataagcccaaggattacaacaaagagaccatggaggctttggctaaacgttataaggaaagcgcccaagccactaacgaggcacgtgccaataacctcaccgacagtactgtagtcatgattctttcggaatcattctccgacccaactcgcgtgccgggagttgaactcactgaagatccgatgccgaatattcacgcccttgaaggcattaccacttcaggcctgatgctttcgccgggcatcggtggaggcacagccaatatcgaacatcaggcattaacaggccttagcctggcgttgttcgacaattccatgcaatcgccttatcaggagcttgtcccgcaccagaaaacgccttatacgttcaaccaaatatggaatgatgcttacggcaagaatggttccgtggcgttccacccatacttcaagaacatgtatctgcgcgatagcaactacaagaaattcggtttcagcaagttgtattcgcttgatagcgaccccgcaatcgagcatcaggaccatatcgacagttcgccatacgtgagtgatgccgcctcgtatcagaacgttcttgattcaatcaacagcaatgatcacacccagttcattcagctggttaccatgcagaatcatgcgccctacaatgatttctacgcggacaaccagttcaaagaagccgatgtttcccaactctccgacgaagagaaacagtctatcgataattacgccaagggcatcagcctcaccgatcaggagactgcggactttttgaaccagctcaatgcagtcgataagccagtcaccgttatcttctacggcgatcatctgcccggcacctacagcaccgcgaccaaagacaagaacaatactcttgtcatgcatgagaccgattactttatatggtcaaatcaggcgtccgcgtctgccggtgtcaaactcgacccgcagaccgccggctatgtctcatcgaactatttcatggctttggctgctgaacatatgaatgccaaggtgtcaccttatctggaaatgctgacgcaggtgcaagcgcagattccggcaatcagccgactgatcagctccaacgattcctggggcgatggcagcaccgcctatctggatgctgaagggaaccgcgtcaagcgtaaggatctctccaaggaagccaagcaactactaaatgattaccgtctcgtgcaatacgatatgagtaagggtaagggctaccttaacgacgatggattctttgcagtcaagtaagcaaaaggggcatcagacggttgtccaatgccccacgaatcgattacttctctcgaacccaatagttgcctgatgtacgagacaggtttggattgtaatacggatcgttatctacgatttcggcatacttcttgcggaatttcgcagattcccgatccagtcgagccttctttttcttgctctcgatatcgtacccgcgcgtgacggactcgtagtggtatagctccacctcatgcgcccacacgatgtcacgtccaagctgttcgtgaatccgaatgcacagatcgacatcgttataagcaaccgccaaagcctcatcaaagccatgtaccgcgcggaagtcatcggccttcaccatgcagcacgccgccgtgatggcagagtaattgacgttttcgatgagtcggccgaagtagccaaaatctccacgggggaaaccgacctgaatgtgtccagccgctccgccaagaccgagcacgatacccgcgtgctgaatggtctcagtaggatagtacagctttgctcccacgacgccgattcgatccagctgcgcgaacgacaccattctggtcatccaagatgggctgatgacttcagtatcgtcgttgaggaacagcaagtaacgaccggaagctttttgagcagctatattgttaatccgcgagaagttgaacggaatgtcaatctcttccacacggaaacgatcaccaagtttcttggcaaaacgctcgtacaaatcctgcatatgcgggttgtcgctgccgttatcagcaatgatgatctcataattggggtagtccgtcttgtcaataattgagctgacacaacgttcgatattgtcgtacccgttcttcgtcgggatgattaccgacaccagctcgtcgccggagacatcgtaatgcacgttataaatgccattcggaccggcggaaaccacttcagcctgaataccgcgtctctcaaccgccgactgcaatgcgcgcaaaccagcgtcggatgtgtagctcttggcactgccgctggatgcggtagaggttgccaaagtgcgccaatggtagagtaccttcgcgatgtgctggatgcgatcaggggtggttttttctacgaagcgaagcaccagatcatagtcctgcgagccctcatagccgactcggaaaccaccaatctcatctacgatgctcttacggtacacaccaaaatgactgatgtagttggtgctcatcagcaaatcgggagaatagttcggcttgaaatgcgggtcgaagcggttcccctcttcgtcctctttgtcttcgtcactgtagataagatccgtgtccggatgctcattgagggtcttcactacctcaaacagtgcctggggagccagttcatcgtcattgtcaagcagaccgacgaactcccctgaggcctcttccaaagccgaattcgttgctctggaaatgtgcccgttttcagggcggaacaccactttgatgcgagaatcctgttgcgcataccgttcaagcagcggacgcacatgcggctcggacgaatgatcatcagccaggcacaactcccagttggaatatgactggttacgaaccgaatccacacacttttccagccacttcggctccacgttatataccggcaccagcagcgaaatcaacggctgatacgcaaacgaggcaatctcattgcgcactgccgtctcgtcgtaacgctctgttcgacgaatgaggttatggtacacgtgcttctgccaacgagggccccaatacttatccagcagacgccttgtggtacggcgaggatgccccagcagtgcgaccttgcgcaagaagttcgacaatccggcaagaacggacgacgactgaaccgggatgatgacttcctgactatccgtagaagtcctcaggcgcaaacgcagcttgtcgttcgccagttgcttacgcccgcccggtaccgatatttccgcacggaaaccaaggatcgaatccgggggaaccgtagttattgcattcacgtcaggacgaccgtaacggctcaggctgcgcaaactcgccacaggggattccaccagagagatatcgacctgttcaccgccgtgtatatcggcagcccatccgttaacgagcacagtagatccatcttgcttggcatccacctgatcaaggttgtatacaatgcctcgctgttcctcggaagcaggcgggaagcatgcagccgcaaacggatcaacgatctcgcgatgcatcttcagatattctgcaacgtcatccttattgattgacaagtgagtacgcttgcaatccgtgaaaaccgaatacggctcccaaagcacagtatgaccggactgctgatacatgcgagcgcaatagtcaataccgcgcagtcctgccgccaggcgcgtattgagtccgccgatttccacgaattccttgcgacgtaccagcatgcaatcttccgtggccgcgaacatgtcacgaggaagcagatccctgaagtagtagccgattccttcatcccaggaaccgcgcatttcaaaaggctcaccttgtttcaatgcccgaagggtaacgcccacattgagcacacgcttcttggcgtcaaataccttgccacccacaacgccaacagaagagggacgcgcataattcaccatttcgcgtagccatgtgccatcggtcggcttcatgccgtttaacagcacaatcaaatcttcggaacgacgctttgccacatcattcacggaatccgctgcagcagcaatcacagtgaacgacgggtaatccgtcatctctcgtagctgcttcacttgcgcatcagtcagagaagaagcaaccaccgcaaccgtcggggtgtaatcggcatagtcaatcttatacgtaccgagattgtcgagcattcgcacgtcaccggctattcctcgacgctccaaggccgcttcgattgccttgcgaccagcctcataggcatacatcttgcttcgggggtctccggccacagagcttgcaagggtgcgccagtggtacagcatctgcggaatatgatgaacgtgatgtgcctgctcggtggcacgcagcacgaagtcataatcctggctgccgtcgtattcgctgcgcaatgcgccaaccttgtccaacagcgcacggctcactaccacaaaatgagtgatgtagttatgccccagcaaaaggttcggcgagtaattcggcttaaagaacggatcaaagcgcttgccttgctcgttgatcttgtcttcatccgaatacacgaaatccgtatcgggctggtcattcagcgcacgaacgacttcaaacagcgcctgcggtgccagttcatcgtcattgtccatgaaaccgacgtaatcaccggtagcgagttctatggcagaattcgtcgccgccgcaatacgtccgttgctgtcacggaagacaattttgatgcgcgaatcgctcgcggcaagctcttccagcagcggcttgacgtgtgcagaaggcgaatggtcatcagccaggcacaactcccagttggagtaccactggttttgcatggattcaacgcatttgcgcagccagacctcgtccacgttgtacacaggtgtcaccacagagataagcggagtcttggaaaatgcggcaatgacaggctcagcttcttgctgggtcatcgtttcatagcgctgaatccacgaatcgtaaaaatccgtctcaccaacaacgcggcgtttcaccgcgtctcgcaaatccttcatcgcctcgcgattgccaaggtgcgcggcataaaacatgagcctgtgcacgcgggtgctgatgtattgcatgcggaatcgactcatcaaacgctgaacattgatgtgccttgtcatggtcgtgccaggcgcctgacacatcaagtcgaaattctgcactccctgaggaataacaatcgtgaagcctgcttgatcactgggatccaatccatacgtcttttccagatcaacacgagtattccgcgataccgtcacacccatgccggctaccgccaacggcagggaggtctgcctcatcttgtcgaccgcccagccggtcactatagtccgagactgttccccaaccttgacgttctctactttttcgactgttacctgatatgtacgatcattcaacagcgtcagcatgcttgttctgtccttatcatctcagcagacgaattaatcgattgtcacttgcaccgtattgtccgggttcaccactgacatcacttccgaggcggatcccttgatgtggaatctgcaggcattctccgccaactgcaaacgctcagagtccgtctgcagagcaatacagatgcggaaatcgccaaatgcgagcacattcttcaccgcaaattcggccgtatgcttaccggctgaaatcttatcgtcctcggagccaaacggcatggaaagcacgggaacattgcggccatcaaacacatcgatgaacagctggttcgcaggaaccggacgatcgcattcgaagtcaacattcatggtgaagtcctcgcgcgtatccaggaatttctgcgtctcgccatcgacggcaacgtttacggcattcacggtcacggcattgcgaatagccgcttccttttgctgtgcctccactacttcgcgcgggggaaggaacgaatccgagtaagcatcggcaatctcgtcagggtcgccgatcttcgcaatatagccgtcctgaatgagcattgcccgatcgcaatacctgcgcacatccggcatggagtgggtgaccagaataaccgtcttcttgttgcgcttcgcctcaaagaaatagttctggcacttcttctggaaagcttcatcgcccacggcaagcacctcatcaagaacgaggatgtcgccctgcgatttaatcgccacagagaatgccagacgcacctgcataccgctggagtagttcttcagcttctgttccatgaagtcgccgagctcggcgaactccacgatgtcgtcatacatggcatcaatctcgtcgttggagaaaccaagcatggcaccattgagatatacgttctcgcggccagtcagttcaggattgaatccaacacccaactcaatgaagggcacgagtttgccgtccacctcgattgtgcctgtattcggcgtgtaaatctgggaaatcagtttcagcagagtggatttaccagagccgttcttaccgacaatgccgaaaaactcaccttgcttgatatcaaaggtgatgtctttcagcacttcctgcgtacggtacccgcgaatgccgcggagccaattgaacagcatgttcttcaggctgccagcacgttcaaccggaagtttgaagttcttggatacgtgctccaccttgagcgccaccggtcggtcagcgttcttctgctccatcgctttgtccatcttgttcatcgtcacaccaactccgcgaagtactgggatttaacggtgaaatacttcaaaccacccaagaagatcagtacagaaagaataatcggccagcactgcaggaatgggttatccacccactgccaaatggtctgatttgcagggctaatcatcacatgacgcgcatcctgaacgatttgcgccaccgggttgagaatcagatcgagccgggcaaatatcggaccatactcgcccgcctttgaagtgataagggaaatagggtagataataggcgtggcatagaatccagcctgcattaccacttcccagatggggttcaagtcacgcagattgacatacacggcactgaggaagaaagcgattcccaacgacagcatatacagctcaagcaccagaggaaccatcagcaaccacgaccaggtaagactgacgccgttaatcagagcaaataccactaccacaacaaaattgatgccgaagttaatcatggcactcatagatgaggcaatgacaatcacatacttcgagaagtgaatcttacgcagcagatcaccgtgtcccacaatcgacatcatgccgccggtagtggtttcattgaagaaattccacatgatgatgcccagaagaagagccacagagaagtgcggcacatcagcaccgaacttcaggaatcggacgaacacgagatacatgatggtgaacagcatcagtggcttgagcacagaccagatgtatcccaagaaggactgctggtagcgaagcttgaagtcggtgctgaccatcgccttcagtaataggcggttcttcctggtgaagatttccgtgatgttcaaaattgctcctcaaatacaacaaacccgcatattttatcagcgcggactaacaatctatgcgggttttcagtgaaggtctatcgatccatcggtttgacgatgaacttattatccgccacatccttcagatgcttgccatacgggctcttgccgtacttcacagcggcctccatcagctcatcacgagtaatccaaccgttctcaaaagcgatctcttcggcaacggcgatcggcaggccctgagcacgctgcacggtgcgcacgaattcgcctgcctcatacagggagtccatggtaccggtatccagccaggcatagccgcggccaagcgtctgcacgttgagggtgccgtcttccaagtacatcttgttcagatcggtaatctccagctcgccacggggagacggtttgacctgcttggcgaactcggtgacgcgttcgtcgtagaagtacaggccggtcaccgcatagttgctggccgggtgctccggcttctcaacgatggagatggccttcttgttctcatcgaattcgaccacgccgtatcgctcaggatcgtcgacgtagtagccgaacactgtggcaccatgttccaccgtggcggccttgcgcagtgtcctgcccaaaccgttgccgtagaagatgttgtcgccgagcaccagcgcgcacggctcaccatcgatgaactcctcgccgaggatgaatgcctgggccaggccatccggggaaggctgcaccttgtaagagaagctcacaccatactgggagccgtctcccaacaaacgttcgaagttcggcagatccttcggcgtggagatgatcagaatgtcacggatgcccgccatcatcagcacgctcaacgggtagtaaatcatcggcttgtcatacacgggaagcagctgcttcgaggtcaccgtggtcagagggtacagtctcgtgcccgaacctccagcgagaataatgcctttcatgaaaaacctgctttccacaacgttttactcgttattcgtctacaaacgtattcagcttagctaactcttattcaaaatgaaaaaccgcgcagagagcctgcgcggttttatcacttgaggtcaactgttatgaacaactatcagccgagttccttctccacgtaggtcttgagggtctcttcccagtcggcgggcacgtatccggcttcaccgatcttggcaagatccagtgcggagttgaccggacgcggagataccgggttggtcgcgttcgcgaagtattcggcggtgctgatgggcttgaccttgctgccgttgccgttcgtcaggtcgaacacctcggccgcgatatcagcccaggacttcaccgcaccggaaccggtcaagttgtaggtgccgtagggggcgtggctatcgagcaggtggaaaatcgcctcggccatgtccttggtgaaggtcaggcgaccgtactggtcgtccaccacggtgacctgatccagcttgtcggccgggtcggcgaccttgttggacagcatcatcatggtcttcacgaagttgtgcccctcgccgatcacccagctggaacgcaggatgtaatgctcgggtgcgttggccacggcgatgtcgcccgcggccttggtctggccgtacacaccgagcggggcgaacgcctccgtctccgtgtgttccttggcggtgccgtcgaacacataatccgaactcacgtgcacgagggtgatgtggtggtccttggccaccttggccagcagagccggaccctgggcattcgccttccacgcgatcggacggccttcggcggtctcggccttgtcaacggccgtgtaggcaccggcgttgatgatcgtgccgtacaggctccaatcgtatgcctcgtatgccttcgggtcagagaagtcgaactcgtcgatgtccgtgtactcgaagccctgaagatcatgggcctcggcgtaggcgcgaatcgcgtggcccagctggccgttgcagcccgtcaccagggtgcgcttgggagccatgggcttggcgtccttgagcatcgggtggtgcagatcggcctcggagcgctcggactcctccagcggaatcggccactggatgttcagttccggatccgcaaggttcacgaacgtgtaggtcttcttctgttcgagcgaccagtgcgcgttcaccagatacgtgtacacggtgccgtcctgcagtgcctggaagctgttgcccacgccgcgaggcacgtagattgccttggacggatccaaacgggtcgtgtacacctggccaaagctctcgcccgggcgcaggtcaacccacgcgccgaagatctcgccggccgcgatgctgatgtacttgtcccacggctccgcatggataccgcgagtgacacccttggtggcgttgtagctgatgttgttctgcaccgggccgaagtccggcagacccagacccatcatcttggcgcgctgccagttctccttgaaccagccgcggttgtcgccgtgcaccggcaggtcgaacaccagaaggcctgggatgttcgtcttctcgaccttcagttccttctcgaattcaaatgccatgatcgaatcactgtccctgttgcttgtacttggcttcggtggcggccttggccggctcccaccaggcgcggttgtccgtgtaccacttgatggtctgctccaggcccttctggaagtccgtgtgcgtcggcttccagccgagctcggtctgaagctttgtgctgtcgatcgcgtagcggcggtcgtggccgggacggtccttgacccagtcgaagtcgtccgggctcttgcccatcacggtcaggatgtcgcgcagcaccgtgatgttgttgcgttcgccgttcgcgccgatcagatacgtctcgcccaggcgccccttggtcaggatggtccacacgcccgtggagtggtcgtccgtgtggatccagtcgcgcacgttctccccgttgccgtacagcttcgggcgcaatccctcgaggatgttcgtgatctgacggggaatgaacttctccacatgctggtacgggccgtagttgttcgagcagttggagatggtggcgcggatgccgaacgtgcggtgccaggcgcgcaccagcaggtcggagctcgccttggtggagctgtacgggctggacggatggtacggggtctgctccgtgaacttcgccggatcgtccagggccaggtcgccgtacacctcgtccgtgctcacgtgatggtagcgcacgtcgtacttgcgggccgcctccaacaggcggaacgtgccctccacgttcgtcttcaaaaacggctccgggttcgcgatgctgttgtcattgtgagactccgccgcgtaatgcacgatcgcatcatgacccggcacgattttgtcgagcagctccgcatcgcagatgttcccgtgcacgaactccacacggtcgcccagaatggacttgatgttctccaggttgcccgcatacgtcaacgcatccaacaccgtcacatgcacgtccggatggttgttgtacacgtaatgcacgaaattcgaaccgataaaaccacaaccaccggtcacaatgatattatggggagtaaacaattcttcagccataacttacagcataccgtcaggcataccgagatggcgagcaatcgggaaaagatactgctactattgctgaattatccgatacggagttcgtccatcaatcgtttcgccgatgcgttcaaacgagtacccgtcgaactgcatctcgtccagcttctggggggaaagcacattgttcaccccgagcttgcgcaattgcgccggcgtgacatgcacggtaaacgaatcgggcgataccagggtaaatacatccgccgcttcttgttccaccacgttcacggaaacgaatgcataccggttgtatatctcttcccatcggccgttcggatccagtttcttccacgtggcaaggtcaggtgtgacctccaacgcattcagcgtgtgcactccattggccaccgcgagattcgccagctgggagccgaacgcatcatcgatagcccacataccttgatacttggtctgcagcgactgcacctgttgcatcaacggttgcttggtcaggggtgcgctgccatactgtacgggattcacggatagtcctgataccaataatccgatggatacaatcggtgccacaacagtacgagcaattacgccattgctgagaacagcaaaactcagcagacccactatgacgaaacacaccataaccaatagacgcccgatatacggcagatacatcccatgattcgtccacgccagtactgcggcgaacacggaagctgccagtaacgactgcttccaagaaagcccaccctctgtaatagccaccgcacgaaccaatatggcaatattcgcaacgcccaaaaccaccacgcatcggccgctggtcacagaggtcagcatcaatattttcgagagccacagcggcacgcccacacaggcgaatattgagaacaacgcgatgaccgcaataagacaaacgctgagtatgtcaactttcttccgcttgatcatgccgaagagagcaaggattattccgagcgggaacaaatccacaaaacgcgatgcctcaaccatattggttgccgcagaatcaacggcataatccttgaacgggaaaaagagagtgcccacggacgatatcagcgatagagggggcaatcctcctccagtggattgcctcgcacccggatatgccgtgtgcagcatggattgaatcgtaccccatgaagtcataactgcagaaccgagaattacacagaataatgcaatttcgcctaccaaaatcacgacatcttttcgagaaaccctgatttgcccccagtgccgtataacgacccaaagaatgagcactgcgagaagatagcccagcgaaatctgccatgcggggtacaacgtcagcgcgaacatccctgcgcatatcaggatcactgcggcatatgcggccctatggccggtttcagtgtcaccaaggtaccggtcaaagcacacgatggacacgaatatcgcgataagcatctcaggcaacgcattgaccgcaaaccaccattgcaccaacggggcacatgcaatgaggatggcgccaacgaacgctacacccttgtgcttctcctgccggtgatcattgctgatgcagaggaagaactcatacgcggctaagaaaagcaccactaggcgcgcagaccaataaaaagcaagccctcggctactgccaaagaggatatacccccaatggaatggtcgaaatatctcggcgagagccagcacaggtgcatctttgacgatgaacatgtccgccggtttattgccaaacaaatcattaaagtagctatacccggagtagctttgcgaaaaagccagaggagtgcccaccacatattcgtcggttcgtattatgcgcgggattccccacaccacgtccgtggacatgtcatgccccagccagtaattccacatgcctaaggatgagccgttgacattgagaatgaccgcaaaaagaattatgccgcaaccaatcgcaaaacgatacctatgaactatatgcccgatggcacgaaaaccatataagaaacaaaaccacagaagtagaaaaggtacaaataagaccaatactcgtaataaaacgatgtagacttgcggagcgacaccaaaggtaagcttaaaaatatgctgctgtatgattggagcacccagtgcgagaattatgctgcacgccaatgcgcctataatggcaccgaccaatttcctccacctgacggaacgcactaaggtttttcttttttcagccacaatacttaccatcagttctcctcgacaacagaaaacatctagaacatcctacaaaaaggaagcccgtcatgcacatataccaccttcctcagcaggtagtgctcgagtttcttgtgcactttgttcctcgccagtccctgtggcgataatcagttcgctgtctgtacgctctcatcgaaccttgacatgttgaggtagcatcgtgtcggtcactcgttggaagtcacgtaacgcgcacatatgagcatcaacgtgctccgtccgtcgagggagctgctggccccaccgttttagtcaatccggtgtttcgtatgggagtctcgtcttgtctaacgacaaaaaacgcgcatagggcataggacacgagtcacatcctttcaactcaagctcagaccaagtgcacaaaatttcagacgttagggggtgcggacggaaagttggacgcttgggcgtccggattggagtccgcatgttttcgatggaggatcggcgcagggccgttgacctgtatttcacggagagcatgaccatcaggaaggtcgtcgccaagctcggctacccgtccgagggcgcgctggcgaaatggcttcgcgaggacccgcgctacacgggcgcgtgcaggcgttcgtatacgctggaatgcaagacgaacgcggccagacgcgcgctcgagggcgagcccctcgcccgtgtggcgcgcgacgcgggctgcacgccgacgagcgtgtaccagtggatgcgccgctaccggagcgaggggatactaggactgatgaacggaagaaacgcgccgatgccggccgaaccgatgcccacggccggcgatgacgtggaggagctgcgtcggcaggtggaggccctgcggttggagaacgcggtgatgagggagacgatcggggttttaaaagccgacgactgtgttgggggtggtgccgttttcttggactgtgatccgaggaggagacggccatggcgaagtacacgagggaacagcggcaacgcgcggtcgagttgtatgtgaaatacgagtgctgcgcggcggatgtgatccgcgagctggggtatcccagccgggaggcgttgcgcatgtggcaccgggactggcccgacgaacaggagacgggcgtgtcctcgcagcgtggtgaacggtatgcgcgctacacggaggagcagaagcgtgcggccgtggaccattatctgacgcatgggcggcgtgcgagccgcacgatgcgtcagatggggtatccgagcaaagaggcgcttgcctcgtggatcgacgagctcgcgccgggcgaacgccggattcgccgtggcccggttcccggggaattgaaacgggatgcggtcctgaaggtcgcgtccggcgaattgagttcgcgcgaggccgcggaggcggtgggtgtggattcgtcggtcgtgcgaaactggaagcgtcaactgctcggagacgcgaaaggactcatggtgacgaagagggaaccggaacgcggggattcctcgcagcaggacgatccggacgcgctgcgcggcgagatcgccacgttgcgcgccgacctcgagcgtctgcgcgccgaacagcgggccatggagatccggttggcgatcatgaagggtgcggcggaactggtgggaaaagagccgggcgcagacccggacaacctgacaagccgagagaagacgaccctgatcaaggacatcagtgagacgttgggcgtgaacgcggagagcctgctgaaggaggtcggcatcgcgcgcagcacgtactactaccagttgaaggccatgcgccggccggacaagaacgcgaacctcctgtccctggtgcgcgaggcgtttgagaacagcaggaggcgttacgggtacaagcgcatccacctcgagctcaaaagcgcgggcatcatcgtgtcggccaagcgcatcatgcgtctgatgaccagccacggcatggtccccgtgctcaagagcgcgaagcgctacagttcgtacaagggcgagatcggcggcgcacccgcgaatctcgtgaaccgcgacttccacgccaccgcgccgaaccggctgtgggtcacggacatcaccgagttctcgatcccggcgggcaaggtgtacctgtcgccggtcatcgactgccatgacggcatgcccgtcgcctggacgatcggcacgagccccaacgccgccctggccaacggcatgcttcgcgacgcgtgcgccacgctcaagcccggcgagacgccgatcatccactcggattaagccggttttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcctgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcggggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcccgcgtccagacgcggcggaacaccacgccgggcatgcccggggagaccggattgccggtggaggtgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgtacgagaaccacgagcggcaacccccgggattcgcgtcgatcctatgggcgatccatcgctccacgacgccccgctccagacgcacggccccgtgttcgaggcaatgccggtcgaacgagcgcaggacctggacgcgggtggcgccatgcctgcccatggacgccttgaagcggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcatgtttgtgttcaattagttgttgcgggtttagtcacgatgatttttcgggtttagattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaaccccaggaatcggcataacagcgcggttccctcggcgtgtcgcacagagcccactttgctctgatgaggctaggttaacccctcaaatgtttctgaaaagcatcaaatccactattcggctggcgtgtcgcgagagttttcagcttgtcggccctgcgttcatctctcggcaaccacactgccggcgcacaatcggcgcatgacagcgctccgtcatcggatttcgttcatgaatcgcgggtatacctgtagttatgaccaagaagattgctgtattaaccggggcgggcatttccacgtccgccggcatccctgatttccgcggtccggacggtgtgtggaccaagcatcctgaccaaatgagcgtttacgacatcgatctgtttctgcgcaacaaagaggaccgcgagtactcctggcgctggcaaaaggaatcgccagtatggaatgcgcagcccggcactgcgcataaggcgctggtcaagctggaacaagccggcatgctgacgctgctggccacgcagaacttcgatgcgctgcatgagaaggccggcaacagcgacaacgtcatcgtgaacctgcacggcactatcggcacctcgcattgcatgaagtgccatcaggaatatgccacggcggacatcatggcccgtttggatgaagagcccgacccacattgccatcgcaaactgaagtatcgtggcgatatgccgtgcaatggcattatcaaaaccgatgtggtgtatttcggtgaggcgttgccggacggcgcgatggagaagtcgtacagtctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgttgccctgccgaagttggtggacgagacgattgcggagaacaagtagccctcagcataacgaaagcgccggtgggtgggttaagcaactgatgattgtggttaaccacccaccggcgcttttgcgccacctcccgccagcgggaggtattggagcacacttctgcgcggcttcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctggcccggagtatccggcagctcgacctcgaagttcatgatgcggccgcgggcgatcatacctttctgaatcaccgcacccatggtcacggtgtcgatattgccgccggacataatcggaaccaccacgtgcgggccggtggcggcggcgaacttgcgcgaacgcaggttcaggtgttccagcgcagccagcgaaacggcgccggccgcctcgaccaccagcttatgcttctcgagcatgagcagaatcatttcgttgatgtcgcgctcggtgacggtgaccagatcgtccaggaactcgttaatcagagcgaagggcaggtcgccggggtgcttgaccgcaacaccttcggcggaggtaaccacatggtcagccggagacacacgacccgcggccagcgagtccttccaggccggtgagccctccggaatcgcaccgattacgcgcacttcaggcttgaatgtcttgatggcgagcgccacgccggcacccaggccaccaccaccgagcggcacgaccacgtcagtgacgttcggcacgtcttcaaggatctccagaccgatggtgccttggccgcagatgacttcgtaatcgtcgaatggcggcacgtaaatcatgccttccttgtcggcgagctcagcagcgtgggcggcggattcatcgaacacatcgccgtacagcaccacgtcggcaccgtaggccttggtggcatcgaccttcagcggcggggtgatctgcggcatgcagatggtggccttggctccacgctcgcgggccgcataggccacaccctgggcatggttgccggcagacgcggtgacgatgccgtgagcgatctgctcttcggtgagcgaagcaatcttgttataggcaccgcggatcttgaaggatccggtgacctgcaggttttccggcttcaggagaatctcatggccggtcatctcgctcagcaccggagaaggaatgatctccgtgtggcgggcagtgcctttgagtcgttcggcggccagcttcagttcggctgcatgatcacgttgcagcgccttcaaaacatccttttgttccatagctttccattgtaagcaccacaatgccgagagacaccagctatctcgcttcacagaggtacattcggccttttgcagacagctatctgttttcataggggtaccgagaagcaaaaaccccgggtataagccttgattttcaatgcttatacctggggtttcgacgttacggtacctctctcaagacagatagcatttcgggatagccccgaagtacctctttgagcggagaaaggcactcaatgcactacaactggatgacggctgcctcccacgggtcgagctcgcggttggcaagggaggccacggtgtgcggagcgtcatacgtgctgatcaccacattcggctcggcgattccgacggcggttagttcggcagcctcacgtggcaggtcaacggttcgactggacatattgactacgaccaacaacttctcagcgtcgagctcacgggtaaaggcatagacgtgcggatcagcggcgtcaatcagtcgccagtcgccggcggccacgaccgggctgttgtgacgcagcgcaacgagttgcttgtagaaggagtacaccgaatccggatcatcgaattcaccggcggcgttgatctcggcatgattcggattcacggaaatccatggctcagtggcggcgtccggagcggtgaaaccggcgtagccggaaccgtcccattgcatcggagtacgcgcgttgtcacggctgcgcgcggccagaccggccatcattgactcagacgactgcaccttggcctcctcgaccctctgccggtaggcattcaaggattcaaggtcacggtactggtcgagacgcgtgaagtgggcgtcggtcatgcccagttcctcaccctgatagatgtacggggtgccgcggtgcatgtgcagcatcaggccaagtgccttggccgaacggacgcgggattcctccgcggagtcgtcgccccagcgggagaccacgcgcggctgatcatgattgccggtgaacaagctggcccatcctgcgttctgcacggcagtctggtaaccggccataatgctcttgaatttcggcaggtcaagcggcagcggcttccacttggtaccttcgcaatcaaaatcaacatgctcgaacaggaagagcatgtccaattcaccgttgcccggatcagtgatgtgctcgttacgctgagccgtgacgcctggcgcctcgcccacagtcaggaagccttcacgcccctcgaatacctcacgtcgcatttcagccaggaattcatcctgacgggggccgtccgcacagaacggattcgggttggaatagccctcctcgcccacaggaagatcctcaagctccgagccgtactcgcccggcagcttgccgttcgaatcggtgcgcttggagatcagggtgatgacgtccatgcggaagccgtcgacgcctcggtcaagccaccagttcatcatgtcgtacacagcgcggcgcacggcagggttctcccagttgaggtccggctgcttcttcgagaactgatgcaggaagtattcgccacgctcggggcagtattcccatgcggagccgccaaagtaggagccccactgattgggctcggcgccgggctcgccgggcgtggtgccgggacgagccggacgccaccaataccagtcggcgtgttcgtcgtctttgttcttggatgcttcaaaccaggcgtgttcatcggaagtgtgattgacaacaagatccatcacgatcttgagcccacgcttgtgggcctcggccagcagctcgtccatatcgtcgagcgtgccgaacagaggatcaatgtcctgatagtcggaaatgtcatagccgttgtcgtcttgcggagacttatagaccggggatagccacagcacatccacgccaagatcagctaagtaatcaagacgcgacgtgatgcccttaagatcgccgaatccatcgccgttcgtgtcttggaaagagcgcgggtaaatctgatagaccaccgcgttggaccaccacggattgggggtggcgccgttggtgcggatggcgtcggggattattgcgcggttgaaagtagtcatcattggctccttattgatatctatattgctcgttgctcacagtctaaaaattggcgaattacattcccattggagaactgcgttggtgtgccggaaaataaatttcaatcggcatatgcgctttcatgattgcacccggaaaacacgcagtcggccgtactcgatctcgcaagtatgggtttctcccggattcatatcaatcgtcgcaccatggtcatcgatgatgcggcaagagcgaccgctagccgtaataatgccgatttgtggctgccggcgcaatccgacgaaagcgatgacctgttctgcgccgaatcttgctgtgacaccgagcgcatagtccgtatgttcggggtcattgagcagtgacgcaatgactggtcgggccggctcatcaggacgcggtaatgtaccatcttcggcaagtaaatcacgcaagacagccgcatcagtgtgaccgcaggcatcggaacaatacactggtccgccgctaagcaatcggagcacggcatggactcgcgcatggggatgctccgtccagaacatgtcccaatcacagtggtacagctcccccatcagcagtgcacagtatgcgttctggataaggtgttcgcccagcgaatcaggattgtgcggtagatagtcgtcgctactacgggtgattggcgatgaaggacgatgccaataatcctccggtgccatgcccatgcagttaatcaatgcgccgccgaatcgtcgtgaggtcacttcatcaagcgcctgatggcgtccccaggtggcttcaccgtaactttcggtgccacgaaccattactgacgtggaactttgcgaatccactttgacgaaatcgacgccggcttcggcgagttcgccgtcccaggcatcccagaactgtgcgggttgttcagcacgacttccaggaatcaggcaaccattcgccgtggtggttattgcggtcgggcagctggccgcggctacacccgattcgtccaaaccattccaatagccttggaacgcctgccacacgcctacgctgcgcacgccatagtgcgttttgagcagcgcaatggtgtgggcaagcccgtgggggaaacgttggcgatccgcgccaaagtcgatcagggtttcctttgtgcgatccgtgttggaccaaccgtcatcgataagcacccaggaaatgggcacatgcttggcttggaactcctccatcttgttgacgatagcctgctcgttgacatctcgccccaatgaatcccaagtacaccatcccaacccggtgagcgcatccgggaatggacgctccttacgggtgcgaatacccagctggcgtgctgccgtttgtgtggcagctcgaatggccatatacgggtcggatgcgcaagcgatatatgcggcagtgtcacatagagtcgtgcgaccaacccggttggaagacagcacgagccgcaaagccgtgtcatcagattctgttgcgggctgcccactgaaatcagcccgaatatccgtgccgcagatagcgaccaacactagccactcggcatcttcggcatcgttgttgcggcgtaacaataactgcgtgcgttcaggcagttcagatggtgtacgcacccaggtcgggcgcatccaccactccttgtgctggtatagcgccagcatggtgtcatcgttgccgctgtcgacgccggccatggtgagcgacacgtcaatcgcatggtggggctcaaacgcttgttgttcctgaaaggcagcggcgcggtccttgggctggggtgcatgcgcgttcacatcgatacgccagagtcgcacctgagcatcaccctggatacccgcactggacgtgcactcatcttcgcatgattcgggaacgattgtgacggcttctaccggcagttcacagattgccgaagcctgttcgccatagacggcacgaccggtatcaagatgggccgttaccgtgcgaacggttattggacaggtttcggcaatcattggcgtaactccttggtgttcttcaatgagattatgctggcaaggcccagacggtagcagctggaggaacgctctcgacctgagtgttcgcctgcacagtcgcgtcagacacaagtagcacggtcatcggctgcggcaaggcgactggttgactgtcagagaagttcgccatcacaaccatgccggacggcaagcgccaaccaagcagcggcgccggacactcttcgttggtaagccacgagaactggaagtccgtgccgttggccacccactgtttgcgcaatgcgacagcagcacaatacaggtgcaggacggaagccccgtcaccaatctgacgattagtggcatactgcgcaaaccatgccggctggggcagccacgaagcaccggtggcattgaagccgaacgccgggccgtctgactgccacggcagcggtacgcggcaaccgtcgcgccccttgaaataatgaccggaacgttcccaattgggatcctgaatttcatcttcggtcaaatcaaagtcctccggcaaaccaagctcttcaccctgatacacaaaggcggtacctggcaggccgagcatcaccagcgctgctgcacgggcacgacgagcggcgagcgcggggtcaatcggcggattcgtgccgttggacgtcacccactgctcgatgtttgcaccgctcggcagtccgagacgcgaggcgatacgtggcacatcgtggttgccgagcacccaggtgggggcggtttcggcagcgagagcatagcgatgcgtgcgctcaatcgtggtgcggtattcttcgcgattccaggcggcctttgacatggagaagtcgaatacggcaccaagttcatcaggcttggcgtattggaaaatacgggtggtgaatggcgaccacgattcgccgaccgcatacttggctggcgtgtactgattgaacaggtcgcgccattcacggtagatatcatgcacggcgtcgcggtcccagagcggatcggagccatcggtagcctgtggagacatcagtgtcgggtcgatacggtcgcgcagcggctcacgcaggtctttggccagaccgtgcgagacatcgatgcggaaaccgtccacaccgcgatcgcaccagaatgtgagtacacgcaggaactcatgccgcacctcgggattgtcccaattgaggtccggctgctccttggcgaacagatgcaggtagtaccagccgtctccacacgactcccatgcggaaccgccgaagttactcagccagttggtaggcggcaattcgccgtgctcccccttgccctgccggaacacataccgttgtgccgcttccgattccggaccttgagccagggcctcttggaaccaacggtgctgatcggacgtgtggttcggcacgatgtccacgatgatgccgataccgcgttcgtgcgctttggccactaattcgtcgaactgatcgagtgtgccaaggcggggatccacatcacaatagtcggcaacatcataacctccatccgccagcggcgatggatagaatggagaaagccagagcgcgtccaccccgagcgcctgcagatagtcgagacgatcgatcacgccttggagatcaccgttgccgtctccattggcatcgctgaatgagcgggggtaaatctggtagatgacggcgtcgcgccaccagtcattgttggtgaaagtcatatcgttcccctgtccgattgctcggtacgtatggttttaccagtatggccgcacgaaacactgttccggcggccataccctacatcctcttgccttcggatcagcccttaaccgagccggcaagcatggcgcggatgaagtagcgctggaggaagatgaacaggatcatcgtcggtgccatgatgagcagtgcgcccgcgttgagcagcaccacgtcggtctgatactggccaacgaacgactgtagggcacctgccatcgtgcgcttgttcgggtcgttctccaacaccacagccaacaggaactggttccaggtggccaggaaggtcagaataccgagcgaggagatggctggcagtgccaacggcagctgaatggaacggaacgtgcgcagatggcctgcaccatcgatggatgcggcttcgatcagatcacgcggcatctgctcgaagcaggagcgcatccacacaataccgaacggaatattcaggccgatgagcggcaggatcagggcaagacgggtattcagcaagcccatgccactgatctcgtagtacagcggagtgaccaaggtttcgaacggaatggtcagaccgacgaggaacagcacgtagatcaggcccttgcacggcaccttgagctgagcgaaggcataaccgccgagcgagcagaagatcaccacgcagggcacgaccacgatcaccagaatgcagctgttgagcagcagcggggtgatgtttgccatgttccaggcgtcgatgaagttctcccagtgcgggtgggcagtgaactggataccttcgggcatggaaccttgcggctgcaatgccgcggagagcatgctcaggaacggcagtacgcagaagaggacggtcagagcgagcatcgccgtgccggtgatgcgaacggctttggattgctgcatggtcactgctcctttccgttgaccagacgctgcagaggtccgacgaccagcagcacgagaatcatcagggtgacggcgagtgcggaggccaagccaacgctctgctgggtgaaggccaagcggtagacctgcacgccgggcaccatggtggaggtgccggggccgccctgagtggacatgtacaccacgtcgaagctggcgagcgcggagatgatggtcatggtcaggcatacgccgatttggccgcgcagaccgggcaacgtgatggagaagagctgacgccaccagccggcaccgtcaagacttgctgcctcgtacagggactggtcgatgccgccgatgcccgagagcaagagcaccacacagaagccgagctgcagccagaaaccaatcacgcctaccgcgttcagggaggtggattggtcgccgagccacacgtgggcgaagtcgccgaggcctactgcgcgcagcagctgattggcggtgcccttgtcggccagcatccaggtccaggccacaccggctgcagcgcctgggataacgcgcggcaggaacaggcaaacctgcgcgaaggaacgaccgaccttggacttcatgtctttgatgagcacggcaatgatcaggccgagcacaatcgggatgatggagaagaagatgatcaggtagaaggagtgcagaatcgatccgtacagatcggggtcggtgaacacggtgatgtagttttcgacaccgatgaaggtgctagcatcgataccgttccactcgtagaacgagtaccagatggtctgaatgatcggccacaactcgaaggcgatgtagaacacaagcgccggagcgaggaaaagcaggctgaccagaccgagggacatattgcgcttgggcttgaccgccttggctgccttatgggaatccatgattgtcaccacgctttgctggtttggtgtgaactgggaatcgaacatcgcacacaacgtcgtgcgcgcgatgggaaggaaccaggcggagcgggaaaaagggaagaacactccgcccggtaagtgcaagggttacttgacctccttctcgtactgagcctgaatggattcgacgaatgccttgggggtcatcgtgccgtcaatcagggactggaagccggggataatggcgctggcctgcatacctgcggtggcgttgttgatgtagtcggtggtgttaccggtcttcaccagaccttcgtaggcggtaaggacctggccgagaagctggttatcggtgctcggagtctcgccttcgccgaccggcgggtagccgttgtcaactgcgatctggcgggcttcgtcggactggaggaagtcgaggaaggcggctgcagcgttcttgttcttggcgttggccgggataccgaaagcggtcacggcgttggctgcggcagaaccggaatcggccttttcgccggggaaggcgatccagccggcgtcatcgccaagtgcatcgttgatggaggcggagtaccagctgccggaggggaagaacagggcttcgccgttgcagaagcggctcagtgcagtggaaccgtcaagggcgagcgcgtcggaggagaagtaaccggcatcctgccagtccttgatcttctgtgcagccttcacggcaccgtcggtgttgaaggtggcgccatccttctggataatccaatcctgcacggtatcgcgaccctcatagttggtgagcaatgcctggtagatgtaggaagtgccgccttccttggccggcatcatcatggcgagcttgccagcgtcggaggccttcttcatatcggcctcgagctcttcgacagtggccggagcctcggtgatgccgagttccttggcgactttcttgttccagtacaggccggtcatcgagacaccgtccggcactgcgtagaggctgccggaaccgatcttaccgtcggagcccacgcggtagacctgagtctgggaatccggcagcttccaaccgtaagcatcggcgtaagcgtcaagattgacgacatggttgccacgcacagcggagttgatgtcggtgatacgggcaatgtccggggtgtcggcggcggagatgatgcgcgggccattctgctgggaggtgttgtccggatcgtaggtggccttgatggtgatgttcgggtacttcttctggaaggcttcgatcagctggtcatcaaaggtcttcaggccagcgccgtcccacagcttgagctcatacttggtatcgccaagatcagtgctcaccgcttcggtttcggtgttggctttgttgctggacgagcccgggccgcaagcggcgacggatgccagacatgccacagacatcagaccggcaataacggttttggcggttcgttcgatcctcattgatcattcctttcttccttccgggcgatcccggctatgtcttccttggctatctcggcttagcgtatttgctaagcgcttatgcatgaggataacagatgtcgaaccggttcgtcaaatccgcaacacgcaaacaaatggccgattcccgaagaaatgaggaaggcttgacgttccccataggcaagcacttccttctcgcgaaattgcaacatcggtcccttaaatacctaagcgcttattcattcacctaggatgacgtttcgaaggctcgggcagctcgggaaaaattgaatgtggctcaatttgataccagtacgccacgctagacacatcatcctgacgctcaaatgcaccttcatatcctgaaccaatttgttgaagcgtgactctaagctcactatcaaacctgatgggatcaggaatatgccatcggtacaagccacgcataggtggacaataatcgtcatgatattggtttgctatagccccatcgcgcacagaataaaatggatatcctacatatggggcacaaaaagtacgctcgcgcgtatgaccatctcgctgctcagcgaagctccatgcaccgccaaaataatcttcggtgccggtactacacactgtgggataatcgttatcgccatctaggaaaaacttaatctctccctcaccccaccaatatcgttgcaacgtagaaatagcaagatatgtgccgacgtaatggccccgtccgctgactccatcgaggattacatagtcctcgcctaaagtagtgattggctgtctgcgccattgcgcatggaaataagccatttcacgggaggaatacgcattacccaatgcataatcaatctgataaaacaaagccggaatagcatgagcgtggtcattgcgcactacgatacgtgcccgtttacgaaacggcatcgtgaaataacaattcatacctcgtgtaggtgccaccacaataggctctgagaacacatcgcaactttgtccaaagccgcaacagaagaagtctcctaggggacattccacagaaggtcgcttttcatcatcccaatagatggcaagcaccgcatcgcgcagaacgtatcgatcagcgtcactggtgcgatccgtaacggtaaaccacatgtgccgaatacaaccggggccttcaatatctgccaatgtcacagactgcccgggagcaatgtcattcaaacacggctttcccttgcgcgacggccccaacggaccagtttcacggcaaccaaaacccttggctcccgttgggttctccgcattaatcgaacatgttacttcgtcgcggacagtcggcaaatccgataaagttcccgcgtacggtcctgccatcatcataggttgactctcctcaaatcaagcgtcgctagcgaaagcggcatataagttgaagctgtttctaccgcttcgcttctttgtcatattgcgcctgcacattctttgtgaattcctgaggcgtgatgctgttatccagcagtaactggaagttagggattagcccacttgactgcattcccgcagtagcattattaatgaaatcgctagtatgaccgctcgtcagcacgtcggcataggcatcaaacatactctgctgcaatgcgctattcgccttgagatccaaagtagatgattttggcaaatagccagaattgtcaacaataatctgttgcgcttcggcactttgcgtataatcgaggaacgccgcagcagcatcacggttcttagcattcaccggaataccataaaatgcacctgcattagcagcaacgttcggctcatcttcactggtggcacccgggaaagcaaagaactgaacatcatcacccagcgctttggccacagtatccagattccaattaccgctcgggaaaaatagtccttcaccattgcagaacctgctcagagcagtagaggcatccactgcgttaacaccttcaggcatatatcccttgttattccaatcctgcaaggtggacgcagcgtcctgcgccgcctgattgtcgaaggtaccagatttctgcaaaatccaattctgcacatcttccgcagaactgttattagccattaacgcctgaaagacaaaagaggtaccgccatccttggcatatgtcatcatcggcagtatgccggcatccttggctgtctgcatatccgcctcaaactcctcgacagaggtaggagctgcatcaatacctagctgctcggcaagcttggtattgaaataaatgccagtcaccgaataggagttcggcaatgcgtacaaatcaccgctgccgagcttgccatttgaatccactcgatacaattcagtctgcgaatcgggaacatcccagccgtacgcatccacatatgcctctaaagacaccaaatggttgccacgaaccgctgaattcatgtcggtgacgcgggcgatatccggcgcatcttttgctgaaatcacacgcgggccattttgtccagagacattatccggatcatattgtcccgtgatggtgatgtttgggtatttcgcttcgaacccggcaatcagcgcctcatctacagccttcagacccgctccatcccacaaagtcagctcatattttttattacctaaatcagtgctgacctcagtaggatttgtatcacttcgtgagctacttgccgagccgggaccacatgcagtcagacttccagcgataaatatcgcagcaagcgccgcgccgctgttacgcataatcctattcatcggttacctccttgcatcctcatcatatgcaatcgatatttctctttactgtcaccatttttcggcggcaataaaatatatttgcgatatcgattacgcacatcgtacatctttttgcggaacccgtcaaccttgcatcacaccaatggtggccttaacttcaaaatccagatacaatacaatcgattacgcaatgcaggagatcccatgagcgaaccaacaatctatgaagtagccaaggaggctggagtctctgcggcgaccgtatctcgtgcaatcaacggacgtgaccgcatatcggaaactactaggcaaaaggtatttgatgcatgtgcaaagttggggttttcagcatcgaaaacagcctccatgctgcgaacgggaaagacaaatcgtatagcacttaccgtaggtaactcactggctggctggttcagttcacaactagccgaaggcgtatattccgtgctcgcatcccaaggatatgacttgctatcataccgacttgcaaacgccgatcaaagacgcgatttcttttcctcaatgccagtgaagcgcaacgcagacgcggtcatcatctcctccttcgacatcagcgagacagagaggcgaaccttagaacaactcggtatgccagtcatcggtgtcaacaccatcgggcttacggaacagcgagatatgatttccatcggcgtagacgaaattatagcaatgcgacaaaccgttcatcagctcgcaggactgggacatcgcaatatcgcctttatctgcaagcagcaagacagtaacggattcatatgggaagctgaccaacgtatagaagggttccgtcttggcatggcggctgagggactcaacttgcccgacggatacatcatcgcagtacaggacaacgaatttgccggagcagaggcactcagtagcctgctcgcactctcccctcgcccaaccgccgtatgctgcatcagcgacgagaatgccattcctctagtccatgcgcttcgctcatacggattccgcgtacctgaggacatatccgtcatcggattcgatgactggccaatggcacaagcgctcaatatatcaaccgttcggcacgaccctcggtcctacggagcattagcggcagatgccgcaatccgattatcacgaggcgaaattctgacagaaagttgcatcgttgttcccacgacgctcatgttgcgcggcaccacaggcccagcacctcgagattaaacatcgacaacgtccgcatttgatgatgtgcatatcattattgcaacagcgaaacaacaggtaccagccagaggaaggacgaccgggtaacagccacaaggcggccacccattcaccatgaaacgcgcgaccatcaacgacgtagctctcacggccggagtctcaacttttaccgcatcccgcgctttgcgaggtaaggatcacgtggcagcagctacgcgggataaggtgctgaaagcggccaaagagctgaattacaccgcgtctcgctcggcggcggcgctggcaagcggacgcaccaatcgcattgccatgctggctcgcgaacggctggccggctggttcatgggcgaattattcgacgggctgtatgacgaactgagccgcgcacgctatgacttgaccgtataccgagccggcagcgtcgaggagcgtgcggaattctttactcggctgccagccaatcgtaacgccgacgccctcatcgtatccggattttccgccaccgatgaggaagccgacacgttggccagcatgggtatgcccatcgtctcggtgaattcgccgtatatcagctgctgccaagcctccgtggccattgatgacgaggcggccgaagccatggcagtgcgttatcttgcggccctcgggcatcgtcgtttctgctatgtggggcgcaccgatccgctgaccggcaaggaatggggattcgatgcacgcgcacgcggatacaaagatgagatagtctcgcttggcctcaccgactgcggcatccacttcatcgactcggaatcaccacgctcggccaaacaagtcatcgccaccatgctcgcgcagcctgagcggccgaccgctatctgcgtgtggtctgactactacgcattgcgcgtggtacatgagttgcaggcaatcggagtacgaatccccgaagacgtttcggtctttggctttgatgggtccgacgtggcggaatccattggattaagcaccatggtgccaactcccccgcgcgaaatcggacagattgccgcgcgcaaggcactgaatttggttgaggggaagaccttggacgaccctcatacgactgtacctgtggcggtcgagcccggcgcgaccagtgggccagtgcgggaataggcgatatgggaaaagcccccctcggcggaaaaccgaaggaggcttgggtggagctgcactacttcacagcgcctcgcatgactccaccgacgacccacttttgggcgaagatgtagacgatgaggatcggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgattcgggccgcctcttccagcgaaaccggaatcgaacggatgaagccagtggcgatgaacaggttcgtgcccaggccgagcaccgtgtacagaatgatcaggccgacctggttgtccaggtgcagggagcccatctgcttcgcaatcggcagcatgacgaccgggaacggcacgaacatggcggcgatgaagaagtagtacaggaagcggaagaagcgcttgtccatgttgcgggccacggcgtaggccacgaaggtgttggtcagcagggtgagcaccacggcggccaccgtgatgatcgcggagttgagcgcggccttcgggtagttgaccttggcggaggcgtcggcgaagttgtgccactgccacgaggtgggcagggcgaaggtgccggcttcggccggagtcttcagcgcggtgacgatggtgaagtagagcgggatcagaatggtcaggctcagcacggccacggcggcggtcagccaccagttgatcttgtggtccctgcggaacttggcgggcttgccggacttggacggggtaactgttgcagtagtcatttcttatcctcccctaaatcagatctgttcctggctgcgggagatgcgcagctgtacgaaggcgatgatcgccagcacgatgaagaagagcacggcgtttgcggtctggtaggcgtactcgccaccggtcaggccacccttccagatgaggtaggtgacggtttcggtggaggagttcggaccgccctcggtcaaggcgacgacctgatcgaaggtgccgagcgcgttcttcatggacagcacgaggttgatggtgaagaacggtccgatcagcgggaatgtgatcttccagaacttctgccaggcgttgacgccgtcgatggcggcggcctcgtagatttcgtcgtcgatggtctgcaggccggcgaggtagatgagtaccgagtaggcgatgccctgccagacggcgaggaagacgattgggatccagctgagttgctcattggtcaacagcgaggtggacagccacttgatgcccagcgccttgccgagctcgggcagcgggttcatgaagatgtacttgaacacgtagccgatgaccagcacggagagggtgtaggggatgaagaagatggctcggaagccattcttgaaggcgatcttcgagttcagcagcaccgacaggaacagggcgatcacattaatcagcaccgtgatgagaatggcgatgaggaacgtgaacaggtaggcatggcccactcggttgtcctggaagagggcgatgtagttcttcaggccgatgaacttgtaatcgccgtagccctgcgagttggtgaaggaatactttacgccatcaagaaatggcaggtacaggaagaaggcgaagatgatggccgccggaaccaccatccagtagtaggcggggtccactttgcgggtggagaaggcggagaccttcttcttggccggtttcttggcagcggtcttggttgcggttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctcggattccttctcgactgcggtcttccacagttcctggaacgtggtcttgccttgcttgagctcggtgtacttcgattcgggaaccagcgtgccggtcagggaggcgagcggtgcctgggtggtccaggcgtcggccacggaaccctgcagcgggttgatgccggcgtccttgaaggtgttgagcatatcggtgaactcgctccaggtggtcggcggattctccgggtcaaggccaaccttgcggaacagagccttgttgtagatgtagccggaggcgttacccgcgaagggcaggccatacaggcgcttcttggaggaatcggtggtctgcaccagattcttggcgatctgcaccatgccggggttgagggtgtccacaatgggttcatcggtgaagtcgtagaacacaccggaggcggcgaagttgccgaagctgatgtcgccgttgaaggtgatcacgtccggcacacgattcttgacgaaacgggtgcgcagatcggtctgggcgttggcggagttgttgatgttgaccttgatggtcgggttctgcttctcaaagtcggcgaccatggacttgaactggtcggcggcctcggacttgaactggaagaaatccagcgtgacggtgcctgcggtgctggagccgcagcctgccaggccgaagccgacggcgatcgcgcacaccacggcggcggtgcgcacggccagacgcttcagtctaggcgttgcatgtggggaatcggacagcataattgttgactcctttatctttcttttcctccggcttcggtgccggcggttcttccactttccaaggtaacggttcggccatttcattcccagcgccagcgagcccacttgcgcaagcaacaaaaagcgcggtattttgtgattaacgcaataaatacagcgagggggggcttgcatgtctgatgccaacgcgattccacagtggttttccggatccgagcatacgcatcgcgtggcggcggcaattgcccaatacgggccgatagcccgcactacgttggcacagatgctgggactgagccaaggggccttgtcccgcatcaccagcgatctgatctacgccggggtgatcgaggagcttccggccgaggccggcccgtcaggcaagctgcccgagcgattcacgccaagggaaagttcggatcgtcgcggacgcccgcagacttcgctggtgttgtgttcgaacgcacgcaccttcattggtgtcaaggttcatgggatgtcgattgtggccgctgcggtgaacgcgcatggcgaggtggtgtccggccggcacgaggtgccgatcggggcggatcagtcggctgagtatgtggtgtcggccatcacgcggctggtgcgcgaatgttccgccgatatcgcctcttccggactaccctcccccactgcggtgggcgttgcggtaggtgggcatgtggtcgacgattcgattgtgacgttcgcgccgttcctgcattgggacggggccacggacttggggacgatggtcacagaggcgaccggcctgccgtgcggggtgttcaatgatatcgattctctgctggtggatgcctcctggttcgggccgggtgtcggcgtggatatgttcgccgtggtgaccatcggcgtgggtgttggttattcgctggccgtgaacggcaagccagtgcagtacccggataagagctatggtctggtgggccacgtgcttatcgatccggaggggccgcgctgcaccagcggacatatcggctgttcacaatgcttgactgacgattcaatcgccgaacagtactctgcgattgtgggtcgcgcggtcagttttgaggactttgcgcgcgatgccaaggaacgcgtgccgcaggccacgcagttggtgaaccggacgtgtttccggttgggttcgctggtggctacggtggcgaatatcgcgatgcccgggcatgtgatgattgccggggagtccgcgtttttggccaagctcggcaccgattcgctgcgcgatggcattcgtttctaccgtcacagccagacccagccggtcaagttcacgattatggaccacgactggcagctctgggccaaagccgccgccagtcgcgtgattgtgaagcatattgggtaggccgttcttggctcccctcagagaggggagccaagaacgttgcttcgccacagttactccgccacgaccagcaattacggacttgcctatcggcaaggctcaatcccaccttcgctcagctgtcgcttcgctcaggccgtggctactgacagcctactaggctgtcagcttaacgccacagccttgagcaatactgcctgctgggggtggagggacgggggacggatgccgtagcgctgcagggtttcgccggtcaggactacgccttcctcgttccaccagccgagagtgctctggccgttggtcagaccggtcaaatccaagctcgggtcgagcgggctgacgcggtaggtgcgctcggggtcaagtccgggcaggtgcacgggcgcggccggataggtctggctggtggtcagctgggtgaagcggtagatggcggcgtcacggttcggcatcaccataccgtccagacgcacggccggatcgttggagtcggcgtgcacgcaggtgtcgatggcgaaccagtcgcggtgcttcttgaattcggccacccacacggccagcttggcgagcgcctcgtccggctccttcaacaggttccattcgatgcccatgtgaccgaagaacgccatggccatgcgcagttcctggctggtggcgcgctgggtggagtgtgcggggctggcgcccacgtgctcgcccatcatcgccggcggcaccagcagcgaggtgtagcgctggatgtccgcgcgctcgaccgggtccacgcagtcggagacccagatacgatcggcgtgctccaggatgccaagatccacgcggccgccaccagaggagcagctttcgatctcaaggcccggatgtgcggtcttgaggcccttgaagatgttgtagacggcaagggtctgcgcgtgcacggccgggcggccggagcggcgggaaccgggctcggtgacgagcttgttgtggtcccacttgatgtagtcgataccaagctcgccgacaagctggtccatgcagccgtagatgtagtcgaacgcatccggattggtcagatcgagcacctgctgagtgcggccctgcagcggcagtcggccggtggtgggcgagagaatccaatcagggtggttacgggccacgtcggaatcggggttgaccatttccggctcgaaccacaagccgaattccatacccttggcgtgcacgtagtcggcgagcgccttcagggacttcggaccatcgggccagacgtcctgcgcaatctgccagtcaccgaggccggaggtgtcgtcgcggcgggagccgaaccagccgtcgtccaccacgaatcgttccacgccggagtcggcggccctgtcggcgagcgccttcagcgtatcgaagttgtggtcgaagtacacggcttcccatgtgttgaggatcaccggacggccgtgcgagaacaggcgcgggtgcagggagcgcacgtaggagtggaatcgggcggcgatctcgttgagaccatcgccataggagccgaacagccacggggtgtcgtaggagttctggccttcgccggggccggcgagcgtcacttcgccgccgaacaggagttcgccgccgccgattacgccggtcgtgtagggcagacgttcggcggacagtacggagttgccgctccagcccacgtgcaccgaataggcgtcgccatgctcgaagctgaaaccgggcacgccggcggtcaggagcagggatgcgtcgaagtcagggcggccggcgagctgcggcttttcgaaacggccgacggtcagcggctggcgctgcggactgcgttcacgtagatggtgaccggtggtggtgaggatttcgccggcggattcgggcagcgggaagccgagctcgatcttgccgatctcgagcggggctccggcgtctgcaccgaacaggttggttacggtggccttctgacggaccaggccgccggggagcagttcgaggtgccattcgacttccacgccctgctcctcatcgcgcgcggtgactatgacgccgggcacgcggaccggaccggtggcacgggcatggccggccacatcggtgtagctttcgccggacacggcatcgagggtggcttccagcacgccgccggtctcgatgttggtcacggtgaacttggggaagagctcgacgccggcgcggcgcagcaccacgcgctgctcgccgatccagctttcggcctgggtgggcaggatggacggccaggcggtgtcgtcgagcgcgccggacacgcgctgcggcttcagggcgtcataggcggccagcagggtgtcgggcttggccagcgggcggccccagtggacgatgtgcggcaggtcgctgccggcaaacaccagaccgatcgccacattggcggcgggctgggtcaggtagacggcggtgagtgcggtgccgtcagcggcggcgccggtgaaagtggaggtgttctcggccatattgtctccttcgacgtgtgtggatttgcattgcactactggtttcgatggtagaagaaatggaatatgttgccttggtgccgcgtgttggttgcgtgaggtaagtaatgcgtccgtgtctatcgccgctgggcgaagaaatcagtcaggatggactgacactcgacttccagcacgccgccgtgcacttcaggactatggccgatatgcggatcgcgcggaatatcccaaatcgaaccgcatgcaccgagcttgggatcccaggcaccgaacgcgatggtgccgatatgggtctggatgcaggcacccgcgcacatcgggcacggctcaagtgtgacggccagcgtgcaatcggcgagattccaagcgcccaaggcttgggccgcctgacgcatggcgatgatttcggcgtgggcaagcgggtcgccatcagcctcacgcgtgttgtatccgcgcccgacaatctggccggccgcatccagcaccaccgcaccaaccggtacgtcaccagcggctgcggcctgaccggccagttccagtgcgcagcgcatcgcctcgtcatattccataccaacgagtgtatgccttttctcatatcgtctcatgatgtgcataatcggccgcaagcttaacgttttcttcatggttcccatatacttttggtggagaaaaatttaagggagaaggcggcaacatggcggtatttgagctcatcctatgcatcattgcggcggtggtggtgagctcgtttgtcagtcgcttcgtgcccaaagtctccacgccgctggtccagattgtgctgggcgtgctggttacgtatctgccgtttttcccggatgcaacgctcgacccggaactgttcatggtgctgtttatcgcgccattgctgtatttggaagcccacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctcggtaaagaagcctcgctgacgcagcgtcagcgcagcgtgctgaaaggcgaatcactcttcaatgacgcttccggcatcgtcggcttccagttcgctctggccgccgccttcactggagaattcgccgtggggcaggccgccggcgaattcgtgatctccttctttggcggcaccttatttggcctggtgatagcagcagcggccaactggctattcgagaccgtgcgatccctcggctgggaaaccactaccacacgtattctgatggaactgttcctgcccttcctgctgtatttgggcgcggaggaattcaatgtgtccggcattctgtcggtggtggccgctggcctgttcatccgattcgaccgcaccggcgtggggccgaatgtggcacgtacgaatatcgtttccacttcagtatggggtgtgctgagtttctcgctcaacggtgcggtgttcattcttctgggcatgcagctgccgcgcgccatgagggccagctggtctgacccgtatatcagcaataccgtgctgatcggcattattctgctggtcactctggtggtaatcgcgcttcgattcttctggattgcggccatgctgcgcgttgcgcgagatacaatcaccggccagcgccgcaaaatgacacccgaacgctggcgctcggccgcagtgatgacctttggcggccccaagggaaccatcacgctgtcattgatgtttaccatcccgtattacattgccggcggtgcgccgttcccgatgcgtgacgagctgattttcattgcgtcaggcgtgattatcgtgaccttgctgctggccaacttcctgttaccgctattggctccgaaccgtggcaaggatcccagcgcggaaataattccggtgaccatcgatgtgttacgcgccacggtggaggaattgaccggacgcatcacgccagagaatcgtcgtgcgattctgatggtaatcgaccagtacaccaagcgcatcgggcgattgcagcagcgcatcggcgataccgatccccagggattcgagcaattgcagatcgaagcgctgcattgggaaaaggaattcgtgcgcgaccggcttgccgacaccaaagcacatccggcggcggatacggccacgcaagagctgaacgtcgaagcctgcgagcgcatgcttgaccagattatgaatacgctgcgtcacacttccactgatccgacttcggggcatgcggtatcgcagattcgcggtcgcgtacgcatgttccagcggcagatgagcaattacgccaaacgcacggtgtccaagattcgccacaccacaccattggtgagcgaggaccagattttcgcgcgcacccgcgaactgcaggtcgaggcgattcatcatgttatcggtcggcttattgacgagatgggccaggatacgtacaacaccgagcattgttcggcactgttgctggattatcgtcgtgccgaggcttcattgcaggcacgtccgaccatgagcggcactacggaaaccatcacgcaggtcgaggacgtaaagcgcgagagctacggtatcgaactcggtatgattcaggacatgtacgaagccggcgacatcaaccgagcccaagcccgctccctgaggcgcaacatctacgttatgcaagtggacgctgattccggcatctagtttccctggctcccttctctgaggggagccaagttggggattgctatttccgtatgattctcttcagtatgtgcagtagtgcttgcagtgctcacttcgctcatgggagaacagtctatgaccgcgccggccacaagcgccctcgatgtccgattgctgtgacggccgcgccaattccagtgatggcggctgactacagcacgccagaggtaatgtcgttgtcaagtagccactggcgcaaatcggcgaactcctcaagactcacattgtgatccagaccgtggtagctcttggttttcagccacgtatgctcttccaaccaagcggcggtggcgaacagttcgtatttcgggattacgccatcgttcttgccgtacgtatagaacacggggatatcgtaatcggccaggcgagagtcggcgggggccgtgccgggcacctgaccgggtgtgttgaagccggacagggagacgacggcccggtaccgctcgggattgatacgcaacaaatgcacggcgaccagcccaccttgcgaaaacccaagcggcaccacgtcacggtcggcgggaatgttgtcggccacccatcggtcgactgctgtggcggcggcatacgcgtcgtagtcacgatcatcgccgataggcagggcatcgtgaaaccacgcgtagttgccggggtcgggactgccttcacgggccggcgcgagtgtcagcggcccgcgcagtgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggcacagtggtggattcgcggccgatcagaggctggctggcattcgcttctttgctcataccattccaatatagaggtcttgcgcgctgtgcggaaaacgatggaccatgatttcaatcacattgggtaatccgcgccgaatcgccttgggacttttcaagggataccggcaatctgtcaggcgttaccgctgtctgcggtatctgcggctgcggtgattgtctcaagttcgccgccccactgctgctgcagtgcggtcatcttgctggcctcgccgaacaccatccagcgtttgccgttcagcaatcgccaatcacctttcgtttgctcattatcagcgtattggctcagcagttcggaaatcttgctttcgataggtgcccggctgatggctgcggacgattccgattcaaaggatacgaaggccactctcggatcagtgcacatctgtacggtggtgatgcccggcaaaccgcccgtatcaagcccctgccatccttctttgcacgcgccggcagcttgttcgatgccttgctccatctgtgcggtatcttcgacgggtgccttgtcgttcgactgctgaatcagtccttccgggaacaatacgcccacggccacgccgataaccaagcaaactatggcgcacaccagtgcgatgatgccgcccgcgcccactcccccgtgagtggcgtaccgaggcatggtgactcgcgcagcgatgaccagaatcagggtgatgccgataagcaccgccgccgtcaacgcaatgtatcgtcctggcactgccgtcataaaggaaatggcgtaaggcgcgatctcatgaaccgccgaggtggccgataccacgacggctagcagtccgctgacaacggcaagtctgcggcacaatatcgacgttgggctgctggcttttgtagcggcgaatcgccggccggcatcccgcctggatgggcgtcgattctgtgcacgacgtgagctgcgcgaatcgtcatactgaccatcgccgaagaaatcgtagtcctcatcgttgcgggccatcggtgcccccttcctgccgattacacagctagtgtaccgctatggcttgggaatggcggtcattcgggggaatgattcagggcacaaaaagaaccccggcggttgcccgccggggagagaaaggagagagaagaagaaagggggttcaattgtcgggaactgctgcggctcctgatcagctttccgctgacatcttttatataaccactgctttctgggtctacctctaagtttctctgagaaaaacctgagaatacttgcgattgatggaccgcggaagcgtgaggagcctctcacgtttccgcccaaggcgctagacttgaaggcagtatttatttgcccaaggagtttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacctatgtcgatccggcggaaaaccaaggcgcgctcaccgaacagttcgaggtggctcccgacgaaccgtggattttgcaccctggcgagttcgcactgggttccacgtgggaatacgtcaagttggacccgtccattgccgcccgtctggaaggcaagagctcactgggccgattggggattctcacccattcgactgcgggcttcattgaccccggtttcgaggggcatattacgcttgagctgtctaatgtgtcgacgttgccggtcaaactatggcctggcatgaaaatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggcgggttccagttcgacttccagcagcccgaaaagccggtcaggccaacggttcctccgattcccgggcaagagacggcagcatatagcacagaacccacggcacaagccacaccggctctgcagttcccgcagtctgtgcagtctgcgcagtctgcgcagcccacacagcccacacagtttgtgcagcccgcgcaagtagcgtatgcctcacaacccacgcaagctgtgccgaccgtacaagccgctcagccgacgcagcccatcgatccggccatgacgcaaccgttctcgccgcaattcctggctgcggttgccgcacaagcaccacagccggcggcagccacgcagccagtagtatccgaaacaccaatcgccgctgcgcccggccagcagcaatacgtttgggatcagacgacgcaaagcttccgcccggtggaaccgacagcgccggtgacgccagcagcaccagccgcaccagcggcaccggcgacatcgcctgtttcggtagcttcaaacgccgcgacacaggcgttccaacccaatcaggccgagcagcctgcggtagatgccgaggcaacacaagcgttccagcctgatcaggtcatggcaacacagcctttcgaagctcaggccatgccgaatgccgaaaccgcggccacacaggcatacggcgcatcatccaccgtatccggtgagaccgttgccatgccggcaacgcaagtagcgtctgccgatgatgctgcagccacacaggtgttccaaccggccgccctggccgcttcggcacaggctcagcctgctgtgatgcctccctccattccgttggatcaggtctccgatgaggacgattccgatggcgccgagcctcgtcacggcggtagcggcaaaaagaacacccgcaaaatcgtcggcattgccgtagcggtagtcgccgtgatagcgctggttgtcgccggcctgctctggtggcattccaacagcagcaaggcgagccaagccgtggcattggccgagtgcaaggtagcggccaagcagtacacgaatgctcagaagaagctcaccaccgccatatccaatggccaaaccagcgcgcaaacatccaccagcgatgtggccgatgccaatacgctcaccacgctgaatcaggcgttgcaagacgccgacaatccgaccgacaccgccaagtgcgattccagcctcaacgccactgagctgaagtctcacactaaagagctgcagaatgatgccagcgacatggctgacaagacggatgccatcaacaatgcgatcaaggccgttaatacttcaaaggcgacggccgataccgacacactgaaatcgaacctgagctcggctatttcgcaggcgcagggcacgctggataattccgcgggcagtgtggccgatgagaacacccgcaccgcgctgcaaaacgccatcaccgaggccaatacggtgatgaacgggaccagtccgtccgaatccgacgtcaacaatgcgatttctagactgcagaaggccgagtccgacgtcaccgcctcgatgcaggccaagcagcaggcagatgccgccaagcaagctcaggaagaggctcggcagaaggccgaccaagaggcacagcagaagtctcaagacaagtccaacaatagcgacaacaataacggcggcgacaactccacctctactgacggcaccgacggcagcaacaactgaggtctgcagcgttctcccgtttcccatggggcggtaacttccccatggggcggttagcacattttcctttttcgcggaataacgccgttttcagcgaccgccccatgaggaactcaccgccccatgggatagttaccgccccatgaggagccgtttggatatagcagtgggccgggctctgaataccagagcccggcccactgctatatgcccacaatcagggctattgcgatggcttaacgcttggccatcgcgcgtagcacaatcttgcgcagttcggaggcaatcagcacgattgcggccaggcagatgcattccacccaagccatcgggctcaatgccacggtgccgaacggaccgttgaggaacggcacgtaaatcaccacgagctgcagcgccacggacaaaccaatcgcaccccatagccacttgttggagaacagacccacgaatgcggactgcagatgcgaacgggaggacagcgcgttgaacagctgggcaaacaccagaatcgtgaagcccatcgtacgggcctcggtcatctgcgcttcatggccgatggcatccaccgagcggtcggtgaacaagccgccggacaggtgcatgtccataccaatcagcgtgacgatggccatgatgacgccgatgtagatgatgtcgccccacatggaggcgtcaatcacgcggtccgtcaccttacgcggtttacgacccatcacatcgtcggtctgcgggtccacgcccatagccaacgccggcgcggcatcggtcagcaggttgatccacagcaactgtgtggcgagcagcggcacggtgacgcccacggtttccggctggcggatgccgaggaagccggcaaacaccacaccgaggaacacggtgaacacctcacccacattggaactcagcaggtagcgcaggaacttgcggatgttgtcgaagatcacgcgaccctcgcgtacggcggccacgatggtggagaagttgtcgtccgccagaatcatcttggcgctctgcttggtcacttcggtgccggtgatgcccatggccacgccgatgtccgcggacttgactgccggggcatcgttcacaccgtcgccggtcatggccacgatgttgccttggcgctgcaaggattcgacgatcttgagcttgtgctcgggggccacgcgcgcgtacacggacacttcggacgtggccttgtcgagcgcggcctcatcgggcagctggtcgagctggtcgccggtcagggccttgccatccttggcgatgatgccaaggtcggaggcgatgcgggcggcggtcagcgggtggtcgccagtgatcatcaccgtgcggatgccggcacgatgggcctcggtcacggagtcgcgcacctcagtacgcggcggatcgataatgccgaccatgccattccagatgagatcggtttcgatggcttcggcctgatcggcgatgtcggacacctggcctgcagcgttgacgcttacaccgggcacatcagccaaagaaccggtttccagcggacggcaggcctcgccaagcgtacggtaggcctcggaggagagacgttcgacggtggcgagaatcgactggcgatcgccttcggtgagcttacggacctgaccacccacgcggatgcgcgtgcagtagctcaacagcacgtcgggcgcgcccttggcgaacacggtgagcttgtctgaatcggtgctgtccttggcgatgatggacatgcgcttgcgttcggaggtgaacggaatctcgccaacgcgcgtgtatcgcttgatcttgcgatcggccttgaccttgcgtgcggccacgatcagcgagacttcggtggggtcgcccacaatctcccaacggccgttctcctcgcgtagttcgccgtcgttcgcgagcgtgccggccacgagcgtggcgacgacttcatcggccacaatctgggcctgctcggattcaggactgacgccgccggtcataaccatgcggccttccggcgcgtaaccggtgccagtgatctgcacttcgccggacggggtgaccacacgttccacggtcatctcgttgcgggtcagcgtaccggtcttatccgagcagatcacggaagcggagcccaaggtctccaccgaatgcagtttcttgacgatggcgttgtgcgcggccatacgctgcacaccaagcgccagcaccacggtcaggatggcggccaagccttccggcacggcggccacagccagcgagacagccaacagcaaggaatcaatcacgtcatggacatcgttgaagccttccagcacggcgagcgccaccagcaccacgacagcgatgacgcacaccgcaatgccgaggatcttggagacgtaatccatctccttctgcagcggagttttctcatcttcggtggcggagagcatgtcggcgatcttgccgacctgcgtattcataccggtgccggtcacgattgcgcggccggtgccttgcgtcacggaagtgccgttgaagatcatgttggcgcggtcgcccagcgccttggcttcggtgagtgtgtccggcttcttgccaaccggcacggattcgccggtcagtgaagcctcggcgatgcgcaggctggccgcgttgaccagtcggccatcagcggagaccgaatcgccttccgcaaggacgatgatgtcgccggggaccacgtcggcggtgttgatgcgcatgaccttgccatcgcgcagcaccgaggtctgcggggccgtcatttgtgcgagcgcttcgacggccgcctcggccttggcttcttgcatatagccgagcacagcattgacaatcaggatcaagatgatcacgatggcgtcgaacggcagcacttcgccgccttccgcgccgggctgcgcattggctttttcgatgaaccaagcgatcaccgagataatagtggccgcgatcagcaggtagaccagcggatcttggaattgggccaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcgctggtcagacttggatcagtatcccccaatagcgcttcctgtgcgcgcacctcttccgattccacgaccccgttcgttgcggtcgtggacactgcggattgatctttgagatcatccataatgttctccttggtattgccgcggagtagtcagccttgcggccgctgccgggttttctctcccggctggacgcacaggactgcgcggttatggacaccggcgcaactgctgccgatgcatacgattgccattattccataaccgcgtggcgcacttggcgcacagcgtaatagcgttttgcctagaacaggcgacgcaaccaggcctcagccaaatcaggccaacactgcacgcattcgacgatgtgcgcatagaagccgttaccggcagtttccgcattggccaaggacaggccgtggctgccttcagggaacaggtgcgcctcaatgctcacgccggcggcccggcaggcctggatgagcattagcgtgttctccacgggcacggcgtcgtcggtcatggtatgccagacgaagacgggtggcgttttggcgtcgatgtgcttttcgatggagaacttgtccagcaaagcctgattgtgagcttggtcccctagcaggcattggaagctgccgcgatgggcgtacttgccggcggtgattactgggtacgagagcatcagcgcgttcgggcgcacggcgtccgggtctatgccgccctgttcgcggatgtcttcgtcgccgaccgaggtggcgaggttggcggccagatgcccgcctgcggaaaagccgagtacggccacttgcgcggggtttacatgccactgatccgcattggcgcgaatcaggcgcattgcctcggcagcctccagcaaagccaccggatagcggctgggctgcaccgaatagcgcagcacgaatacggcgaagcctttggccaggaattgcagggccactggctcggcttcgcggtcagaagtcatggcgtagccgccgccaggcaaaatcaggatggccgggcgtatacggtccggttccatctcctcgctgttgtcggccacatagccaaagaatcgcgcctcgctgccatcaatgccaacgatggtttgttgaatgtattgcatgccatacatcatacgcgcagagaatagttctcgataagaaccactcgccatatgcggtcttgcccgtatctccaaaccgaataacgcttacagcgaatcgtgaagactgcgggccatggcgcggtcgcgcgagcctttggtgagcttgagaccgagggtcacggcaatcaacacaacagtgcaggcgatccacagcgttcgaccgccgaagttgctgatagtccagccaccaatcagcggcgccagcgcaatcgacgccgaccacactacgttgtagacgccctgatacgtgccgcgcgccgacgcgggtgccatggcggcaaccgtagtggtggcgatagggaatgtgcccagctcacccagcgtccacagcactacggcaagcgcgaatccgccccaagaatgggccgcggcctgcaccgcatagccgatgacggttacggcgaggcccatcaccagcacgcgtgaattgcccatgcgcgcgaacagtttcatcgcgggaatctgtagcaggcacaacataccgccattgatggtgagcagcaccgaatactcgcccagccctagaccaaggtccgtcatggcaatgggcaggccggaggtgctttggaagtacacaaggaagtagccgaacatcagcagggagaagccgaggaatggagtatcggtgagcacgcgccgccaattgcgagacatggcgcccttgacactggcagccggtgcggcatccgagtgattcggcctctcaatgccggcgaattccgcatgggtaacactgcattcgtcttcatggcgcaccgcacttggcaccgatacagtaatccccaaatgccgtacctcgcggaagaacgcaatcagcaatatcgtgacggctatcatcaccgccgcttcaacgtagaacatcagcgaatacgagatcttgaccagctggttggccacaatcggtccaatcgcgtacccaaaattaatcgcccacgattgcagtacgtatgcacgttgctgacgttcggcaggcaccacatccgcgatatacgcggcgatggccgggctgggcagcgaggcgaacgcaccatagacgaacagagccgcgcctaaagacacaggatcagtgagtacggaaacgaccagtagggcagccgctgcgccgatttcgccgatgataatcatggattggcggccgaatctgtcggacaaggtaccgccgaacaggcagccgatgattgcgccgaagccgtacatggccacgactgtgcccaccacaccctcatcgaggcgcagcgcggaaaccaaatatatcgacaagaatgaggtcacgaagcgacccatccacagaatcagaatcgccaaccataatccccaatacagcagggacagtccgaatatcatacgctgcttcttcactctcaataccttaccggctaccgacggcggaatagccgcgttttggcgcggggtgctgggacaatagcacctatggctatcaaaaaaggaccgaccaaggggtcgggtggcaagcatcgcaacaaactgaagggctacggccccactcccaaggccgaggaccgcgtctatcacaaggcgtacaaggccaagaaagcggccgaacgtcggcagatggccgacccgcgtctggcagcccgccgtcgagtggacaagttcgcttcggcggatacttcggatctggtgtacggccgtaattccgtgctggaagcactgcgcgtaggcgtaccttcttccacgctgtacatcatgtctcgtattgaacatgacgatcgtactcgcgaaatcgtgaaaatcgctggtatgaacggcctgcacatgctggaggccgatcgtctggagatggatcgtatcgcccgctctggcaaccatcagggcgtgattctgaaggtcgatccgttccagtactcctcgctgaacgagctggccgatcgtgctgagaagaaggccaaggcaatggaggccgcgaattcggcggccgcccgtattgctgcgcgaccgctgtttatcgcattggacggcgtgaccgatccgcagaacctgggtgccgtgattcgttcggcggccgcattcggtgccaatggtgtgattctgccggaacgccgttccgcttcagtgaacgccgccgcttggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggcgagactggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtggcggcgggtatcagcctgtacgcggtgtccaacgcacggcgcaaggctgcggcggagtgattgtcgcttgaggccgtaataggttgtacatacacggaagcccctctatttgaggggcttctttgtgtgatgggctcacctacagacagtccaccggattgtccgcttaatgactccacactgccgcatccggatcgtcatcggggttgtagccgtcgtcgtccgggtcgctgtaggtggattcgtcgtcaatgacgccggaatcggcctcttcgttaagttcggcgagtgccttggagtcaaggctgtagctcggcagagcgttgtcgatgtagctggtcacggcctcgcccatcggcacgtcgtggccggccttctccgccaggaaccagcgatggtcaagcacctcatggaagaactgagcaggctcgatctgggagcgatattcgcgcggaatcatacgcacggtcggctcgaacacctcacgcatccagtcggtggccacgatttccagatcctcgccctcacgccacgtggaggcacggtaggcgtcaaggtcgttgagcagacgacgggcctggttctcctgcacgtcaaggccggtgaggcgcagcagcttgcggttggcgtagccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcgatcaaccaggcggttgcccacctcgatctcatccacgtcgccgggcagtagcttgccggacgccaaatccataagttcgccgatgatgttggtgcgggccaagtcgatatcgtattcgcgctggccgtcggtgagctgggcttgcaggtcaccggtctcggcgtccaccaggaaggcggagaaagcgtcggcgtcgcgcaggaacaggacgttcgacagggacacatcgccccagtagaagccggccaggtgcaggcgcaccagcagcacggcgagggcgtcaatcagtcgttcggcggtgtccgggcgcagattgcgggcgaacaacgcacggtacggcagcgagaacttcaagtgccgggtgaccagaatcgcctccagcggctccccttcacgggtgtgacggccgatgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtcctcaggccaggtggccaagggcttgtgccagggcagcgtgaacatcttcgggttcgagctggcggcggtgattttcagtgcttgcggctccgctgaattggcgtgttcgtcttcggctttgacagacgtggccttcagcgcacgcggatccatctggggcaaatcgttcaactccatgtgttcgattttacgtgtcgttcgcgatgtgtgctcctttgccacgacttcggcgcgttatgtttacgggaaaaacaccgtttggtctctccctcagaccgtctaaaaggcaaaagaaaagccccgcagctatgcagggcttttccaacgaggccataagagaggaagagaataacctcgtttaatggttgacgaagcgattagacctcgccaagtatctattagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggaagcctcagcggcggagccatcggtgatgatgttgccgtagatgtagccatcggagcccagatcctcgacgttcacaaccttcagggagaaggcgttcgggtcgtcagccggggccaggccagcgtcctcaggacggaagccgaccacgatctggccgttgtcttcggcggtgagcttgttgacggcctcagccggcaggtccacggtgtcctcaccgatcttcgccttgccgttgaccaccgggtgggtgttcaggttcatcgacggggagccgatgaagccggcgacgaagacgttggccgggcgatcgtacagctcggtcggggcgccgacctgctgcaggataccgagcttgatgacggcgatgcgatcgcccatcgtcagggcctcggtctgatcgtgggtcacgtacagggtggtgacacccagctggcgctgcagagcagcgatctgggtacgggtctggacacggagcttggcgtcgaggttggacagcggctcatccatgaggaagaccttcggctcacggacaattgcacggcccatggccacacgctgacgctgaccaccggacagagccttcggcttgcggtcgaggtactcggtcaggtcgaggatctcagcggccttctcgacgcgcttgcggatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccgatgaggatgcggcccttgttgacctcttccaggccggcgagcatacgaagggtcgtagacttaccacagccagaagggccgacgaggacgaggaactcgccatccttgatatcaagattcagatcatccacggagggcttatcgttgcccgggtagatacgagtgacgtggtcgaaaacgacttctgccataattactaatcctttcagaggcaggtacgtgcctcacgatccgttgtaaagggatttgttctttactgtgcttccgccctcgccaccgacgtacaactttgctttcggaaactgcaagcttcagcgtttacttttttccggttcagtgaaggttctcttcgttgagccgagaactactatacacggaccgtggaccaaggcaagtggcgtgtctgaaatgtagttaactttatgggcgtttctgggggtgttgtgtggttcggcccatgacacgcctgcttctcgaacgtgcgaaccggcacgcccgacgtagagcaggtctgctcttcccggactgatggattccatcagtcgccgactaatgcgacacagactcgaaggtgacgccgttgcgggcggctttgcgctcggccttgcgctcctcggcgtcttcgatgcgctggatgcgcagctggcgccagtcctcgcgcatgtcgcggaaacggtcggccagcgttacgtcatcgttctcggcatcgccatcagtactgctgccatcggccttaccgaacgtgccatcggccaccttggcgatgcccagcttgagcagtccgagcaactcacgcaacgtttccggtacgggctcatcgccctcatcggcggacttggtcaggccctcgatgcggcgacgaagcgcgtcggcgtcctcgggatcgatcttgagcccggcgatcagcgactggcgcatggtctcgtaatcgaggttggcaaaaaaattcagctgttgcagcgtcatgaagcccttgagctcggggaatcggtggacgatgtattcctcgcggtcgtcggcggcgcgggtccagtcgcgggtgagctgcggatcccagctggcggtaatcgacccctcgcgcatgcggtagtggtacagcgccttgggcagacggaccacgcgcgtggcctcgccgatcacgttgcagatacgggagagatcctcgattttgcgacccaccgggaaggagaatccggtgccctgataggtggaggcgggtgccaggaaggcccagaaatagccgtcgatctcagccttgacctgctttttgatggcctcgaccggggtcagaacctgcacctcggtgaagtcgttgtggcgatagttggacagcagcggcttgttgttctcggagatggtgtcgaactggaacatcacgaggtcggcgtcatactcgcgcatggcgttcaggcagtcctccaccaacgtgggggccacggtgtcgtcggaatcggcgaagtatatgtacgcaccggtggccccggcgatgccggcgttgcgggcgtcggacaggccgccgttgggcttgtgaatcacccgcacgcgcgggtcgcgggtggcccaagcgtcgcacatggccgggcagtcgtcaggcgagccatcatccaccagcagaatctcgaggttgcgataggtctgcgcaaccacagacttcacgcattcgtcgaggaatttctcgaccttatataccgggatgatgatgctgaccaacggctcctgttccatgcctccagcgtagcgccgtcgtgcgaacgcggcggcgctgcgggttcgcggaccgcgaaacccttagaagtcccagtcgtcgtcatcggtttcttctgctttgcccatcacgtaggaggagccggagccggagaagaagtcgtggttttcgtcggcgttcgggctcagagcggccaggatcgcggggttcacatcgcaaatctcagccgggaacaaagccgggtagccgaggttcatcagcgccttgttaccgttgtaccgcaggaacttctcgacgtcatcggtcaggcccacgcagtcgtacagcgactgggtgtactccacttcgttgtcgtacagctcgttgagcaggtcgtacgtgtagtcctgcagatccaagcgctcggcatcgctcagatgggcgatgcccttctggtacttgtagccgatgtagtagccgtggacggcctcatcgcggatgatcagacgaatcacgtcggcggtgttcgtcagcttggcgtgcgcggagaagtacatcggcagatagaagccggagtagaagaggaaggattcgagcagggtggaggccaccttgcgcttgtacgggttgtcgccctcgtaatagtcgagcacgatctccgccttcttctgcaggaactcgttgttctcgctccagtcgaatgcggcatcgatctgctcggtggagcacagggtggagaagatggacgagtagcttttggcgtgcacggattccatgaaggcgatgttggtgtacacggcctcctcgtgcggggtgagcgcgtccggaatcagggagacggcgccgaccgtgccctggatggtgtcaagcagggtcaggccggtgaagacgcgcatggtgagcgtgtgctcgtcctcggtcatcttctgccagctggggatgtcgttggagacggggactttttcgggcagccagaagttgccggtcaggcggtcccagacctcaaggtctttctcatcttcgaggcggttccagttgattgcggagacgcggtcgatgagtttcagcggtttgcgcggaatggaaatcggtgccatgagtgttccttattactcgttgtcgttgtcgttatcgtcgttggatttgttttcgaactcctccggcgcggtcagccggagcagtgccttataaatcattggtgacattgtgggttcctcagagcatgcaggagacgcagccttggacttcagtgccttccagggcttgctggcggatgcggatgtagtagagggttttgatgcccttgcgccaggcgtagatctgggccttattgaggtcgcgggtggtggcggtgtccgggaagaacagcgtcagcgacagtccctgatccacgtgctgggtggcctcggcgtacgtgtcgacgatggccttccagccgatctcgtaggcgtccttgtagtacccgaggttgtcgttggtcatgtaggcggccgggtagtacacgcgcccgatcttgccttccttgcgaatctcgatcttggaggcgatcgggtgaatcgagctcgtggaatggttgatgtacgagatcgagccggtgggcggcacggcctgcaggttctggttgtagatgccgtccttcagaatcgcgtcgcgcagggcctcccagtcggccgcagtcgggatcgcgatgccgtactgttcgaacagcgcacggacccgttcggtgcgcggagtgagcgaacgacgaccatcggtgtacttgtcgaagtagttgccctggccggccggcttggcgtagtcgctcgtagcgaagctggcgaacgtgcggccatgctccacggcgagcgcgtgcgaggcacggtaggcgtggtaggccacggtcatgaagtacatgtcggtgaagtcgaggccctcttcagaaccgtactggatgccttcgcgggccaggaagccgtgcaggttcatctggccgagaccgatggcgtggccctcctcattggcgcggcgaatcgaaggcaccgcgttgatgctggtgtgctcggccaccgaggtgagtgcgcggatcgccgtctccaccgtgtggcccaagccgccatccatcgccttggcgatgttgagcgaacccagattgcaggagatgtcgcggccaacatgcgcatacgtgaggtcctcgttgtatgcgctcggctcctgaacctgcaggatttccgagcacaggttggacatggtcacgcgaccttcgatcgggttcgcgcggttgaccgtgtcctcgaacacgatgtacgggtagccggattcgaactgcagttcggcgatggtggtgaagaacttacgggcgtcgatgtaggtcttcttgatgcggtcgtcggccaccatctcgtcataatgctcggtaacggagatgtcggcgaacggcttgccgtacacgcgctccacgtcgtacgggctgaacagggccatctgggccttctgtttggccagttcgaacgtgatgtccggaatcaccacgccaagagccagcgacttgatgcggatcttctcgtccgcgttctctcgcttggtatccaggaagcgcaggatatcagggtggtgggcgttgaggtacaccgcgcccgcgccctgacgtgcgccgagctggttggcataggagaaggagtcctccagcagcttcatgaccggaatcacgccgctggactggttctcgatgtgcttgatcggggcgccgagctcgcgcaggttgctcagcagcagggccacgccaccgccgcgcttggagagctggagggccgcgttgatgccgcgcgaaatcgactccatgttgtcttcgatgcgcaccaggaagcagctgaccggttcgccacgctgggccttgccgaggttcaggaaggtcggggtggcgggctggaagcggccggcaagcatttcgtcggcgtattcgatggcctgctgctcattgccggcggcgagctccagggccacagcggcgcaacgctgcgggaagtcctcaagatagaggcgaccatcgaacgtcttgagcgcgtaggacgtgtagaacttgaacgcaccaaggaaagtgccgaactcaaagccggcggattccacgtgctcgtagatgcggtcgaggaattcagcggagtactggttgaagaccgcagggttgtagtactggttgctgatcaggtattcgagacgctcggcggtggaggcgaaccgcttgctgttggtggccacgtgccctgtcacgtattcgcgttcggcggccttgtctttgtcgaactggatcttgccgtcggcgtcatagaggttgagcatcgcgttgagcgcgtggtaatcgtgcgccgggtcgtactgttccgctgcggtgtcggcagtattgtcgagcggcaggccggtggcggtgaggtcagtcattggaaatccttggaatatggcagaagtgtgtttactcagacagttgctccccccagtcaacttcgttgacagctcccctcggagaggggagccaatacctcgagggggtcaagatttactgttcggtgaagaagcggacgaggccgtttcgcacggcggcagtgtcttccggggtgcccatgagttcgtaacggtagaggtagggcaccttgcatttggcggcgatgatgtctccggcggcacagtaggcctcaccgaaattggtgttgcctgaggcgatgacgccgcgaatccactcgcggttggctggatcgttgaggaagcgtttgacctgaatcggcactgctttcttgaccacgccgccgccataggtgggcaccatgatgacgtacggttcgcggacgtttagcgccgggtcggcggcccgcaacgggatgcggtagacgttgatgccttcgtcctgcaaacggcatccggccacgaaccgtgcggtgttttcggaggccgacgagaagtagaccaatgcgccgatcgtcttgccttcggccgcgaattcgggctggctcagactcacgcggacaccgtggcggcggcgcggttgtcggcggccacctgctgggcgacttcgcgaatcaggtcggggcggtagccggtccaggagttgtccggcgtgatgaccaccggagcctgctggaaaccggcggcctgcagctgctcaagggtggaggggttctgcgtcaggtccacggtttcaaacggcacacccagcttggtgagctggcgcttggtggcatcgcactgcgggcaatgcggcttggtgaacacggtgacggtcatggcgactccccttgatgtggttctgatgaacagtgaagcgaaggccatattacagcggtgtgatttgaaatcaaggcactatatgtagtggcgcgtgtcacataacaaacctagatatagggtttttcgttgatattccgccattcccatgcacccccgaaaatcggcgtgcagcgacccgcccaatcacatgtggcattgttcacatttgcgtttgaaccgctcttcgactgatcctcaaccgccctgcaaccgccatcttgagtttcgaggggctgttttgaccctttccggagatctatctccgtttcgaggggctggtactcaagtaagcgcatccccaaaatggcggaatgacggtggggcgaagccgtttatacccgtgttctagcgggccaccagcccctcgaaacgggagtaaacctctacggaaggccaaatcagcccctcgaagcggagaacggatacctcggcaccccgtgtggagccagaaggcccggccggatgtccaaacgagcatccggccgggccttaaaagtagttgttcagttatcagaatcgatgcggcgcgatactactccgcgtctttacggctccaacagatcttcgatgcggcagccaagcgtgcgggccaaagcgagcacggtggagacggcagctttgccaaggtctttgcggcgctgctcgtacatttggatggagcgcagggtaacgccggagcggcgggccaacccggattggctgagtccggcgcgcacgcggatcgtgtgcagccgggagtcgccctcggtgcgattatgggcggcccgctcgtcgtacacgtcgacgaatcggctttcgtcggcttcgtgcagagtcgggtacagtcgcacgatatcgtcgagcgacagcacatcgagaatgtccgagaaccgcactcccctggtccattggcagtatgcgagtacccatccggcccagtattcgggtgttgagccggcgcgcagtgcggctggcggcatatcgagaatgcgcgcccaaccggtttgccgcatgatttcggccaccagctcctcgccggacatgccacacacgtatttgggcgtgcctcgcccgaaaagcgcggccgcctcggaggtggcgaagaagtccatgaataggccgaccggcaacccgcaatcgttcagcgcataatcgaaggcgccggccaagttggccatggcgtccggcaagtatgtctcatcataggcggggatcatcgttggtcactttctcgcggatgatgtcgcgcatgaacaggccgtcgagatcggcttctgcgctgttgcgacggtaggcttcacgagccgtgcggtcgcgctcgttgcgcaatacgtggtaggtcgaagcgcgggcgatttcgcagccttggaaccgcagcgccgcgaatgcctgaggactggcgagtacgatctgcttgccgagctcgcccaaccgcatcgcctcagcgagttggtcgatggaaatcgcgttattgacaaaagcgcgggcgaacgagaaatacgaatcgtcggcacgatatccgacgatgacgtcagcctgactggcatccggcagaaacacttgtttcagatattcgatgccttgcgcggcgacggcggtggtcggctggaaacgacggttttcgaccagcatggccagccagttcaggatggtgtagggcggctgggacaggtccaggaagaggagcccgtccgtggtcaatgtgtaccgattcgcgaaaccgtcatccagtcccgcgcacgcccattccttggccagctcgacgctgcgcgtgcaatagaatccgcggccataatcgttgttcggcttgaccagcccgtattcaggatgcttgatgacatgcgaagagccatgccacagttcgatcgatgcggtctccattggccggctccttctctctccttacatattcttgattatatcactgtggtgatagtcataagggaaatacgagatgaaaaataccgctgtatacgttcgtacacaacgtgaaatgtatacgaacgtatacaacactgatgtccggagtcatgctccgcagtggcgcagcggacgcgccactacaatcggaatatgggactgaagacgtggaagaagtggacggactggccgctgatggtgctgtccgtggtgtttctggtggtgtattcgtgggaaattctctcccgcacgcatatcgcgctgtgtgaaaccgtcatcaacgtgatctgggtggtgttcgtcgtcgattatgtggtctcgctgtggttggccgacgatcgctggcagtggttcaagcacaacctgttcacgctgctgaccatcgcgctgccgatgctccggcccttgcgactgttgcgtttgctgaccgtgctgcacgtgctgaaccgcacctccggcatggcggtgcgcgggcgcatcaccgtatacgcggtcggcgcggtgggaatgctcatgtacgtgggcgcgctggccgtgtattccgtggagcgcggggcgtccggatccacaatcaccgacttcggcacggcgttgtggtgggcgttcgtgaccgtgaccaccgtgggatatggcgacttctcgccggtcaccttccaaggcaagatcattgcggtggtgctgatgttcaccggcatcgcgttgatcggtattgtgacggccacgctggcctcgtggatcgtggatcaggtcaatctggagacggatcggcgcgaggacgctcgggagaaggaagtggccaaggaagccgcgcaagaggctattgcaacatcagccaatcccgaaatcgacctattgcgcgaggaagtgcgtgagctgaccgctacggtagccggtctgcgcaccgaacttgagcgacgttgattggcgaagcgggacaaacaacgattctgccaagaaggtccgcgccagttgttgtcaccgcggattgcggcagaatcattgtcgccatggctgttttcttcagtcggctcaacccaacttttgataatttttatttttttgatatttttgataatttttattttaggttgattcagcgaggaggcggtccacatgaaggcaaaggaaaacccattcaagccaacggcaggaggggaaccgcccctgctcatcggccgaggcaaagttatccgcgatttcgagaaaggtctcgataacggagtcggtgccccagggcgcattatgctcgtcaccggcgctcgtggaaccggaaaaaccgtgatgctcactgtgttcggagaccgggccaaagcgcgtagatgggatgtcatcgaagaaacggcctctgccggactatgcgaacgccttgttgatgccttacgaaccgggcgaggggcccttgaccacctcactatccgaccatcgttgacttttgctggagcgggcatcggcctcggagaagccgaactatccccgaagcgtatgcccgaaacgttgagaagtgccattgccggacggttggatgcgcttgagaagcgccatgctgggttgcttatcaccattgatgagactcaagcggctgagcgatccgacatgattgccatcgccactgccatacagcatcaaatcagggaacgacgcaatatcgccatcgtgttcgccggtctcccacagatgatttctgatttgttcaatgacgaagtcatcacgttcctacgtcgcgcgaaaacgaacatactcacagatattcctcttgatgaagtgcgcgatgctttcgccacaacattccgcgcctccggcatgtccatcaccgacgctcaattaagcactgcagccaatgtgacagccggatacccctatatgattcaactggttggctaccatatctgggatgccgcagacatgcgggactcggataccatcatcgacgctgatgttacggcaggtatcgaggaagcacgtattgaccttgataacgccgtgtgcatcccggagttgcaaggcttatccaaaaacgaccgtgagtatctcgaagccatggcagcgtcagatggtccctctcccaccgtgaatgttgcacagcgcatgggcaaaacgcctaactatgccgccacctaccgcaaacgcctccttgacgccttcgttatccgcgaaacagaacgaggcgaagtcgattttgccgtgcccttcctgcgcgaatacttgcgtcggaatcagtaatcggcacaatgcacagtatcgatatattccgttccatataatgacttttcgcattcagatacacaatggacggcctgctgagtagcactcagcaggccgtccattctatttagctattcagttatcggagacacacctcaggccttgaccggagcgtcagcgacctgctgggaggccatcacgccgaacaggtagccgtcttcggagaagtattcgaaggtacgaccggcgaagtcgcggcattcgaatctgatatcgttatcgattcgatcagcggctcacgatactgcccttgcatcgctgtgccactgttgaatgtgcccggctggctcacctttgggtcaccgccgacacatccttgatgccgatggttatagagtcgcaaattcacgactggcgcacctgcccacgcacctatcctgtcatttcgagcgcataatttgctaccacatccggtcagggcaatcgaccttaatggcgtaaacggcacttctcaatacgtaaacggcatttattcttggctcccctctcagagaggggagccaagaaatatcaagctcggcctcccaggagagggccagaataatgcaccagcaaggcattaggatggagggcatgagcgatttgaacgcgttgaatcttgagcccggcgaagtggttggtgggtatacgctgatctcccggctcggctcaggagctatggggtcggtgtggcgggtgcgcgacgacggcggcaccacctatgccatgaagattctgcgcgactccctgaccgacgagtcagtggcaggctccggctctgcgtccacggccctgcacgaccccgacctcaagcccgatgtcacgccgcgcgagcgcctgcggcgcgaggccatggccttgaagaagatcaatcatccgggtgtgtgcggcatcgtggatatggaactcgacgatacgttggcgttcatcgtcactgaactcatcgagggcaagaatcttaaggatgatgtggccgccaatggccggtatgtgggcgacgatctggaacgcttggcccgcaagctcatcgaagccaccaaagccgtacatgcggccggcatcgtccatcgcgacatcaaacccaccaatgtgatggtgtcggccgccggaccggtattggtcgatttcggtatcgcgatgggcgagggcgaaagtcacgtgacccgcaccggcctagtgatgggtacacccggattcatcgcacccgagattattgacggtgccgaatccgacgacgccaccgattggtggtcggtggcgtccgtgctcgcttttgccgcaaccggcgcgcctgtgttcggcaccaagccgatgatggcggtacttgagcgcgaggcctcgggcaacgcgaatctttccggactaccggccggcacattggctgccttccgttctgcactggacccggatcgcagggatcgttgcacgccggatcaattgctgaatgccatcgccttggatgcgttgaatcccaacgcttggcagggcgagcaggcgggaccgttcgccgcgggagccgtggctggacaaccggctgcgatcgttgccgaagccgcggaggcgatgcccccttttggcgcggccggcggcgttgaccgcaataatccccgaaccatctggcgcgcggccgaggaagccgctgaggctcccaccatggccgtgttctccggcaataagggcgataacggcgatggcgaaaccgccgtattctcgccggctggcgccgctaccgccacgctgcccttagccgatatgccgccacgtccgccggccggtgcggagcaggccacgcaactgttgcccgacgctgctgccgatttcaccgacgacgccggcacgcaggtactcaccggcgcgaccacaccgatgccggaccaaaccacgccgctggccgagcgcaccaccgtactccccacgccgcagccgtcatcattccccccgtccggcaccgcccagagcagctgggatcccgcaagcaaccagcccacagcggtggaccccgccattcgcccggcattgcagcgcatcatcgaccaaaccgcccaagcggcccccaccgaaaccatggtccaaaatcctcccatgcccaatccggtggacgtgaagcgaggggaatatctgcagcgcggcaccctgccattgatcctgctggcggcgccgctggcggcactggcggcaaatgctccgctcgtggccatcatcgcggccactgcgttgttgtggctactgctcaccctggcctataacaccgaaccccagcttgagcgcgagggcaaacgcggcggcgagcgcaaaaactccgattcgtggattcgcgtggcgacttttccctggcatctggtcaaagccctgctgctggccattccccgcatactgctgctagtcatcatctatatggcgggaaccgccgtggccaccgcggctctggcactgcccgttcacaccatctcctggtatttcaccgcggattggggtattccggtgccgttgctcaatgatgtgccgttctccgcttccgggctggcgctgggcggtttcatggccatcggctggctggtcactgtgttcgccccacagtcgatgatgattcggctggggggcggcgtactgcgcgggctcaaacacagtcgcccggcgggcgcgccatccaccgaagtgggtggggctccacctgctccagtggcgccggcgcccaagggcggcgggcgcggcaccgtgctgttcaccatatgggccatcatcaccgtggccttgtgcgcgatgccgattctgggcatgccgatcaactggatgccgttcgcctagagcggggcggaatctcacacatcagccatccgcacacatggccgttgtgtatccgatacgttcgttccgtcacacttttacagggaattcacctcagatcagctctgggcgcagtcctcctcaggcccggtcattatgatggggcccaaacattgaagcgattgcaaggggatagctatgtcagatccgaagcgtcaggccaagcgtgccacacgcgctgagcgccgagcggccgaggaggccgcacaacaggcacgggccgagcaggcagccaaggagcgtaagcagcagaccatcatcggctgcattgtggtggccattattgtggtgctggtggccatcgctggattcgccgtatacaaggctatgcggccgtccaacaccagcagcagtagccagcaaagcaacatgaccgtggacgaggcctatagcaagctcaagaaagtcagtacccagccggctaacgccgacgacaaggccggcttcgtaatctccaacaaagggtatggccagaaagccgagggggctcccaccgtatccatctacatggaaccgctgtgccccggctgcgcctcggtgaaccgccaactcgacccgacgctcgtcaagctgatgaacgcaggccagctcaacatcgatttgcacttcctcaatttccagaacaacaagagctccgacaactactccaaccgcgtgttcaacggtgccatctacattgccgagcatgatgacgatcccgaccacctcatgagctacctctccaacatctacgctgaggatttccagccgggcgaattgtccaattacgagccggtaaacaacgccaagctggagaagcaggccgtcaaggccggcgtgagcgaggatgtggccgccgcggcgttcagcggcaagaacgaatacctcgactggctcaccgcctccaacaactacacgatcctgcgccccgaactgttcaacagctccggcgccttctcctcccccacactcaccatcaacggcgaatactgggatctgaagcagctcacgctggcggacacgaatatggtggacggcttcctcaagtccattgggctggatgctgaccaggtaggcgtggaaggcaaaatgccatccatcggtgccagcggaaagccgatttcggtcacctcctgatgctgcgtggccgaataagttgacgccgcgacatatgcaataccgcctgcggctcggcttaaattgaccactcgggaagtaccggtatactagtcatttgttcgcaacgatttacgcgttaagaacaatcgcctctttagctcagatggccagagcggccgccttgtaagcggcaggtcgtcggttcgatcccgacaagaggctcgtcgcgcagaaaaaatggcgtattatgtgatacgtagacttttctacgcatataattcttaccttgggtaagtactccaggagccttcccccaattatgggcttcctggaatgagggcggagcgtcccccaaccagctccgcgccttcaagggggcgggaacatccccttctctcccgccccccttttcttttctttttttgagctcagaacaatctgacgagcaggaatggtgacggtggccggtgaaaccgcagtacgggccggaacaaccgttacgatgggtggcgtaatcgttcacccagcaggaagagtatggcaatggcacggcgttggaccccgcagcggtttgttacactgcgtcgcatccgcgtaatcgcctgtatcgcggcgaccagtatcgcgctggctggatcattcgcgttcaccgcgcgtaaatccgtggccctgaacatcaacgggcaaaccacccaagtcaccacatatgcgatgacggccacccgtcttctggaggaacaaggggtggatatcaagacccacgatatcgtgaccacctcgtccggcgaccagctcgccaatcatgccgtggtcaccgtacagtccgcctaccagaccaccatcaacatcgacggcaccgccgtgccgttctggaccgtggccaccagcgccgaccagctactgggatttttcgaggaaaaccagaacaacgccgcgaagatcaccgtcgacatcaagaacgtgtacaaccagctcaccggcggcctggtgatcaaccagtccgggccggtcaccgtcatcgccgacggcaaaagctcggtggcccccaatggcaagctgccggccgcctccatcctcgattccaagggcatcgtgctcaacaaggaggatcgcgtcagcgttgagaaagacagcgacgagaccattctgcgcgtacgccgcgtgacccacggcgaggagacgcgcacgtccgtgattccgttctccacccagaccatcatcgacccgaatctggctgaagggcaggccgatgtgcgccagcagggcgtcaacggcgagaagacgcaggtgtacgacgtcacctatgtggatggcgtggccgaatcggagacgctgaaatcggagaccgtcacctcgatggccatcgaccagatcatcgccgtaggcgccgccaagtctgataccgataaaggttccgataagaaatccgactccgccgataacggcaaggccgattccggttccaacaatcagcacgagtcgtccaacaacaatgccggcaacaccggcggcaacaactccggcaacaccggcaattccggcaacaccggcggcaacaactccggcaacaccggcaattccggtaacactggcaacaccggtaacaccggcaactccggcaacactggtaacaccggcggcggtacgaacaacaattccggctcttctggctccgattcaggcacaaccaccacgccctccggccgcctgtggcacgccaccgtagcccaggctcaggcctatgccgccggtgccgccgcgcagcgcgggtggacaggcaacgactgggattgtctggtcaaactatggacccgcgagtccagttggctgtggtatgccgaaaacgcgagctccggtgcctacggcattcctcagtcgctaccagcagacaaaatggctgcgttcggtgccaattaccgtgacgatgccgccgtacagatcgattggggtctgtggtacatcgcacaagcctacggcagcccgtccaaggcatggcaacattccgaacaagtcggttggtactgatcagttacgaagcccacaaggaacacacgcttatgaacgacaccattcccgccactggtcacctgttaggtgccgccgatatccgtcgtatcgcggccgatgccggcatcagccccaccaagaaattcgggcagaacttcgtcatcgaccccggcacggtccgtcgtatcgtacgcgaggcgggagtgaccgctgccgatcatgtcatggaagtcggccccggcctgggatcgttgacgctggcgattttggaaaccggcgccaccatgaccgcagtcgaaatcgatccgccgctggccgaacgactgccgggcacagtcgccgaattcatgcccgaagccacgtcacgactcaccgtcatcaatcgggatgccttaaccgtcaccccggagaacgtgcctgatttcagcgatgacgcatcgtttacgctggtcgccaatctgccgtacaacgtggccacgccgattctgctcacgctgttggagcgtttcgacaacctcggctcgttcttggtgatggtgcaaaaagaggtggccgacagactcgccgccaagcccggttccaagatctacggcacgccgagcgtgaagctcgcctggtatggcaccgccgaacgggtgggcaccatcggccgcaatgtgttctggccggctcccaatgtggattccgcgctcgtcaaattcacccggtatcaggccgatgacccggctgccccgggaactgcgaacagcacagacgacggcacacaacgggaactcgtatttcgtctgatcgatgcggcattcggtcagcgtcgcaagaccctgcacgcggcattgaagaccattgcgccctccgaggcattctccatcgccggcatcgatccgacccgtcgaggagagacgctcaccatcgccgaattcaccgctctggccaaggccatcgaatcgtgtggagatggagatgaggcacaatgagtccggtaatctcacatccacgctcagccgctgcccgacatcagtccgatgagctctcccccatcaccattacggtggattgcccggcgaaaaccaatctcaccttggaagtgggacctgctcacgacgaatggagcggacgccacgaactggacaccatctactgcgcaatcggcgtatacgacaccgtcaccgcaaccgccaagcaacccggagcaggattctctctggagctcgaaggcgcttatttgggcgacttggcctcctcacgcagcgacatgcgccgcaaccatgcggtactggccctcttcgccatggcccaggcggccgagcgcgagccggatgtggcgttgaccatcaccaagcgcattcccgtgggtgccggactaggcggcggttcagccgacgccgcggcgaccatgctggcggtcaatcgtctctgggagctgaactggcccatagagcgcctgcgcaccattgctgccacgttgggcgcggacatgccgttctgcctgaccggtggccttgcatacggcaccggtttcggcgaacgcatcacggatatcgcccccggcagccgcgatgagctggcgctgatagaacagggattcagcggcgaagtattggtcggcgcataccagtcgcaactcagcactcctgaggtctaccacacctttgacatcgtgggagccgcagaaggcgaccgcaatcatctgcaggctgcggcaatcagcctgcatccccgcagcgggcaggccatcgacgccgccacgcaggcgggtgccagccatgcattcgtctccggatccggcccctcagtggtcgctttcgccgccgacgaggcagcggcacaacgcattatcgaggtgtggcgcgatacagctgtggtcgatcgtattattcgagccaaatctcccgaacaccccaatatcagcgtcagacagtgacgctaaggtagcaaccagccacccgacccatgaaagaagtccaccgatgacgtatcaggttgatgaacgtgaagcccgcaaggcgtacgtgcgccaccgccagaccatcgtcttttccatcagcggcgcggtattggcagtagtgctggtcatagccctactgttcaatttccacgttttcggcctcggcgaagtggagactccggcccgccagccgaattacggcaacgcggcaccgtgcgcggtcaaggacagcagcggcaaagcgcaatacgtgtccaacgcttcggtcggcattcgcgtgatgaacggcacctctcacggccaattcgccaaggccgtgggtgaagctttggccaatcgtggattcagcgtgcagaaaatcgataactattccagcaccgacgttgaacgcaccaccatctacttcggcaagaacgccattaatcaggcgtatacgctgatcggcaatttcaccgacgccaccatgatcatgacggctcgcgaggatcagctcatcgatgtggtcatcggcgccacgttcaacgatctgcaggacaccaactcctccccgcaatccggtaagaccatcaccaatatcgagggttgcaaggccgccgatagcatgaccaagctgcccgccgacaccaaacacgacgcatacacggcgcagtaaggcgcatacagcttcatcttcgcgaaaaaccgtacgctgacacgtattcagcgtacggttttttttggtatcggactagtatcggactactgaatctcggcgtaccagcgcttgagttcttcgacggccacatcgtggtccaccggaccgttatccaagcggtattccagcatgtgcttgtaggcgcggccgatcatcgggccgggctccaggcccagcaactccataatttcgttgccgtccagatccgggcggatcgcgtcgaagtcctctttcttcttgagttcgcggacgcgctcctccatctcatccatggcctgggagaagatcatcgccttgcgtttgttttgtgtggtggcatccgcacgcgtgagcctgttcagccgctcatagaggtgcccggcatccttgacataccggcgtacggccgaatcggtccacggctcgtccacatagccgtggaagcgcaggtgcatattcaccagttccgagacgtcctcgaccagatggtggtcaaaacgcagcgccttcaaacgcttgcgggtcattttggcacccaccgcgtcatggtggtggaagctcaccttgccgcccgactcgaaccggcgggtcttcggcttgccgatatcgtgcatcacggcggccaagcgcagcgtcaggtcgggggcgggcaccgggccgtccgggccggtttccagggcgatagcacgttcgagcacaatcatcgtgtgctcgaagacgtccttgtggcggtggtgttcgtcgatctgcaattgcagggccggaatttccgggaagacgatgtccgcaagaccggattcgaccaacgcctcaaggccggcgcgcggacggtcggagagcagcagtttggtcagttcgtcgcgcacacgctcggcggatacgatgtcgatgcggtcgcgcatcgaggtaatcgcctcggccgcgtccggcgcgatacggaagcccagctgggccacgaatcgcacggcgcgcatcatacgcaacggatcgtcgtcaaaggactgtcgcggatccaccggcgtgcgcaacacgcccttggacagatcactggcaccaccgaacgggtccacgaattgcaggtcgggcacgcgcagagccatcgcgttgacggtgaagtcgcggcgggacaggtcgccctcaagcgtgtcgccataattgacctcgggcttacgcgagtccggatcgtacgtgtcagagcgataggtggtgacctccaccttgacctcggtgccgtccgggcggcggcgcatggcacccagcgtgccgaacttgcgccccatgtcccagaagccgtcatgcccccaccggcgcagtatcggctcgaactgctcaggccgtgcggatgagcagaagtccaaatcgtggctctttctatggagcagcaaatccctgaccgggccgccgaccaatgccagctcgtaaccctgttcggcgaacagtcgaccaagttcgatggcttcaggccatacttcgaaatccaatgggcaccttcccgcgtgcgacgtttttctgccctaccagcataccgttaccccacctgcacacggggttgagtaaggtggagaatatgattacgcccgccgaccttgcccgcatgctggggcaaacaccagattcggcggatagccatacccaagaccacctgctgtatacgtccgaaactccgcatcattccgccgattcgggcgattcttccgatgtcggcggcaccgcgagccactccaccaatcaggccgttcatcaagacgaagtagacgcagtaccgactgcgcaacattccggtgtgcctggcacacccgcaacgcccgccacacccgaaccatccgaatccgaaatatcggacgccgccagcgacatgcccgcaccgaagccgatgatgcccacaccggccaccgtcttcggcatgcatgccaccgtcaccatcgccactaccagcggcactatcgaggggcaggctgatggtatcgccggcgaggccggtgccgagacgattgccgaggtcgagccgattatcgccacggcacaaacgtccgtaaccatcgtcacgaacgatcccgcggcgaccgctcacgcggccgtagatgctgccgttgcggtcgccaaggccgccgccgcgcacaccacagcgataccgactccgcgcgacgtgctgatgccgcctgcggcacgtaccgcaccggccgcaacgccggtcaccatgccggtctcagcgccgtctgcagcaccagtgaggcccgcaacgtcagcgcatcccacgccggccacggtcttcggccggcacccgtccggagatgttgcctcgccggaaccggcagtgccggtagaaccggtgacgccatccggcccgactccggccatgatgccgcaacgccgtacgtcggacggtccgaccacattcgcttcactggatgcccaggaactgccggtcgtacgcgaatattcggcaggcggtctgattttcgatgaccagaaccgcgtggccattatcgcccgtcattcccgctccggccatctcgaatggtgcttgccgaaggggcatatcgaaaaaggcgagaccccgcagcagaccgctgtgcgcgaagtgcatgaagagaccggcatcctgggcgaggtgatcgattccatcgccaccatcgactactggttcaccggtaccacgcagcgcgtgcacaagctggtccatcacttcgcgctcaaacagaccggcggtgaactgacggtggaaggagacccggatcatgaggcggaagacgccatctgggtgcgttttgaagatttggatgacgtgttgagctatcccaacgaacgcaaaatcgcgtggctctacgccaggaagaagaacaggcaggcaaacgagtgaacctacccggagtcttacgacattgcacacgtctggcacacgcactggcggctggcgtcgccgttgtggcgatgctggccgctccattgaccgtctacgcgaacgatacgacggacacgactgattcatccgatacgacggacgcaacgggcaatcagaccgagaatcagcccaagcagagcattgccatcacgcaaagcacccccatcgtcacctccaaatcgggctatcgtgtcaccgcggtcatcagcaatacggacagcacggccacgtcaagcggcacactgcacctgaccaccaatgcgttgttcacctttgtctcgcgcaccgatattcagaattgggccgagaacaacgcccccatcccaacccccaacgagttgggttccgttgacgtgccatcgattcccgccggcggcactgccaccgtcaccatcgaggtgaacgccaatcagcagacccttgcctccatagggagttggggaccgaaaccgctgatgctgtcgtatatcgttggcaatcagatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacagcacggacaaggccgacaagtccgataacgccgacgccagcaacgcggccgaagccactgatacgcaagccatatccttatccgaacaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgacttcgacatcaccgcctataccgcactggacgataccgcggcctacgaaaaggccggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccggtgcctctttcgatgccgaccagactgaagccgtacacacaggcacctacgtggtgcatacgcctgccggcgatgtcaccgtgctgaaggagcaatcgaccttgggcacgctgtccaagggccaagccaccagcacggacgcgcaggccgagtccagcgatgccggtcggttggcccgactggtcgctcagagcgcgttctaccagatggaacagccctatacatcccgatacctgcttatgacgttctcccgcaccacggaggccagctggatagatcaggtgatgagcgccttcgagcaggcgtcttggttgaatctgacggacctgaagaccatggccaaggccgatccgtacaatgtcagcgattcggtcaatcccgacaaggccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccgacaggacgccaatgacaccgcctcgcatagcaacgatccgacgcaatggattggctctttactggtgctgcatgacgatatggcgctgcggtccatgtctggctccccccagccgacagccacgcgaaaagccatggtcaaagccgcgaaaacactggccagcgatcttctgaacggcgtacgcatcaacccatcggaatcggtatccgtgttcagcgaatccgcgaaaatgccaatcaccgtcagcaatgaccttccctacgccgtcagcgtgcaggtcaactcactgactgactccatgcagatcgtcacctcgcgaaccgctgacatcgatattcccgcgcatagcgacgctcaggtgaccttcaccatccgcgtttccacttccggctcatcgacggcccatgtgtcgttgaccgaccgggaaggcaacagcttcggcaacacgcaggacaccgcgatcaccagtgtgatgcgcatcagtgatgccagcggcttcattatcatcggcttcgccgtgctactgggcattatcggcctgtggcggcagttccatcggaagaaggaccccgacgaatgagttcaagcgtaggtcgtaattccctgatcatggccacgggaaccgctgcttcccgtgtgaccggtcagctccgcacgattcttctcgctgcggccatcggcaccaccggattggcggccaacgcctatcaggccggttccatgattccccaatccgtgttcacgctggtgtccggcggcatcttcaacgccgtgctggtgccccagatcgtgcgcacgttgaaagaaaaagacgcccaagaacgactgaatcgcctgattacgttggccatcggcatcctattggccatgaccgtggtgatggcggcggccagccctctgcttgcccgcctgtacgtgggtagcgacgatcaccagatgatagccctgaccacctcgttcaccctgtggtgcatgcctcaggtgttcttctacggcctgtatacggtattgggtcagatcctggccgccaaagaccatttcctcacgtatgcgtggagctcaaccggtgccaacattattagttgcgccggttttactggctttattctgctgttcagcaaggccaatgaacagcccctcgaattctggaccgccgacaaaatcgcgcttaccgcaggcacctggactttgggcgtggccttccaagcgctgatactgttcctgccgctggcccgtatcgggttcaagtacaaacccagcttcgggcttggcggctttggactcaggtctatgggtcccgtggcgttaggctctttgggcgtggtgatcaccagtgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcgctcatcgccgtatcggtatccacggctatgttccccaaaatctcccgttccatcgcagctgcgaatctggatgaggcacggcacgacctggtcagcgcactgaataatgtgggcctgctcatcatgttcttcgccgccgccatggtcgtgttccccgaaccgatcatccgcgcattgcttccgtccgtctcgatggacgagactatgttgatctcctatgcgcttatcgccttgtctatgggcattccattggggtcggcgttcctgttaatccagcgcacgttctacgcctttgaggacggccttcaccccttcctgtccgcggtgatgcagtatggattcacctcaatattcatgatcatcggcatgatggtacttcctcctgagcattgggtactcggcatcgcctgctcggtgaccctcggtggattactggcgttgccgctgacgttgatgatgttgcgccgcaagttcgaaggcaatcttggcggtcgggagatcacgaggacatatgccaaggccattgtggcggcactggcttccggagttgtggtctggctgatcaaacgaccggtagtcgcactgttcggcgcggatattcgaccagtaggcgggcacatgagctggtggtctgcgctggccatctgcgtggtgctcaccattgtgctggccgtagtatatgtggctgtgttgtgggtggtacacaccccggaactcatcagcgcctatcactcgatactggcccgtctacacaagactccggccagtgaggacgttgctgtgacagcccagccggaaaaaagtcgacgctacgtaaatcaatcctgagacggagcccgtcaaggatagccccgcacgtagaatatctaagaccaatctcgaacaccaatcacacggagccgaacgcactatgaaaccgcaactcggagacacgattctcaaccgatacaccttggtatcatcgttgcgtgaggagcctggcattcaggcatggaaagccaacgaccgtgtgctggcaaaggattgccagctgttcatcattaccaatcgcagcgctttcgccgcaatcgatgagctcgctggtcgcatggccgccactcgccctgatcgtgtgattcccgtactgaaataccgtatggaatccgacgtacttctcattgtcatgccggtggatagcggccaatgcctgactgactacatggtggataccgccaagccgctcagctacagcgccatccggtcgattatcggagaatgcgccaacgtgctgcgcgaggtcattgcggatactcccagcggcatcgtcatcacaaccgacaccgttcgagtgactacctccggtgtgcaaattgccgatgcaccatgtgccacgatgctggccgatacgtccgctaccgatctgcgtacggacggtcctgaacggtatgcgattcgccagcttgcggcattactctataccctgctgacacgcacgccaagccaagcgacacccacattcaatctgcgtgccttgccgcaagacacccctggcgaattccgcgtgatttgcaagcgtggattggccttgagcgagcccgacgagcatacgttgccaatggcagcccttgtagaactcgacgccttgttgggtaattggaagccgctctctgaactgagcgatgctgatatcgctttgccgagcgtggaaagcgattgctcgattaccaaggcgatactgaagcctgccaacgagactgatatcgtgcctattcccagcacgttgattaacagcaacagtcttccggaattgtctattaccccttccctgccgattcagccggccgccgtccccgctccgcacgcgatgtcaccggttcctctgcctgatgggtccagtactgctgacggcaaccagtctcagtctgatgcccgccgtctgtttgacttcaacctttctgacgcctgggagcacgaaaatctttccggtgaaggcaccggtgactggtacagcgaaatgaatccggcccctatcggcggtccgggtgataatactcggttgacagtgcctattgttaccggcggtatttccgatgccaccgtgggagagacaaccagtcgtattcccgtgttcgacgccagcggccgtgctgtggctcccggtgaggaatcactgcgtgccttggaagaggagcaggcccgcattgccgaagtaagcgccattcctccgagcttcacaccgaaggatgtgccggatgacgaggttgacagcaagctgcccgatgaacatctgttcggcaaactgtcgaccaaggtcgttgccatcattgtggctctgatattggtagtggcagcggctgtttgggcagtgcatgcgttccgatcctccggagacaatcctgccgatgcttccagcaactccagtgaaggtgactggcccgatatcaatgctgacgctgtgccattcggtggcagcaagaacgcgacgaacggtggcgccactgacgattcctcaaagtcgagtgatgccactcagagcgaatccagggactcggcatcagacaagtccaagaagtccgagactgctgattcgtcgtccaagaagaccaaggccaagaagtccggcgataaggattccagcgctgctccgcaaccgcgccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcaaataccactggagaccccactcagggcgagcaggtggccgaattcacctttgctgaaggtggcactactgaggtgaagttcaccaaagccgtcaatacgcaggatctgctgctgtgggtgccatcgggtagcctgccgcagaaccagctgtacatcgagaaggtggaggtcttctaatcggcatctataccgataactgacccaagaagggcggtaccgttcgcatacattcgacggtgccgccctttcttcgcgtctggctgaatgacatggaatatcgtatgggggtgtgacaatgtttcacgtgaaacataacgtcatcattatcggttctggtcccgctggctacacggccgccatctatcttggccgtgcaggtcttaatcctgttatggtcactggtgcgttgtcgccaggtggacagttggtcaacaccactgaggtggagaacttccccggattcccggaaggtattcttggcccggatcttatggatcgcatgaaggaacaggccaagcgcttcggtacaacttatatcacagacgatgtctcttccattgaggcgtgtgagagtgattcggtcaagccgacctatcgtgtaacgctctccgatgactcccagttggaggcatcagcactcatcatcgccacagggtcgtcattccgtaagcttggggtgcccggcgaacaggagctgtccggacatggcgtctcgtactgcgccacctgcgatggcttcttcttcaggaacaagcctatcgtggtcgtaggcggtggcgattcggcttttgaagaggcattattcctgacccggttcggttcttcggtcaccttgattcaccgacgcgatagcttccgtgcctcgcagatcatggtggaccgagccaaagccaatccgaccatcactctactgaccaacacagtggtgacctccattaccggcacctcctcccccacacagaacaccggtgcacctattgccattcctggcttgacaatcaaacgaccggctgtggcaccggccagtgtcagcagcattgccgtacgtaacgtggtgaccggagaagaaagcacgctggacaccaacgccgtattcgtggctatcggccatacgccagccactgattttgcagctggtgttgtggaccgtgacaatgatgggtatgtcgtggtgcagggtgccagcacggtgaccagtgcgccaggcatctttgctgcaggcgattgcgtggatcgtacttatcgtcaggcaatcagcgcagcgggcatgggctgccgtgcagcgctggatgcgcaggcctatcttacggactgattgcggcgacctgatgatggcttgctgttctgactgctgcctgtgacataggagcagcgctaggtcagtgttacagcatgccgcctttggatagtacgcaccggtcaaaggcatagaaaggcccctcaggcgcggagaggttgtgcccgatgttttgcgcaaatgtggcctggtccgtcgtcgggggaatgacttcagtcggttgattgcatgatgccgtcgagccgggacatgtccaggtagcggcggctcgaccaatcgttggcggtgacgtagcggatcctggcgcagatgagcatgagcgcgctcctgccatccgggaagctgccgacgacgcgggtgcggcggcggatctcccggttcaatcgttcgatcatgttgttcgtgcggatccgccgccggtgctccgggggatactcgtcgagcagataggtcgtggtctcgccgataccttccctcaggcaggaggccgccgctttcagtctcctggactccatctcgcgggcgacctcctcggccttggcgagggcggacgcgcgtgattccatggcgaagatcgccttgagcgcggcggacgcccattcgcggtgggtgggcggcaccttggagagcacgttgcgcatgaagtggaccatgcaccgctggtatctggcctgcggcagcatctcgccgacggtggcgacgagcccggcgcacctgtcgccgaccacgagcctgacgcccttcaggccgcgctcgatcatggaccgtatgaactgctcccagctggccttgtcctccttcatgccctcggccacgccgatgacctcccggtggcccgtgtcgtccacgccgatggcgaccagcacgctcacgttctcgaccgacccgccccatgagcgcttgtgccacacaccgtccatgaacacgtacgggtactcgcccccaagcggccggttgcgccattcgtcgatctggtcgtacaccttcctgagcttgtcggagagcgtctgcgagggcatccgctcgccccacagcaggcggctgatgtcgtcgacctgacgcgtgctgacgccggccaggtacatgtcgatcagcgcctcctcgacgctctgctcgcgacgccggtagcgttcgatgaccgccgactcgaagaccgcgcccttcagcttgggcaccttgagtccgagcctgccggccttgacggtgaacctgcgcgcgtagtggccggcccggtacgccttgcgtccatcgcttctctcgtatctggcggcgttggcgattaggtcggcctcctcgtcgagcatcgcgttgacgatctgctcgaccttgtcgcgcaccatggcgtcgagcttggtctcgaacatggcctggtcgaactgtatgatttccttggacatggcccgtgcctctttccaatcgcggttttcctgtgttagcgactgaaaatcgtacccggtgcgggccatgctcatatccgggaagcccgaatcacaaagtgcgcaaaaactgggcgttatctctcgtcgcccgcgacagcttcaccccgcaagactgaaaacaaaaactcgagatacagcaaggaccggcatcctgttacgaagccggtcctgcaattacgtttcagcaatcgcgccttaacgaagaaggtgggcgtcgcaccagacgtgttcgacggcccagatggcggggttgatcagaagcacgtcggcagcgtagccgggggcaagcagaccgagcggctgcttggtgaccgggttcgcacgatcgaaaccgaatgctttggccggaatcaacgtggcggcttccaccgcgtcggtaggcgtgaatcctaattcgagtaccgcacgctgaacagccttttccaacgtcaacgtggaaccggctatcgcaccattcgatgcaagacgaacatgaccgtcaatcacattcacatccaacgcacccagcaaataatgaccatccgggcaatcggtggcagccatagcgtcggtcacaaacgcaatgcgatgcggagcgaagccgaatcccaaacgcaccatcggatcctgcacatgaaaaccatcattaatcaactcaacagtgacgcgcggatcctcaacagcagccggaatcggaccaggctcacgatgatgcaaaccattcatcgcattgaacatgtgcgtcataatgccagcacccgcatcaaaacctctgcaggcggttgcataatcggcatcgcaatgtcccaccgcaggaaccactccagccgcagcaaaacgacgaatcgcatcaatgccatgcggtagttcgggggcgatggtgatctgtcgcaaacagccgttcgcagcatgcaaaagccgatcaacatattcgggaaccggatctttcaagcattccggatcatgcgcacctttacgagacaacgcaaggaacggaccctccaaatgcgctccaagaatgtcagggcgagcacccatcatgccacgcacggtttgaagattggcgcacatcacgtcaagcgggttggtgatcaaactgagcacctgacgggtggtgccgtgcatcatatgacctgcgcgagccatgcgtatgccttgcacaccatcatcgaaggaactcccccacgaaccgtgcgcatgaatgtcgacgtaaccgggagtcatcatgcggcctgcagcgttggtcacgaaaccggccgaaccggtcatggaatcgccgaaaccaaccgaactgaccgaatcggaatcagcatcggcatccaaaccgacgcttgcgcatgccgcagcaaaatcatcgtcccgattcccagtcgcaataatcgcgctaccatcggaaaccagccattaagagacgccactctgggagatagacacgcccctgacattgacttcatgtccacactcaaccagggtaaggtcgagcgtgaacatgaagtcagcttgagtcgattagagctgaatcacgactccctcccaacgagcaagctcgccgcgagcgatcgacttcacgccatgtacggcatcataggtgctgagcagcacctgcgactcgctcacgccattcccgagcaatcgcgcgacctccgccggcacccgcgccgtcctaccggtgagattgaccatgacgagaatcgtatcgtcgccgccggtacgggtgaacgaatacacctgctcgctgtctgccgcgaccagattccactcgcccgtcgcgacggtcgcgttgccgtggcgcatggcgatgagcttcttgtagaagccgtacacggaatcaggatcgtcgaactcctcggccgcgttgatctccacatggttcggattcacgccgatccacggttccgtcgccgcgtcggccgcggtgaagccggcgtacctggaagcgtcccactgcatcggcgtgcgcgaattgtcccgtccgatgagcgcgagggccgccatcatcgattccggcgactggcacctggcctcctccacgcgctggcggtaggcgttgatggcctccagatcgcggtactggtcgagcttggtgaaatgggcgttggtcatgcccagctcctcgccctcataaatgtagggggtgccacggtgcatgtgcagcagcatgccgaacgccttggcgctcaactcgcgcgactcgcggtcagagtcgtcgccccaacgggacacgacacgcggctggtcgtggttgcagaagaacaggctggcccagccggcgttcctcacggcctcctgctggtcggcaagacgagcacgcagattcctgacttcgaacggcacggtgttccacttggaaccttcctggtcgacgcccacgtggtcgaacaggaacagcatgtcgagttccttgtgggccggatcggtaatgaactcgttgcgttccggagtgatgcccggcgcctcgccgacgttcatgtagccctcacggccctcgaacacctcacggcgcatttcggcgaggaattcgtcgagccgcggaccgtcggaacagaacgggcctgcgtccgtgtatccctcttcgcctatctccccctcggacaattccgagccgacctctccgggcagccgtccgtggccatcgagatgtttcgagatcaaggtgatcacgtccatgcggaagccgtcgatgccgcgatccatccaccagttcatcatcctgtacacggccttgcgcacctccggattctcccaattcaaatccggctgcttcctggagaactggtggaggtagtattcgccgcgcttcggatcgtactgccacgcggaaccgccgaaataggaaccccaccggttcggctcggcgcccggagtgcccggctcatgacccggcctggccggacgccaccaataccagtcggcatgcgggtcgtccttgtcgcgagaagcctggaaccaggcatgctcgtcggacgtgtggttgaccaccagatccatcacgatcttcaaaccgcgcctgtgcgcctcggcgagcagctcatccatgtcctccaacgtgccgaacagcgggtcgatgtcctggtagtcggagatgtcgtagccgttgtcgtcctgcggggacctgtagaccggggacagccacagcacgtccacgccaagatcagccaaataatcgagacggctggtgatgcccttcaggtcgccgatgccgtcgccgttcgtgtcctggaaggaacgcggatagatctggtagaccaccgcgttggcccaccatgggttcggggtcgcgccgttggaacgcacggcgacgggaaggacggaacgattgaaatcagtcatatcttgtttccttattaaatcaagttcttcatcaacgcgatgctatggatccacgttgcctatatacgggatgaatcaatgttgctttttcctttccctttagagttccatccatgagccgaacaagcatgctcatgcccagttgacacaactctgctggcattaagggaaattcatctatcctcagacgcttgcctatggaatctgtatatgttcccgctgaaatcagcgaaagatcttgaggaatcttcattccacgctgccgcgtcgcagcaacaagattattaaggaacaatgggccgccttgagtcacaattgctgtgttctcactcgagatgaacctctcaagtaggttttcggcagcatcgaaatcatcctcgtcggtaaactcttcatctatatgaatcttgtatcgcgcagcagcatcatgcattgatgtcctgagtcgaatgaggtaatttgcacctccatttcgttcgtaatcaatctccttcccccctgcaaacagaattctgctgtgcccattacgacaaagcgtttgcatgatcatttcacccatttcaataaaatcggtatcaatgcatggcacatttatttcattcataggatgtccaatagaaatgagcggaatacttgaaagctgagccaattcaatccggggatcattcatagtcacatccataagagcgacaccatccaccatcccagtatcgatgatagagcgaagctgctcatctcctgtttcctcagtcaacagcaacgtttcatagccaagtcgcctggccgctttgagaaaatttagaaaataagcacaatagttggtatagctggtggaatcatggacgggcgaactcagcgcgacgaaatgagtctcaccactcaacggagctggaccaccgtttttcgccaagtaaccaagttcccgcgcagcttgcaatactctccgacgggtatttgcccctatgggacgtttccctgtcatcacataggaaaccgtgcttatggaaactcctgcgagagccgccacgtccttgattccagccattgttatccttattcgttcacagtaaagccttggctctttccttgctcaacgagcttgtcctgccaagccttcacaccttccttcattgtggtctgtcccgtgtaagcagccccgacagtgtcggtgaaaacgcttcgcgcataaacgtcatagggcagaaattcgaacttagatgtgacacgcttcgcagcctcggcgaattcagcattgaacttctcaccgccaaaataatccaccgtgtctccatcggagttcaccatagtagtctggctaaggaatttatcgttagacatggtcttcaaatcagcaggaaaaccaccttggtccacacgggacatgatggcatcagaattagtgctggcaaattccataaacttgtacgcagcatccgcattcttggatgacgacatcagggcaagggaggagccgccgtactcagaacttaccttctcgccggcgttccacgttggcatttgagcaattcgccactttccagcaccctccgaagcattgtttaaaaacatgccgggagcccatgcagcagatatcacgctcgcaaattctccggaaccaactgaacgataccaatcatcagaactatcttttgtcttcgtttcgattagtccttcatcaatcatcttttgccagaagtcacagaatttctgcactcctttatcagtagtgagtttgacggtaaccttggtgccgtctttagatgtggaatatgggtgtccacctgcttgccagaccattgcattgaagaatccggcgttccctggatcattagtaatatatgaaccaatctgcttaatcttctttgcatcttgatagaactcatcccaagtacttggcggctcagaaatgccagctttgtcaaatacctctttgtcatagtaaaaagccattggtccagagtcgactggcataccatacataccgccattgaaattcactgcattccaagtacctggggtgtagaaatccttatatttggcagtcccatagtcattcagatttttaagagagcccttaattacatactcaggaatcgcataatattcaatcatggctatatccggaattccactgccagcttccaaagcattattcagagctttgtattcatttttaccactaccggcattggtaaatttgatgacaatgttagggtttttcttcatgaaaaccttagcattagctttaagattgttatcccaagcccaaacattaacaaccgtcttaccgctcccatcgggagtttccgactgagttgttccacacgctgccaatggaacaaccatcgccgcagcaccgcagagagcaattatttttcctaacgagaacctcattgtttccctttctttctattgagcagcagtggcatgaccttgcttttggcgcccttgcttgtagtctgcatcttaaaaccgaaggattatgactgacaaataatttcgatgatttcgacgatttcaataatcaaggcactcaccataacagacatgcgcggctgcatcacgcaacggccaacacaattgatgatccattgtctaaagaacgagaaagtcacattagcgaatactccactgagaccaacggtagcagccgcaccgccaccgacaatggcccctcaagcggcgcatacaaaacccatggaggggcacaggttacggagatatgcaatgactcccggcccattaaacctataacgtaaatcaacagcgatgtcgccaataacagctctgctatatatttccatcaacaaattgcctggaatatgtgccaaattgcaaccccggcggttcagctatcatgcgctgaaccatcaacttcgtaggccctcacacgatacagtcgcgcgcgcctgttctggtgagtgccttgattattgaaatcgtcgaaatcatcgaaattatttgtcagtcataatccttcggttttaagatgcagactacaggcaagggcgccaaaagcaaggatcatgccactgccgttcaatagaaagaaaggaaaaagaataccatcaggtgtcctcgaaggcatgaaccgtaccgcccgatcatcgaaatctgaatttcttcagtccaacgatcagggtgcgattcatcaaggctccaccgtggagtgaaagtacaggcgcgaaagggatgctttcccatccacacctgtttcacactcggaaatctttgcgcggcaatcaaaaacaatcaaaaaatgtctcgaaggagagaatgatgtcagcgacggaagttgttgccaatatgccactgcattcggcaaccgtgcgtgtcaataaacacaaggccgattggcgtggttggaagtttatgtggccttttgcggtggtgttcgtgttcgtgttcatcgtgccgatcgtgtacgccgtttatatttcgttcttcaagaagcagatgatcggcggcaccaagttcgtcggcttcgagaactacgcgcgcctgttgggtgatggccagttctggagcagtgttggtcgtgtggccctgttcacgtgcgtgcaggtgccgatcatgctgttcctgtcggctttgatggctttggctttggattcgatgaagctgcatggcacgaggttcttccgtatctcgacgttcctgccgtacgcggtgccggcggtggtgtcgacgttgatctggggtttcgtgtatggcgcgaagtacggcctggtgggttcgttgaacgtcacgatcgtggcgacgtggaacaactacttcctgccgttgatcatgctcaaggattcgaactggtatccgctcacgatcggtttgaaccagtggaaggaccaggcgagcaccgctggcggccaggcgatccagaacctggtgatcacgggctcgttgatcacgatcatcccgctggtcatcgcgttcctatgcctgcagaagtactggcagtccggcctctccgcgggcgcggtcaaggaataatcaatttctacaccacagccatggaacgaaaagtatggcccgtgctacaagtacgggccatacgcatatacatgatctggcggaccttcctcacaaatcacgatagttgttccccattgtgagacgcacttcggctgcaaagctgaagtaattcagatccatatggccgaaggtacggtctggttgtgcccgaagtcttgcgcaaaagcggtctggcccgttgccgggtcggtttcagtcggttgtctgcatggtgtcaccgagtcgggacatgttcaggtagcggcggctcgaccaatcgttggcggtgacgtagcggatcctggcgcagacgagcatgagcgcgctcctgccgtcggggaagctgccgacgaccctggtgcgccggcggatctccctgttgaggcgttcgatcatgttgttcgtgcggatccgccgacggtgctcgacggggtagtcgtcgagcaggtaggtggtcgactcgcctatgccctccctgaggcaggatgcggcggccttcaatccgcgggattccatctgcgcggccacatcctccgccttcctcaacgcggcgtcgcgggattccatggcgaacacggccttgagcgcgccggccgcccatgccgcgtgtttgcggctgaccctggagagcacgttgcgcatgaagtggaccgtgcaccgctggtatctcgcgtccggcagcatcgagttcaccgtggccaccagcccggcgcaccggtcgcccaccacgagccgcacgcccctgagaccgcgttcgatcaggctcctgacgaactgctcccagctggccctgtcctccttcatgccctccgcgaccccgacgacctcccgatggcccgtgtcgtccacgccgatcgcgaccagcacgctcacgttctcgaccgacccgccccacgtgcgcttgtgccgcacgccgtccacgaacaggtacgggtacgaacgctccaacggcctgttgcgccattcgtcgatctgcgcgtacacccccttgagcttgtccgagagcgtctgcgagggcatccgctcgtcccacagcaggcggctgatgtcgtcgacctgacgggtcgaaacgccggccaggtacatgtcgatcagcgcctcctcgacgctctgctcacgacgcctgtatcgttcgatcaccgccgactcgaacagcgcgcccttgagcttcgggaccttgagggtcacggtcccggccttcacggtcaggtcacgctcgtaatgacccactctgtaggccttcctgtccccggtgcgctcgtagcgggcggcgcccgtgatctcgtccgcctccgcgttcagcaattgctcgaccttctccgacaccaaccggtcgagtctcgtctcgagcatgttctcatcgacctgtagaatctgatcctgcatggttccgtcgcctctttccatagcggttttgtttggcgactgaaatcgtacccagacgacgggccatgcctcttcattcaggcttcaaccaaagtgcgcaacaaaccgggcgttatcgacggagaatcacgatgtgtgatttgtcatcctccagcctgaggggttttctattgcgacaggggctacaacgcaggctacgcccctgccaggaatcacgcagaggctataacgtcttgcgcgtacaacgcactgcacagcaataatgccggcgacagtgacaagccgatacaatgccaagtgacaacgctaagcatcggtgttgtcactgacgatgccggcgacaacacgaatgttcttatcgtgttacacccatttggaatcggcatcgccttggctcggcaccagcagctgcaggatgcgatccatatcctctggtgacgaaaagacgatttcgatgcgaccatgcttggtgctgcccttaatcgacaccttggtatcgaaatgattttccaaactctgctggatggcggaaccaacccaaggattggtcttagacgtcttgggcttcttcggctgctcccccgacgcaatcttcatggcgacgatttcttcggtgctgcgtacagaaagaccttccgcaataatacgagaagccagcttgtccatttcctccggatcgctcaggcccaatagcgcacgcgcatgaccggacgatagcacaccggcagccactctcttttgcacagaagccggcaggttcagcagtcgcaaggtattggcgatttgcgggcgagacttggacaccgacttggacagctgtacttgtgtcaacccgaactcttcaatcatctgctggtaggcagccgcctcttccagcggattcaaggccacacggtgcaagttttccagcaatgcatcgcggagcatatcatcatccgcagtggttttgacgatggcgggaatcgtctccaacccagccaactgagaagcacgccaacggcgttcacccataatgagctcatacgggctgtccaaatgaccggcaaacggattcgtgctggattccgtctcgtcgtgcttggcggctttggccgcagcaatctggcttgccggacgcttgcgcacgactatcggttgcagcacaccaacttccttaatggaagcagacagctcattcaactcatcctcgtcgaagatggtacgaggctgatgtgcattgggcccgatatcagacagtttgagttcagccagataaccaccggctaccggcttgagctcgtccttcttatctgtgtcagcggtctttgccgccgatgcagtcaaagatgtttcacgtgaaacatctttgacagtgacggatgtacgatgtgccgtctgagacgcagacgacttgccgccctgctgaggtgcggcgaccttaccggtttgaggtttctccgtaccgaaaaacaggtcgctaggatgagtaatggtgtccaatgcgggcatggatgcgcgtttaccggcggctttcttggctgccttgctggacgatatcgtctgaggcacggcaggttttgattcctgctgggcagtagccttcttggcgggggttatgtcagcagtggccgccggagtagacgaatcctcctcaatcattgcgggctgctccgccactggctcctcccctggcaatgtggggaacaaagcgccaaggcccttaccgagtcgtgattttgatgccattacttgttcctcctcgcatcaatggtgtcaaggacttgttgcgaacgctgtgcgatttccaaagctgcttcaccatacgatatggcacctatgccacgaggatcataggcaatcaccgattgggagaaactcggcgcttcggagatcttgactgaacgcgggatggtggtattcagcacaatgctgggatagtgtcccttgacctcgttatatacttcacggctcaatagcgttcggcgatcgaacattgtgacgagcatggtggacaccagcagtactggattgaaatgctcctgcaccaaaccaatcgtgttgatcagctggccaagaccctccaatgcgtaatactcagcctggataggaatcagcatctcggtcactgcacacatggcgttgatgaccaagaggcccaagctgggcgggcaatcaatgaacacgtaatcatagtgtttatctgattgacgcaggtagaggtccaaggcctccttcaacaatgtgtttcggttgggcagatcagccacttccaactcggcaccgctgagatcgattgatgcaggcacaacatcaagtgtgggaaaatcaggacagaccgtgataacatcacccagatcggaacgcccctcgataacgtcatagaccgagggctctcccgatgcatgagatacacccaacgccgtagaggcattgccctgcgggtccatatcgatgaccaacacctgcgcgcccttgttcgccagcgccgcagcggtgtttaccgtggatgtggttttacccactccccccttctggttggccacggcgatacgacgagtccgttgaggctttgggaaatcggttttcttgagtacatcgtagcgtgagctttcatcagccatttggctgccaagcactgaaccgtgaccatcgaatattcgctgaagcgtttcggaagccgattctataggttccgactgatgatccttggtggccatcgctcctccttgcacagacgtaagttccagtgttctcattcgtatggacatgatgctcgttatccacaattgcgatatgcaatgtggataagtgtggataagtgtgaatgacgttgagtgtaagattgtgtattcacagacgaaaacattgaaaaatcaatgttttcatcattatgcacatcgtcccgtaaaaatgtggataacttttacgcatatatggaaatgtggataactcaatcagtactccactcatcgcttatccacaatcaccacgtgggtaggctcaagatccggcccgacagccgcctcaacgacacgtggacgacgaccaccgaattttgcaatctccttgccagccttgtcgatttcagcctgagcagaccgtcccttcagtgcgatcaactgtcctgacggtttcagcaacggcaacgtccagccagagagtttggtcataggagcaaccgcacgacacgtgacaacagcgaacggatgaatttcccgcttccgtacctgctggatgacggcatcggagcgtccacgaataatctcaacgttctgcagttgcatcaggtcaacacattcatgcaaccattcgattcgccgctccatcggctcaatcagcgtgaagtcatgatccggcaaacacgcggcagccaccaatccaggaaaaccaccaccactgccgacgtcggcaactgttttgaagcgaataccattcgtcgcattccgaacgtacggcacaatcgcagcggaattcagaatatgccgttcccaaatgatatcgacgtcacgggggccgatcaatccacgaggttcaccctcttcggcaatcttggcatggaaacgctccaacttcggcaacgcatcacccaagacctcagcaagtacaggtgacccctgcagctgatccgtcatagccatctccctcaccatgtttcacgtgaaacaatcaacatggagaatggcgccgctcattacgacgccattctccatgcggtcactttagtttgttcaaagacgacatccgtcgaacgtccctgtcatctcaaaaaaactcgccgagcaattactcctgatcaagctcgtcgtcttcggcggtatcctcgactctattcttgagatacaccgtcacgtaacgatgaggctcctcaccgtgcgagcgagacttcagcccctcttcccgaaccacatcgtgaacgactttacgttcgaaggaattcatcggcttcaagtcatacggctcgccggaatccttcactgcgtcaatggcatccaaggcgatatcacggaggtgctgacgcttgcgcttcaggaaaccgtcgacatccacaatcagatgagaacgctcgccggtcttctgctgtacagccagacgagtcaattgctgcagagcatcaacgacttcaccattacggccaataagatgtttgatgtcagtatcgtcatcagcaacgatttgcacggtggggcggtcattacgcacgcccatctcaatgtcgccctcatagtcggcgatatccagtaggccttcaaggtaatccgcggcgatgtcagcctcttcgttgagctggtcgatcgacttcacgtcatcctgtgccatacgctactccttcatgtcgtgtttgaattccaagtctaagccctgctcccccgaacagagaaagtaatgtcggtgcgtgttgaatgtttcacgtgaaacatcgaactcgcaccgacatagtcgtcacttctttttgcgcttacgcacgggctgttgacgctgatagccctgagtggccttacgctcggcctcttccttggccttggccaatgcttcttcttccagagagggcaggccggcctttgcgcggcgagcattctcattacgatgatcgcgcttctccttgtccgccgcagccggagagccaggggtcgggaatgcgtacacctgccacaatgtgcggcagaggttgcacacgttgttggtcagccagtagaccagcacggcgaacggcatggcgacaccggagaagatgtacatcaccgggaagagccacagcatagccttctgcatggtctcggtctgcttgttcatcgaagcagctgccatgttgcgcttcatgctgaagtactgcataaaccacaggcagaaacacatcaggaacacgaagataccgatgaccgccttgccactagcggcagcactggtgaagttatcggtcacgctgacaatgccgaacacatcggtttgggtgaattgcttggcggttgctacgtcgaacgcgcccaacgcatcgcgtttaccgttggcaatgtatggaatggccgacagcgtatagaacatggacatgaacaccgggccctgaatgagcataggcaagcaggagccagccggattgacgtcattgtcttgatacagtttcatggtttcacggctcatggcctccctggaagcctgatccgtcttgcctttgtacttgttctgaatacgctgcatcttcggcgccaatgcctgcatcttgcgcatcgacttcatctgcttgtagaacagcgggaagatacaagcctgcaccaccagcaccaggatgataatggcaagcacccatgagacaccaatcgggctcacgcccagcatcacgaagaagtcatgcacgatcttcatgatccaggtctgcaaccactcaacgggagtcaggattttatatagaaatccccaaaacccgctatcaagcagaaattcatttgagttcatcgttgggcctctctttgggttgtggccaatggtgtcagtcgaggctcttcatgagccttcgaccacgaaaacctgtaaaaaacggaataccgttgtggaacatcgtcgattcccccacgactccacggccggcaacgcagtaatctcagcacggcgagcactccccctttgaacgcgccataccgttccaatgcctcaatggcataattcgagcacgttggataatacttgcaacaaggcggtgtgtttgccgagatgtgctgttgataccagcgcaccccaccaatcatcaccgccttgaaagaagctgtcatgcctcagccaccttatgcgccaccgtggcaaaagccttcgcgatctgctgatctagcgaagcgaacgatgcggtcgctgcactgggcttggcgcgcaaaacgatatcgcaatgcgcgggcagcagatcctcatgggctctggccaatacacgaaacctacgcttcaccgtattacgggtgaccgcatgtcctaccgatttggagacagctaatcccaaacggcgatgcaccgtccggtcgtcatcatcatgatggtcgtcgggcaccaaatagtgcacgacgatatccttgccacctgctttgcgccggcgtttcagcacggtgacgaaatcacgatggctttgaagcctctccacctcgactatgcctgtggcactgatcggaatgatcaggcggagagggtcttgcggcccttggcacggcgacggttgatcaccgcacggccagaacgggtgcgcatgcgcaggcggaagccgtgcttcatgtggcgacgacggttgttcggctggaacgtcctcttcataatccattgctcctaggtctattcggcaacgcttcgcgctgccctcacgtgagtcaagctataccaaagtactctcacccctaccctcaagtcaaaacggacggagtattttcacatttcgacacgttgcgagacacgccccaaatctcttataatcggcggaataccaaccattcacggccaaaagttatccacaaattacatgtttgttattcacaatccagttatttcaacacgcgacacggtggataacttgtctaaaccagagtaaatattatctgttgtacgtatttcgccacagcgacagaaggggccaccatggttaacgcttccggcgaccccgtaatcgaggccgcccacatctggtcagacacgctgacggtgctcaaacacagcgcttcgctcagcccacgagaaaaaggctggttggaaggcgttgttcctgaaggcgtcttcggttcgaccatcgtgctgtgtgtggacaacaacgacacgcttcaagccattcagggtgatttgaacgattccctgcttcaggcattgcgtacggtaaccggcgaaaatatgtttcccgcgttcaaggtcgtgccgaaaaccgagcccgaaccgctttcggaggcaaagccggcgcagccatatccttcggaaatttctccgactgtcgccgaattcggtaaagaatcctatggtgcaaagccggcagccgcaccgcgggaaccgatgcccgccaccgagccgcagttcccggtcggtcagcagaagatgaatcgcgatcccgagactcatctcaataagaacttcacgtttgattccttcgtgcccggcgattccaaccgttttgcccgtacggtcgcactggccgtggccgaaggttccgggcaggatttcaacccgttgtgtatctatggcggatcgggcctgggcaaaacccacttgctgaacgccatcggcaactatgcactggtcaaggatcccgggctgaaggttcgatacgtcacgtctgaggaattcacgaacgaattcattgacgcgctgcaaaacccgaaccaaagccaggggcagattgctgaattcaaccgtcgataccgacaggttgatgtgttgcttattgacgatatccagttcctcggcggcaaggaagccaccttggatcagttcttccatacgttcaatgcactgcatcaggcaaataagcgtattgtcattgcttccgatgtagcgcccaagaatttgaagggtttcgaggctcgactcatctcgcgcttcgaatccggcctgaccgtagacgtcaagccgccggatctggagacccgaatcgccattcttcgcatgatcgcctcgatgaacggctcgaaaatccccagcgatgtgttggacctcatcgccgaacgcttcaccgagaacattcgtgaactcgaaggcgcgctaacccgtgttacggccgtggcctcgctgagtaatcagccggtgacccgcgccttggccgagcagacgttgcaggacttcttcaccaccgatgtggaaatcaagcccacggacatcatcagtcaggtggcgaagtacttccacctgacgtttgaggatcttgtcggtaaatcacgaaccaaaaacgtggctgttcctcgtcagatcgccatgtatctggctcgcgaaatgaccagtatgagcctgatggatattggccaggtctttggcggacgcgatcacaccacagtaatgcatgcctgcactcgaatcagtgaccgaatgcagcaaaaacaggagatctataactacgttatggagctcacggttcgcctcaagcaaagcaacaccaactgacacaacgcttctgagagacgaaaaacggcactttttggactgactttccgaaaagtgccgtttttggttgctcaggcggattctggtggatacgtcgaggcaacggattcgagacattagattcctcatggctcccctttgtgaggggatctgtcggcgcagacgactgaggggagtttcgaaggggaacacgcaaaaaaaccatgaaacgagagaatcgattctgaggaccgattttgcgggtttgggcgagcgagacggaaaaagtgccgaaaacggtctccagaatcgattctcctcgacgaaaaacagtcttcaacacgccgtgcgaaagtgcgaaaaccaaaaaagttatccacatagttgtgcacagatgtgggtaaactcggcggataactcgtggattacccactgttttgttgtggaaaactcgtgcataaccgcgacctcgatgtggaaaactcaaattcgacgaactggctgtggaaaactcgcccacttatccacaagccatgcagaatttgtccacaattttcagggacttatgaaccgttgcagttgtagggctcagccctacttatccacactatccaccggccttattatggcgattacttactcagttacgtgaaaagcatcatcgccatagtaacagccggtcatctagcgtacgtaagttcgccacctaacggctagaatatttctcagccaatccgacgaagggaacaatcacacatgaaagtcgaaatcgatactgcagccctggccgacgccgtagcctggacctcccgagtcatcgacgcacgtccctccaacccgattctcgctggtgtcaagctggaagccattgacggaacgctgcaattctccgccttcaactacgagatttccgctcgccaccacatcgaagccggcgttgacgaagccggttccgtactggttcagggcaagctgctggccgatatcaccaaatcgctgcgttcggagaaaacgtacctggtcaccgacggctccacgctgaccatcacgtccggcaagtcgaagttcaccttgcagctcatgcccgacaccgagtacccggatctgcccgtggtaccggccatgctcggccaagtcgatgccccgactttcgttcaggccgtgaaccaggcgtgcgttgccgtctcccgcgaagaaaaccgcccggtactgaccggcgttcgcatgcaattccaaggcgacaaggtcgtcatgacctccaccgatcgcttccgtttggcccgcgccaccttcacttggactccgcagaacccggacgtcgacaccaccacgctggttcgcggctccctgctcaaggatgtggcccgtgctcttgacgagcaccagaacatccgccttgatttcgatgccgatagcccgacgctgctcggcttcgaaaacgccggccgcgtctccacctcccagctcatcgacggtgaattcccggcggtcgaccgcctgttcgccgacgaatatccgattcaggccgtagtcaacaagcaggatttgctcgacgccatcagccgtgtggctttggtcgccgaacgcaatgctccgattcgcatgaccttcaccggtcaggaagtggcgctgtccgccggatcggtcgacgaggctcaggccaacgaaacactggacatcgacatggatggcgacgacatcaccgtggcattcaacccgtcctacctgaaggagggtctgtccgccgtaaccgaaccattcgtgcgcatcaaaatgacgaccccggtcaagccggtcgagttcaatggccagcaggaagctgattccgacgagtccatggactaccgatacctgctcgtgccgatgcgctttaacaactgaaatccctgaatttccaacgattcgctaatgcacatctcccgtctcgcactcgaccactaccgctcatggagtcaggtagtggtcgatttcgtaccaggcgtgaatatcctgttcggcaagaacggtctgggcaaaaccaatctggtggaagccgtcgaagtgctgtccaccggatcgagtcatcgcacgtccagcacgttgccgctgatcgaacgcgggcagaccacggccaccatccgcgcgaacgtcgctgatgatgccggtcaaaccactacgtatgaagcgtcgattcatgcgcgtggtgccaaccgagcccgcatcaactcggggtcgtcgctgtatctgcgcgatatcatcggcaagattcccagcgtttccttcactcccgaagatcagcgattggtgtccggcgatccgggagcacgccgcgtcatgatgaatcaggctgcggctctgctcgagcccggatacatgcagacgttgcaacagttcacgcgcatcgccaaacagcgtgccacattgttgaagcaattgaatgccaataccaacaatggacagccgatggatgcggttctgagcggtttggaaatctggaccggccagttcatcgaagccggtgtggcgttgacccgtatgcgcgctcatgtgatcggtctgcttgccgagccatttgccgcgatttacgccgacttggccggtgccggcgagcaggtgacgctcacttatgcgccttcattcgacgaagtgctgatgttcgacgatccgcatccgcagattagcgagcatttccaacgcatctaccccggtgaagtggctcgcggcgtgaaccttatcggtccgcagcgcgatgacatgaaccttgagttgggcggtattcccgcccgcgagttcgcttcgaacggcgagatgtggacgatggcgttggccttgaaaatggcattgttcgaaatagtgcgtgaccggttgggattgcagccgattgtgattctcgatgatgtgttcgcccagcttgacgacagccggcgcacgcagattcttgatttcgccagaaaacaggatcaggtgctgattaccgtggccgctgaaggcgatgtgcccgactatgaatcggcccatcgcatcgacgtggccgcactggacgaaccagcttccgtgatattgccaactctgggcaatttgtccaattcgcgggaaaatgagagtttgggtgggtatgacgaaaaaaccgcggtggacagcgcgtccgtagaacggaaagtgtcatgaacccgccgatcgcccgccaactcaacctggacgagaccaaactgccggccgaaatattcgagcggctctcccgtcgcggggcgaccttgaaggactacagacgccgccgtgaagaggccatcgaaaacttcggcaaaccggggcgcgatccggctgaactgggcagcgtgatgaccaccatcgccggcaacggcgtctggacggcgaatatgaagcttgcgcaattgcgcaaccattgggaccaagtggtgggtcaggccatcgccagccattcggcagtcgccgatttcactgacggcgtactgaccatccgcgccgaatccacggtctgggccacgcagctgacctaccttatcccccaactcaccgataccatccgtcgcaatctcaaaggattgaccatcaccgagattcgcgtgaccggcccggccgccggatacacacgcaaatgggctcggcggcggtagccaagataccaaacaaattcgcagaagcctcgctatggcgctcgtcgggttagacgagtaaaatcacatgcagtatggtcaaatggccagaagagccctttacgggcctcgtaagccatatcgcctccgtgaatgaccttcatgacggaggttgaccctgtagtcacggaaggaagcctgttggcagacgaaaccagcaaagaggagcagctgaaggcggctgcggaacgcatcaacaatgcggaattgaccgaaggcgaacttgacgaatccatggcccccgagcattatgaggcctccgatctgagggtgctcgaaggactcgaggccgtgcgtatccgccccggtatgtacatcggttccaccggcccgcgcggtttgcaccacctggtctatgagatcgtcgataactcggtcgacgaggcgctggccggatacgccagccatatcgaggtcaccattctgccggacaacggcatccgcgtggtggacgatggtcgaggtatcccggtcgatgaggtgcccggcgagggcgtctccggtgtggagaccgtgatgaccaagctgcacgccggcggcaagttcggcggcggcggttatgcagtgtccggcggtctgcacggcgtgggtatctccgtggtcaacgcactctccacccgcgtggacatcgaagtgcgccgtcagggcttccactggacccagatgtacatcgaccagcaccccaccgcgcccttgaagcagggcgagccgatgaccgaaggcgagtccaccggtacgtctgtgactttctgggccgacccgaagatcttcgagaccaccatctacgacttcgagacgctgcgttcccgtttccagcagatggccttcctgaacaagggcctcaagatcagcctgaccgacgagcgtgagaacgaccaggccggcgacgaggtggccggcgacgccgcggacgagcccggcgcaaagcaccagaccgtcacctaccagtacctcaacggcatcaaggactatgtcgactacctggtcaaggtgcgcaaggccacgccggtggaagaggacgtcatcagcttcgaggccgaagacctgaagctcggcatctccgccgaactcgccatgcagtggaccactgcctactctgaggccgtgcacaccttcgcgaacacgatttccaccaccgagggcggcactcacgaggagggcttccgcgccgcgctgacctcgctggtcaaccgttacgcgcgtgacaagggcatcctcaaggacaaggacgagaacctctccggcgacgacgtgcgtgaaggcctgaccgccgtgatctccgtcaagctcaccaacccgcagttcgaaggccagaccaagaccaagctcggcaactccgaggccaagaccttcgtgcagcgcgtgatgaccgacaagctcggcgactggttcgatgcccacccggccgaggccaagaacatcatccagaaggccatcgaggcatcccgcgcccgtctggccgccaagaaggcccgcgagaacacccgccgcaagtccatcttcgagtccgccggcatgcccgacaagctcaaggactgccagtcctccaacccggaagagtgcgagctgttcatcgtggagggcgattccgcaggcggctccgccatccagggccgcaacccgatcacgcaggccatcctgccgctgcgaggcaagatcctcaacaccgagcgcgccagcctggaccgcatgatgaagtccgacaccatcgaatcgctgatcaccgcggtcggcggcggctacggcgaggacttcgacatctccaaggtccgctaccacaaggtcatcatcatggccgatgccgatgtggatggtgcgcatatcgccaccctgaacctgacgctgttcttccgctacatgcgcccgatgatcaccgccggctacgtgtacgtggccatgccgccgctgtaccgcctgaagtggaccaagggcccgcacgacttcgtgtacaccgacgccgagcgcgaccgcgtgctcgccgaaggcaaggccaacggacgccagctgcccaagggcgaaggcatccagcgctacaagggtctgggcgagatgagctaccaggagctatgggagaccaccatggaccccgagcaccgcattctgaagcaggtgcacatcgaggacgccgccgcggccgacgagaccttctcgatgctgatgggcgatgaggtcgaaccccgccgcctcttcatccagcgcaacgccaagaacgtgcgttggatcgatgcgtaacggaatcctccaacctccctcgtcagagggaggtacacaacggacttagacaactaaaggaacaacagtggcagatgaaaacaacaccggcgacgagcagttcacgccggacggctcgatggagccgttgagcccgcaggaggcggacactaccgactacggcctgatggacaccggcgaacgcatccagcgcaaggacctgcagcaggagatgcgcgagtcctatctggcgtatgccctctccgtgatcgtcgagcgcgccctgccggacgtgcgcgacggtatgaagcccgtgcatcgccgcgtgatctacgcgatgtacgacggcggctaccgccccgatcgcggctacaacaagtgctcccgcgtggtcggcgacgtgatgggtaagtaccacccgcacggcgactccgccatctacgacactttggtgcgtatggcccagtcctggtcgatgcgcaacatgctcgtcgacggccagggcaacttcggctcccccggcgacgacccggccgccgccatgcgttacaccgaatgccgtatggccccgctggccatggaaatggtgcgcgacatcgacaaggacaccgtcgacttcgtgcccaactacgacggcaagacccaggagccgaccgtgctgccggcccgcttcccgaacctgctcgtcaacggctccgccggcatcgccgtcggcatggccaccaacatcccgccgcacaacatgcgcgaggtggcggacggcgtccactgggcgctcgaccacccggacgccagccgcgaggaactgctggaaaacctgatccgcatcatcaagggaccggacttccccaccggcgccaccatcctcggccacaagggcatcgaacaggcctaccgcaccggccgtggcctgatcaccatgcgtgccgtggtcaacactgaggagatcaacggccgtatgtgcctggtggtcaccgaactgccctaccaggtcaacccggaccgcctcgtcgtctccattcgtgaggccgtgcgcgacggcaagatccagggcatcgccgacatgcgcgacgagacctccggccgtaccggccagcgcctcgtgctcgtgctcaagcgcgacgccgtgccgaaggtggtcctgaacaacctgtacaagcactcccagctgcagcagaccttcggcgccaacatgctggcgctggtcgacggcgtgccgcgcacgctgagcctggacgccttcatccgccattgggtgaaccaccagctcgacgtgatcgcccgccgcaccgcgtacctgaagcgcgaggccgaagagcgcgaccacatcctgcagggctatctgaaggccctcgacatgctggacgaggtcatcgccctcatccgtgcctccgaagacaccgataccgcacgtacgggccttatggggctgctggacatcgaccaggtgcaggcggacgccatcctggccatgcagctgcgcacgctgacccgcatgaaccgcgacaagatcgtggccgagcatgaggaattgcagcgcaagatcgccgactacatcgacatcctcgccaagccggaacgccagcgcaagatcatcggcgacgagctcgacgagatcgtcgccaagtacggcgacgaccgccgcaccaagatcctgccgttctccggcgagatgaacgtcgaagacctgatcgccgaagagaacgtggtggtcaccgtgacccactccggcttcattaagcgcaccaaggccgacgaataccgctcccagcaccgcggcggcaagggcatcaagggcaccaagctgcgcgaggacgacgtggtggatcacttcttcctgacctccacgcacaactggctgctgttcttcacgaacaagggccgcgtgtaccgcatcaaggcctacgagctgcccgagggctcgcgcgactccaagggccagcacgtggccaacctgctgcagttcgcgcctgatgagtccatccagaccgtgctgtccatcccgaactacgaggtggccaagtatctggtgctcgccacccgttccggcaaggtcaagaagaccccgctggccgagtacgattccccgcgccagggcggcctgatcgccgtgcgcctcatggccgacgagaacggcgagaacgccgacgagctcatcggcgccgcgctgtgcaacgccgaggacgacatcatcctggtctccaaactcggcatgagcctcaagttccaggccgacgacgagcagctgcgcccgatgggccgccagaccgccggcgtgcagggcatgaagttccgtaacgacgacagcctgctggccatggatgtggtccctggcgactccgacaaggacctgttcgtggtcaccaacgagggcttcgccaagcgcaccgccatcagcgaataccgtctgcagggccgcaatggcctgggtatcaaggccgtgcaactggtcgagggccgtggtgctctggtcggcgcgctcgtggtgtccgaagacgatcaggttatggccatcatgaagtccggcaaggtgattcgctccaacgtggacgaagtcaagcgcaccgggcgcaacacccagggcgtgacctttgccaagcccgacaagggcgacacgattctctccatcgcccgtaacgaggagaaggacgagcccgaggatggcggcgatgccgcggcgaacggcactgccgagaccgcacaatccggcgagaatgtgaacaacgcggacgaggcgtgagcagcgtcctgaaaagctggtagcctcgcatacagcagaggctaccgccaagcctgttaaggagaaacgatgagcgagaatctcgaagacaacgagccccggatcataccgccggcagtcggcaatacgcagaacgagcatgtcgagccgctgatcggtactgagcacgctccccgcgtggcacgctccgtgtccagcgatccggaagaatccgcgttgccttcttcaggtgccgccactcccgtgcgtccggcacctcgccgtagcgcccccagggctcgccgcatgagcttgtcgctgacccgcgtggatgcttggtccgtggccaaggtgacgttcatgctgtccatcgccgtggcgattattcaggtcgttgcctccgcgatcgtatgggtgctgcttgatgtggtcggtgtattcagccagattacgcagattgtgtcttccaccggtcttgatgcaggcggtttcgatctcaagaacgtgttgtcccttaccaccgtggtctccggcgtcaccatcttctcgattgtcgaagtggtgatcttcactctgctggccaccattgcggcactgatctacaacgtggtcagctctctggtcggcggtgtgcacgttacgctcggcgacgactgatatagctatactgacggaactctcctcagtgaaccgcaccccggttgttggactgaagtaattcagattcgatgatcggaggtgcggtttcttatgtgtggggatcgcaggcgtcgttgctgggccgagacttgggactccggcgacgctgggggtggcaggcgtcggtgttgggacagattttgtatctctgacgacgctgtggagggcttaccgtcgtcagcggtacagatcttggagttctgccgacgctgagggtgcgttctgtgtcgtatgcgtccaattcttggccctctgccgacgctgggcacagcaagcgtcgttgctgggccaagttttggactgccgccgacgcagagaatgcacacagtggtgttggtctgccagcgtgtggcagcttggcgccgctgggggggagtcatgagtcccattccaactcccccttattgaccacttaggggtgcatcccaacacatggggtgcacccccttttttcttgttgtgctacggggttccagtcgcatttttttcggtgatattttgaacgcgaagacaggctgggaaatgcccgatagtcgtgttcccctcagcaggtgaagccctgctttcaggctgcaaaaccgactcgggtgttccgaaagcggctttcgttgttgtacatcgatacataagagagaacacccatgaaaaacaccattattcgtgctgccggtgtgctgttggctgcaagcatgatatttggcggtgcggcagccactgcatcggccgcggaagcaacgtcgccgagcaccggcaccaccagcagcacgcaagccgcggaatccatcaatcgcgaatgggtgctgaatcctgcgaacaacactgagctggcggctctcggcactatacaaggcggatcccagacgttcgacgggctgaccatcgatgccactgcaaacggtgccaagtttgcgccgcgcgccaatgacacccagatcaacgccggaaccatcatcagcatcccggtgccagcccacaccaatacagccaccatcacccttgcgttgtccggcggcaccaccactattaccgcggatgccggtgaagtgagcagcgacaacacagttatcgccttgcctgctgcggagtcggctcgtacggtaaacgtcaccttcactgcccagacctatctcaacggcatcgcccttgccgaacagcagccggaacccgagttccccggtacgcccacggtcgcggccaaagacacgaactgggacttcacggaaaccggcatcgatcgaccggccgtgcagggcctaccgacaactaccaaggcgtcgccatcgacgctcgggcgcaaggcgccaagttcaacccgcgtactaccgcggcaagcggcggcagcgatactcaggtgaacgctggaaccatcctgtacattccggtcgcacaggccgagggcggcgctacagtcaccgtgaagggccagctgtacggtcctacgctcaagctcgacggtacggacatcaccaccggcactgctgtaaccatcgcaaccgacagcacgcgctacgtgccgctctccgttgaaggcacgggcagcctgtacctgaccggcatcgccatcgactacgcggccggctcccccgccgccaccagccacacggtcaccgtgggcccgaacggccagtaccggaccattcaagccgctctggatgctaacgactcttccgaaaccgaccgactagtgctgaagatcactccgggcgactatcgcgagaagatcaccgtgaccaagccgggcgtcaccttcgccaacgccgacgtgaccgccaagcgcgcggtgacgattcgcgccagctactattcgtccaacacattcgatgccgacggcaagtttgtgccgcaggatgaattcgaccttggcaccaacaagtgcgccaccgtgaccattggcgcgggtgccacaggtttctccgcctacggcatcaccttccagaacgattacaacgtggtggatcacacggcggcgggcgagcagacgccggccgtggcgctgaacacccaggcagacaaggtgtacctgaagaacagccgcatcatcggccgtcaggacactctgtacgtgcagggcgccggcaaccgcgtgtacgtggacggcggctacatcgaaggcacggttgatttcgtgttcggcgacgccaacgcctacttcgccggcaccgagctgcacatggccgcgttcgccggcaagaacaacggctacttcaccgccgccaacaccaagaagtccggcgtgggcctggtgtttgaccgctgcaacttgaccgttgccgcagcatatgacgacgatgccaagctttcgctgggccgcccgtggcagacgttcgcgcagtacacgcaggtgcgtaagggcgacggcagcagctatgtgaccggcgtggatttgggtacgaagaactcggcgtatacggacacttcctcggccgtgacctacctcgacagcacgatgtccagcaagatcaccaagaatcgttggaatgtgtggaccagcaagaaccagagcggcaaaagcgtggacgtgaccttccacgatgatgtgcgattcgcggaatacgccagccacgatgaaaccggcgcgctgcttgatccggctgattataagaacgtcgtgctcggctcgatgtctgctttggatgaggctcaggtgcaggcgaagcgtgctgaattgctcgcggcactgggcttcggctcggcggctggttagtgggttgtgccggatggcgcgtggccattcgcttacgacccgaactactcgaccggcactgatgtgcagccgactcagccgggcggcaacgcctcgcctaacgcggattcggcggccaaggccgacaccatgccggaaaccggctcggccatcattgcggtggttgtagtcgccgtgccgctgctcgttgctggcttggcgctggtagcagtgcgccgcaatcgccagcagtgattgaaagcgttgctgcgaaccggacctggtgaccttgtagacgggggggctatctccgttgaaagaggtacattgatggctttgcagaaagccaactgctttcaaaggggtacctgaaccacgaaacctcgagtataagcgttgcaatgacggcgtttatactcggggtttcccatattcagtacccctctgaatgcagttagcttggatcgatgatcatatccaagaattcactcgtatagtggtgcgtaatgcttacgtatttgggatagcacttgttgctcgttgtacatatagcaatgcccttgcctcctcacggggaagcaagggcattacgctactgcttagtactgcttagtattgctcagcactgctcagcgattgctcagcggcaagcgtcacagcacgccctgggcaaccatggcgttggcgaccttgacgaagcctgcggcgttggcaccgagcatcaggtcaccctcgtgaccgtattccttggcggcggccagggagttggcgacgatttcttccatgatggacttgagcttggcgtcgacctcttcgaaggtccaagacaggcggtagctgttctggctcatctccaggccggagacggccacgccaccggcgttggcagccttggccgggccgtacagcacgccgttcttctggtagacctcgatggcctccggggtggacggcatgttcgcaccctcgacgaccacggtcacgccgttgtccacgagcttctgtgcggattcgccatcaacctcgttctgggtggcgcacggcagagcgatgtcgcccttgacggtccacacgcccttgctgccctcgtggtactcggagcccggaacgcgctcggcgtattccttgatgcggccgcgctcgacttccttgatctgcttgacgacctcgacgttgatgccgttcgggtcgtagatgtagccgttggagtcggagacggtgacgaccttggcgcccaactgctcagccttctgagcggcgtaggtggccacgttgccggagccggagatcacgacggtcttgccctcgaaggagtcgttgcgcagcacgcgcagggcttcctgggtgtagtagcacacgccgtaaccggtggcctcggtgcgggccagggaaccgccgaattccagacccttaccggtcaggacgccggagtactcgtcgcggatgcgcttgtactggccgaacaggtagccgatctcacgaccaccgacgttgatgtcgccggcgggaacgtcggtgaactggccgatgtggcggctcagctcagtcatgaaggcctggcagaagcgcatgacctcagcgtcggacttgcccttcgggttgaagtcggaaccgcccttgccgccgcccatcggcagcgtggtcagggagttcttgagaatctgctcgaagccaaggaacttgacgacggactcggtcacggtcgggtggaagcgtagtccgcccttgtacgggccaatggcggagttgaactggatacggtagccgcggttcacctgaaccttgccctcgtcgtcaacccaggccacgcggaacttgatggtgcgctccggctcgacgatgcgctccagtacaccggccttctcgtactccgggtgcttctcgacaaccggctgcagggtctcgaagacctcgcgaacggcttgcaggaactccggctgatcgccgtcacgggcaacgacctggtcgtagacacgcttgatgtactcgtcagtgagcatgattctcctcgatttgctagggaattaagacggttttattctatgcgcgcaggcccttgctgcatagagtctcgctcggataacgggaaagctatcggcgtggttatggggtggttcaagtttccgtttgttagatttttcggcgattgctggatgtctgtctgtgcgtgaatcgggtcgaaatggaagctgcatcacaccgaaggtgcgttcatatagtggacataaaggtggacttgggtgatgtcggatgtgcccgttgggaatcgtgcaccgtaggggccgaggtcttcggcgcgcaggttaccgggttcgcggtcagtgcgcgaagtaggtctgcagaatcatcgtggtctcggtgcttaccggcaccgtgcggtggatgagattgagcaattcctcaagggcggtgggggaggccacgcgtaccaccagtacgaagctgggggcgccggccaccgaatagcaggagacgatgccgtcgatattgttcagcttgtccggaatcgaggattcggctgagtagtcgagcggggtcacgttgacgaacgcgctgatgggcaagccgcgctgctcttggtcgatgatggccttgtatcccttgatgatgccgcgcttctccagcttctgcacgcgcgactgggcggcggagacggacagtccggtcgcctgggccagttgcgcgagcgtggcgcggccgtcggcctccagcatggtgaggatgcgctggtcggtctcgtcaatcgcggtcatggtgtcttctccgttcgttgtgctctgtgttcactgtacctgttgccggaatgcgatggctttccgattttgcctggtaatttcagtagttcttcctgtgttttctgttgtgtggtggaatgtttatgcctaaagtcctaattgaatgtaataattccttctgaaataagagaacgacgaaataattccattgaggagggatgatatgcagaagttttccaacatgcctctgtccgaagttgcatctgctgctgtgcctgctgtcagacgggttgctgtgccgaccgccaagcccgcgagcttgtccgccgaagccctgaatatcccgcgctccggcatccgagacgtattcgaccgtgtagagcgcgtgcctgacgcgatttcactgaccgtgggggagcccagcgccacggccgcgccgcatatcgtggcggccgcttgcgaggccgcacaggctggccgcactcggtacaccaacgtgctcggcgtccccgaataccgcaaggccgtggccgattactccgcccgtgtgaagggactcacttatgatcccgaaaccgagattcaagccgttgacggtgccacgattggcctgtttctggcgctgaaagccgtggtaggcaccggcgatgaagtgattattccctcgccgttcttcacttcctatgacgccgaagtgatgctgtgcggcggccgcccggtcaccgtggcgctgcgtccggagcacggcatgcgcgtgaacgcggcggacatcgaagcggcgatcaccccgcgcacccgcgccgtaatcatcaactcacccggcaatccgaccggcgcggtaacttctgccgctgaactggcgcgtattgccgaagtatgcaagcagcacaatatttgggccatctccgacgaggtttaccatccgttcgtgtttggggaaacgttcggggaaacgcttgggggagaggcagccgtggcaccatcgattgccgcggtgccgggcatgaaagaccgcaccattgtggtggaaagcctgtcgaaaacctacgcgatgaccggctggcgcatcggctacctgctggcacccgaagcggtcatcgaacagaccggtaaaatcgccgaactcatgcactcctcggtgaactccttggcgcaatacgcaggcgtggcagcactggccggtccgcaggatcatgtggccgccatgcgcgaggaataccgcgccaagcgccagatcgtgctggacggtctggccggatgcccggtattgcgcttgattgaaccgcaaggtgcgttctacgcctttgtggacgtacgcctgactggccttgactccggtgaattcgcagaccgtctgctggacgaagagcacgtggccgtggtccccggcgaggccttcggcgaggaggggcgcggcttcgtgcgcctctcctacgccggagatgccggcgagctgcgtgagggcgtcgcccgtctgcgcgcattcgccgaacgggtatggaaccccatcaccggacaccacaccgccacttatcaccccatggaggtgttggcctgaggcttaaagcgaggctaggccgccaattcagactcgtcggcgcgagcgatggcctgctcgtaatccttggtgcctttgaacacttccttggtccacgggttgatgccctgcttcttggcgcgtagcaggatgtagccaagtgccagcacattggccgccaacgcgattaacgagactgcaaggttcacattcggattgttcacggactgggtggagaacatggaatagtcctggaacatcgggaacacctgcgcgaacatgcaccagatggccagcgtgttggcgcggttctgaatccaaccgcccttgttccagaagaagttggccacggtgggtgccagcagcagcgccaggccgcaataccaggcgtgggtgggcaggcagttgtaggtgtagcagaagttccacaggtcgtaggccacgatgaacacccaggtcatgtccggccagagcatgtcgtccttcttcttggaggcgtagatgccgaaccagccggtcatgcagaagatgttgagcaggccggccacgccgttgaagacgttgtgccagccaccgtacagggtcacgccttcggtggagatccacgtggtgccccagccgcggatggcggattcgaagtcggacactacggcaatgaggatgttgatggccacgatcacgaacgggaagcacttgaaccagtgcgatttgccgatggatccccacttgtatttgagggccatgaaaccgatgcagccgatggtggccgcgtacagcttggcatagtggaaccagctggtcatgtgtacgtaggtcgggttgttgagggcccagtcggcacccatggcggcggccgtgtagatggtgatgaagtagacggtcagcacggccggtatgacgaggaaggcgataacgccaccggttttggtgcggcgggccagttcgttggcgccgataagacagcagaagacgagtatccatccgatccattggtagatggcgttgtcgccgtagacctgaaacagcataagcggtcctttccgtgtgtgcgctgtgcgcctcgcagtcctccattgggttgctgagacgcctatagacgccgctatgttgacgcagcgtcaatttctctcacggcacagtctagcctcaagttgacatcgcgtcaaaacaaccgcattaaggctgccgcgtttcgtatcgttacgcgtaggggctggctgaggcgtaatgctgaagagtaacattgaagcaatggcaatcaagccgatttgaggaagagaagcacacgatggcgtactgcggccactgcggaaatagagttgataggccggcacgattttgcccggcatgtggagcgtctgtagacagcgcaccggttgcgtctgtaccagtgccggccgcatcgtcagccgtaccgactgcgtcgataccggcacctgctgtgccagcgccttcagtaccaccatcgataccagccgcgccggttgccccatcggtttacgccgcgcccgctgccccacagccggcaccaactgctcccttgccagctttgccgattcccgctcctgccgcatatcaggcgactgatgcaaccgccgtcctggcaccgccgcgcaaatccagcaagaagctgatcgccgttctctgcgcattgcttgcgacgattctggtggcggccttggcattcatcgtccccaacttcaccgccgtcaaagcgatgctgggcttccagcccaccaatccgctggtcgtcaccttcgacgcgatcaactcgctgtccactctgcgcagcaccaaatacgaactcagaacccacagcagcactgacgactcccttgacgcgcggatgtctggcatgtattcgctggggcaaaaccaccaatgactcctccgcgtctgtgaccatcaagacagatgaacaggcaacaaccctcgcttggcacaaaggcgcattcgccgggaaaaacgtttggtatgatgacgacccctactacatctactacccggccgaccaatatgaagatgacttaaggaacggcgttggtagtgatgtggcggacttgatattgaacgtcaaggatgcgttggtcaagaacggtgcttgggacatcaccggcgcggagcgaacgttctacgatcagctggacaagatgaacgacgatgggtactcgaacgacatcgaccgggccaagggcacgaaaacgtctgccgaggtgaaggccgaggccagcaaattcatccaacaatatctcggcgtggagctggaagataagaatgtgcgcagccagctgttcccgaatacatcgtctgccaagtctgccggcaacacgcagctctcgtatcaaatcgatgtcaaggcattggcccagcactttgtgaattactggatcagccatgaagcgcagtatccgcatctgaaatcatgggtgattcagcagatcgaggataccggtgtgggcgatgctgaaggcgagtaccgtcaggcgctcgacaatgtgcgcaactgggacttcggcacggatgaagagccggatatgccgactatcaccgtggatctgaactacggcaggaagcatctgatgagctcgattgccgtaagcgtgtccggcaaggacgaatacggcgactcctacaaaggttcgctgtcgttgacgctcagccagcagaacgcggtgtctgtggacgaccccgatttgactgatacggtgagcaaagccaaggacaacaacgagctggatctgtcttgagcagaatcagaatgtgcggaacgccgtgaacagatcatcgacgtgacgtcgcatgtgattcacagaacgggttttggggcttttccgttcgtcaggtagccgaagcatgcggattgaccgagccggcggtcatataccatttcaagaacaaagtcggcttgctgattgccgtgctggagcatcgtgatcgggaagatatggctacgtttgcccattctcttggcgttgaacctgaggatatgtggagcggcaacgcgcagttcggcattcgtgatatctgtgctgcccttatggagcgcaatgcggctcagccagagatggtgcggttgtatataccgtgctacaaggcgaatcgttgaacgagcatcatcctgcctatgagtattaccaaaaacgagaacatcgcgtgatggacaccttaacccgagcagtcgagcgtgacggtttggcagatcctcgtcgcgaggcgcggactgctttgtcgatgatgaacggcattcgggtccgtttggctcagggatcgggcatcggtcgatttagtggccgattggaatgcctatgccgacttccggtggcctcgacagtcgtgaggcaataagacttttctcgtgagatacgctatcggcgtgtcgtcatctttttgttgcaatacgcagaaaatgcaagaacaaaaacccttggaatcggactgattccaagggttttgttgtgtctgtggagctagccgggttcgaaccggcgaccctctgcttgcaaagcagatgcgctaccagctgcgctatagccccgtgagaaaaaaagagcggctcgcggccgcttcatttttcctgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgcgattgtcgcttgcgccatgattgccggcgcagcggagcatgacgagtgcgatgaggctgttcgcgtggtggaagccgtaggccatgcggatggtgaccttgatcctgttgtcggacgcctcgagcctggcgttggagtagcccagctcgatggtcctgaggatgtcgggccacgacggcggatcttccgggatggcttgccgctctcgtacaactgcacgatctgccgtttgaacgcctcgtcgtagtggcggggatgtttcgggtcggccatcgtcggcctccaatctcatgtcattcgtccctcatcggactgtctaatacgttgtagccaatccacggcgtcacatcgtcaggctgtccgggtcgaggaggaaatcgtagacgctcatcgtgaggatgccgtgctcgtcgcggacgggtttgaccacgtcgcgtacgaggacgatcttctggaagctgtcgtcgatctcgagcagcgaggcttctcctgcgcgaccttctccggtgtgggcagttggtacgcggattggtcagggcgccgatggaggaggccagcacgtcgaccaggtcgtcgagctcctgcgacctgcgcagcccgttgcgcatgcgcagcagcccgttgatcaccccgtacagacggggcggctcctcgccgcgcgtacgaacgcagttcatgaagaattacgagtgattcgtcgaagtcttcggcgttacggccgccgcctgagccagggcggcggccacttgttcgttgacggctccctgctgtgcgatggtgacgcggatgcctcgactggcatgcgcgtccacgcccgcaccggcccccgcgtcggctccggtggcgtcggcgctgatacgcaggctcggcaggaacggcttgccggcggccacacggatgccctgttcggccagcagtcgcagcgccgccggctcgtcgcgcaccggaatccacagattcagtccgtcaccggtatgcacgtccaaactttgacgcagcagcagcgcgtgcatcgtcttttgccgggtggcgtagatatgccgggcgttggtcaccgtgtggaacgcctctttgtcggccagcatttcatacagaatctcttgcaggaaccggctcacccatcccgatcccaagcgtcgttgggcgataatcgcctccacggcatcctccggcccagacagcgcagccaagcgcagatccggcccgtgcgacttcgaaaaactgcggatatgcaccacgtgttgcggcaatcgttgcgccaacgatgtcgcatacgcattggccacatcgccactgtgatcgtcttccacaatcagcggcataccaacgccattcgggtagtgcgcgagcagcacgtccgccaaagcgtcgatgcgttgcgggctgaagctggccccggtagggttctgggcgcgcggctgcagcaggatcatactgacctgatggccgccgtgcggcaccgccagacgctgcgattccagcatggtcagcgcacggtcgagtgcgtcgggcagcataccgaacccgtccatcggcacgccgaacgccatcgcgccatgtgcctcgatcatgtcgagaatcagcggatattccggtgcctcggtaatcacaaaatcacccggctgaacaaaagcgttcatggtgtgcgccaaaccgtcgcccgcgccggatgccatagtcatcgcctccggctcatacggccagttgcgtcgcaaaatctgttccagcatgggcaggatggtcggcccgtcgtatgaattgacgaatgccttgtgcgtgccgagcttgccgagaaacgggcggatgtccggcagcagcgaaaggtccggcgtgcccttggacaggtcgataatcggtcggtccggcgcggtggccggggcttcggccagcaagtcgccggcatcgtagcgatgcgtgcgcgactgccgcagtacgaatgttccggcgcgcccgcgggagcgcagtatgccggacctggcgagggcatggtaggcactggagacggtggccggactggtgcgtagcagtcgggcgagatcgcgtacggtgggcatgcgctggccttccgcaagtatgccggaggaggtcagcgaggtgaccgattcgacgatgcgttgcggggtggccgtcgcctcggtggtgaggatgagtgaggataactggccggcatcaacggccaggtcgtcggtggaacgcaggggagcggccgtaatgcttggctcatcgttgtagccgacggcatgtgcggttgttgatgcggttgatggcgatggcgtatccatgatctgcctcccggatcttggcggcgagcgtgatgagcgcgcgtctgcgtgaatgttgccgattgccgccggctgatgatcgatggcggttgccggcttgttgctggctgcttgactgccgatagtaacggtcactgtggcaacggtagtcaaatgttagcgccgcattgtgcaatgagtatgtttttgaataacataaacattacataatctggatacaattattgttcttgttcctatgtttcaaaatgatttcgtattcgccactactgtaacattattaaatgttcgagtttgacgcgaaatgttcaactctcataatgacattcacagcgcgttgctgccctgccccgatccacgggagacggcatcgggcacttcgagaaaatatcgaggaaaggacacatcatggggcatgatctttcgcaggatgcggaaatctgggacgacgcttacaagctggaccgcgcacacgtattccattcgtggcacgcacagcgcaacctggatcccactgaagtggtaaccggtcacggcgtgtggctgaagtacggcgacggccgtgaaatgctcgacttcaccagccagcaggtcaacgtcaacatcggctaccagcacccgaaggtgatcgagggcatcaagaagcaagcggaactcctgtgcaccgtcggacctgactacgcgaacctagcccgtggccgcgccgcctccctggtggcccgccgcgctccggaaggcttcgacaaggtgttcttcaccaacgctggcgccgacgccaatgaaaacgcgatgcgcgccgcccgcctgttcactggccgcgacaagattctgtcttcctaccgctgctaccacggcaacaccggtgcggccatcagcgccaccggtgactggcgccgtaagcccaacgactactctcgcggccacgtgcacttcttcaccccgtacctgtatcgctccgagttctccgcaaccacccaggaagaggagtgcgagcgtgcgctggctcacctcgagcacgtgatccagttcgagggcccggacaccatcgccgccgtgctgctcgaatccgtgccgggcaccgcaggcatcatcattccgcccaaggactacttcaagggcgtgcgcgagatcaccaagaagtacagcatcctgatgatcaccgacgaggtcatggccggcttcggccgcaccggcttctggttcgcactcgacgactacgactacacgccggacatcatctccttcgccaagggctgcaactccggttacgtgcccgccggcggcgtgattatgagcgacccggtggcccaccgcttcgacgacatcgtcttccccggcggcctgacctactccggtcacccgctggccatgggcgccatcgtggccacccaggaagccatggaagaggagcacatcgtcgacaacgcctacaccatcggcaaggacgtgctcggcccgcagctcaccgctctgtacgacaagcacccgaagatcggcgaggttcgcggcaagggcgtgttctgggccgtggaaatggttgccgaccgcaccaccaaggagccgctggacgacgccacgatgaagcagatcgtggccgaaggcgacaagcgcggcctgattctcggcgtgcacaacaaccgcatccacgtcactcctccttgcgtcatctccgccgacgaggcgacccagggcgtcgagatcctcgaccaggtgctgaccgcggccggttgctgattgggtgactcaatggctcggtgacggtttgtagccgttgccgacagcaccgttcattgctgatggcggcccgttcggaacgttaggttccgggcgggccgccatcgttgtccgccgttgtgcgagaatgacttgcgtgccttatcgccgtcgtcaatccaccgctccgaagtccggtgcgccgaaatccgttcggtccgctgccgccgggcagtcgttggatattgatggcatccatctgcacctgacgcgcaaacccatcaaaaacctgtatctgcgcatcaaaccgccgagcggccgcgtcgaaatctccgcaccgatgcggatgagcgagagtcgcattgcggatttcgtcaaagagcgacattcgtggattctcgcccagcagcagcgcatggctgaggcgcaacggcgctccatcatggcattgaacgagggcgccggcttcgagaacggaggtcgtggtgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggatcgacgaacgcaaacgacaagcggcggccgcgatcaacgccgcgttgccacagctgctggccaagtgggggccggtcgtcggccggcagcccacgcatatcacgctacgggtcatgacctcgcgctggggatcgtgtacaccgcgaaccggccgcatccgtctgaaccttcaattgggactgatggaaccgcaattcctggaatacgtcttggtccatgagatgacgcatttgtgggaaagcggccacggtgccggattccagcgccgcatgaccgcctacctacccggctggaagacgctgcgccgcgacctcaaccgccgcgtggtgctgtgacgatgacgggtcaggcttcagtgccggcgatgtggctgatggcctgatcggattcgttcgcatggtccgaatgcgccaccatctcgatggccgccggacacccgctcaccgacgaagaccgctggccttggctcgacaccatcgccgcgtggatcgacgagcgcgtggccgccggcgagcccgccgtggtcacctgctcggcgttgaagaagatctaccgcgacaagctgcgccgtcaaggcgtggtgttcgtctacatgcagggcacattcgacgaggtgatggaacgcctttcccaccgccaaggccacttcatgaagccgagcatgctgcaatcccagtccgacattctcgaagagccgggcgatgacgaaattcacgtcaacgtacacatcggccaggccgatcccgaacacgaggccatggccgtggccggtgccctcggcctgtgagccatctctcggctccccttagtctcacttcgccacacgtgcggcgcatcgacgaactcgaacggcgcatcagcgaacttcagctggagctgaagcagtgtgaaggccagcaagggcgaaccggatcggtccaaacgggctactcaggccgaccagcccagccagtccgttcagaccgacctaactgatcagagcgggccctctgaccagtccgaaccatctgaccgacatgtacttgttgactaagtgtgcggcccgtcattcgttatggaacatgccggccatgtatacaggcaggtaggttacattcccttcgactgagacgttgcacgggccaagcacatagcctgtattgagatggtattcagggtgggcgagcacgttgtccattgcgcgatggcgtttgtaggatttgccggacttcacctcaatcggcagcacgtgatcgttgcggtcttggatgaggaaatcgagctcgccaagcttcttactgttgtagtagtacaggtcaaatccgtgagcgcgtagctcttgggccaccgcattttcatagattgaaccgtagttgatatcagggttgccgtcgagtacgtcgagcgcggttttcttgagaaacgagccggtaagcagacccacgtcgttgtaaaagagtttgaagaggttacgttccttgctcatctccaacggtgtgcacggttcgtccacgttgtacgcggcgacggctacatccgcattgaccagccaatcgaaatcggaagcaaccgattggaatctcatgttcttttcgattttggcgaaggtaaagcgcttgtttgggttatttaactcgctgggcaccaaatcgtagatagcgcggatatgcagccggtcttctttgcgcgcgtattggctgatatcgcggcgatattcacgctttatgttctcttgtatagtgcgcacgtccgcaacgctgccgtttgccacgaacgagtcgactgcggcaggcatgccgccgatgaccagatatttggagtatagctccatgagcctttgatgaatgaactcatccacttcctggtgcttggcaaagcattcggcaagcatatcgaatacgtcgttgccgatatgctgcgaccagcagaactcttggaaatccagtggatacatatccagctcggtcaggtacccgaccggtaccgagcgtatatcttcgagctcgactccaagtagcgagccggaaagcgcgtaatcgaaccgaccatcatctacaaggaacttaattgcggtgaccatttccttgcaacgctggacctcgtcaaagaaaatcagggttttgccgggtactaatggcgtatttacggccagttccagcctcatcagtaggtttttggcatcgcggggccgatcgaataatgcaacgaggtcagggttctcgatgaaattgagctcggcgatatggtcgtaatgctgttgggcaaagtgcctgatgatataggttttgccaatctgacgggctccggtgaccagcagtgcagtgcgtttcggcgcggatctccaagcttccagctgtgtctcgatttttcttcgcagcatgagaatctccagtcatttgtaggccttgcatctatgctgggcacgttttccaactgtttatagcgcatattttacacttttccaaccataagaatgcggttttggctacgttttccaacctcaaaatggggagttttatacacttttccaacttatgtatgtggagactctctatttcacgtgagacgaaagtggctcccctctttgaggggagccacggaatacggcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcgtagtactcgatcagcgccttgagatactcctcggtgcccacgcggccctcagcgtcgaacgatttccacgtgcggttgcgcacgatggcgtcagcacggccatccggggtgccgcccagagtggcaatgcgctcggcggtctcgtcggcctgggccagcacggcctcgacctcggggtcaagcatctcgtgaacggcgatgaagttcgggccggtcacgttccagtgtgcgtgcttcaggaccagagcggcctcctgctcctggctcagtcggttctgcaggatggcgatggccttctcactggccgcttcatcaaggcccggcacaacaaatgcaagtgtcataatgttccttctttcagtaggtggaacgttgccctttcattctacgttttttggttatgccccgggccgaacgaataggtggtgaatatcacgtggctagttggcatcgtcgctttgtgattcggctggcagtggcgcatggtccggggcgccggctttgcggacttcgatggtttcgatgcggcggccatccaccttggtgatgaccatgttgtagccgtcgtcggaatgcagcacgtcgcctaccgctcccatcttgccggtcttggacaggaagtagccggcgaccgtctcgtacgggccgtcctccagctcgatgccggtcagatcggcgaagtcctcaatggtcatgctggcctcgatcgtggccacgccattgacgaacgcggtgcgggtggtgcgttcgccgcccttctcgctgggcagatcgtactcatcgcgaatatcgcccacaagctcctcggtcatatcctcaagcgtcacgatgccgtccgtgccgccgtactcgtcgatgaccacggccagatggatgccgcgcttacgcagcagttccaggcttggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaagggctggtcgccctcgatgaagaccacgtcggcacgtgggcgcatcacctcggcgacgatggtttcggacgcgtcgaacacatcgtccagaatcgtgcgttcgtccttggagaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagatcacgatggaacagtaggagatgatgagggtcaggatgatgttcaccaggccgccggcgatgccggggtgcacgccccagctttcgaccgccggaatcaggtagggggcgatggaagaggcgccgaacgaggcggacaggaagccggagagcgtcacgccgatctgcacggtggacaggaaggtgttcgggtcacgtgcgattttggcgactttggcgccgcgagcatcctcctgctccatctgttcgatctgcgagccgcgcagagagaccaatgccaactcggtgccggagaacacggaaccgataacgagaaatacaaaaatcaggaggatgttcaaaccaagtgacatggcttcaactctaggggagcggcacgtcaaattggggtgtgctggctgggcagtaagaaactcggcaaagggaagggcactcttatcattaccgcggacgacgtgtcgaccggtgtttccgatgcgttgctcgccttcgacgatgccgtatgcgctccagcgctggacggcattactagtgcagagaggctgtttctcgcggctatggccaaggattcgccaaatcccacgcaggtggcgatattgcggatcgcacgctcagaagctcagcacttccactttgccggaatcgagctgatagcgggcgccgacgatcatgagcttgtcagtggcgagggcctgctggatgacaggagactgctccaccaaagtttcaataatgtgggccacatgcacgcgctcgatatcttcatgcgcgtcgagctcggcttcgcgcgcctgccagacggacataccggtctggcgcagaataatcgattcggcggcggcgatgtgctcgtcgaggtcgtccatcgcatccgcggcctccagtgagccgtcggcttcggaagtgatggtgtgcatcaggtcgtccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggtacgcgcgagtccgagcaggagagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccatttgggcacaagggttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaatgagttccacgaagtgaccaaggacgatgtgctcggccactggtccctgttcttcttctacccggccgacttcaccttcgtgtgccccaccgagcttgaagacctggccgagaactacgccaagttcaaggaaatcggttgcgagatctactccgtctcctgcgacacccacttcgtgcacaaggcctggcacgacgccaacgagaagatcgccaagatcgagtacccgatgcttgccgacccgaccgccctgctggccaaggatctcgacacctacaacgaggccgatggcatggccgagcgtggcgacttcatcgtgagccccgagggcaaggtcgtggcctacgaggtcatctcctccaacgtgggccgcaacgccgaggagctgctgcgccgcgtgcaggcctcccagttcgtccacgagcacggcgaccaggtctgccccgccaactggacccctggcgaggaaaccatcgagcccagcctcgacctcgtcggccagctgtgatcgacactgaataggcggtaatcttggccccctttctgaggggagctgtcgctgaaagcgactggggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggccggctggcctgacggccggcctgtacttggcccgcgctcgctaccgtgtgctgattcttgaaaaagatgatttcggcggccagatcaccatcaccaacgaagtcgtcaactatccgggcgtgggccgcaccacgggccgcgcgctcacccagaccatgcgtcagcaggctcaggactttggtgccgaattcctctccgccgaagccaccggtctcgacgtggatggtgacatcaaaaccgtgcacacctcacgcggcgacctcaagaccttcggcatcctcatcgccaccggcgccagcccgcgcaagctgggcttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggttgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacctcggtgccgggcgtgtacgcggccggcgatctgcgcgtcaagaacctgcgccaagtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgagctggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgcccaactgtgcgcatctgcgtgccggctgagggcgacggcaaggccggcaaggacggcaatggttcactggtcttcaccggtctggccttccacggcgtaccttccggccacgagttcaactcgttcgtgctcggcctgtacaacgcggccggtcccggccagccgctgggcgatgacctggtcgaacgcgcgaagtccatcacggacccgctgaacatcatgatcctcgtctcgctcacctgcacgatgtgcccggaaaccgtgcttgcttcccagcgcattgcctccctgagcccggccgtgcgtgccgaagcctacgacgtctcgcacttccccgaacttaaggaccagtacggcgcgatgagcgtgccctgcatcgtcatcacccacgccgacggcacccagcaagtcgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacgacgaacaggccggtgagcaccggaatcagcgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgtcgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggctgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggagacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcagggataatcgcgctggtccaacgattctcggtaaaccttgccatatatgggcggatcctttcgtaactggtgtacgatggcctgccggcccgaacgagagtcgtatcgcccatatccacgcacatcacgacggcatgcccctgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcaacgcgtgcgtgacgccgcccgcaaactcggctataaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccgtcgacaccgtgaacgcgccgagcgacgccggctcacgggcggcaatcgaacaccttatcgcgcgtggctgtgcgcgcatcggcatcgtcggcgacaatcacgatcccaacaatcccaacatcattcccggctcgcgtgatattcgtatgcgggccgccaaggagacgattctcgcggccggactgccgtttgacgagcgccgtgatttcatcaaatcctcgtggtcgattgacggcggtatcgaggccgggcgcggcttggccaagaaaggcaagtgcaagtacgacggtctgtactgcctgaacgacggtattgcgctcggtattctgcgtggtctggcggacgatggcgtaagcgtgccgggcgatgtgcgcgttatcggcttcgacggcctgagccagagcatgtacagcgtgccgactttgaccaccgtggccaccgatttcaagggcatggcggataccgcgctgaccttgcttatgcggcgtatcgagaacctggacgacgagttcttcccgcagaccgtgaatgtgggctataagctcatcgagcgcgaatccactgcggcgtagagtctttggccgtgttgagcttcaattgggtgattggactggcaccagcggctgatatcagatatgccgaaagcagcgatgatcggatttaagttgctggagatgacaggatggattgctctttacccctttcaccatcttgcaataattcttacatgtaagaactctctgttaacatgtaagaattattgcaagatggtgaaaggggatgctcatgttgccggccaaagaaagtttgacggttgagttcaagagtgagcagaagcgccctcaatcgcatgatgaaattgttgacaacgtagtggctctagccaataccgaaggcggcacactgtatctcggtattgaagacgatggcactgtgaccggcgtatgtgacgagcatcgcaatatcaatggacttgcggtactaattttcaataagactgttccgcagcttcccgctcgcgtggcgctcttgtatgagaacgaggtgccgatagtcagtattgaggtggataacagtcagcaaatcgtatctaccagtcaggggaagacattgcagcgccggctgaaagcagacggctcgcctgaggtcgttccgctgtttgtttcccaattcattagccgtttatctcagcaacggttctacgatttcagtgcgcaacctgccccagaggctcggttggacgatttgaatccagactcacggaacaagttgagaagccatattcgcagtgccaatgcgcaaaactcgttgttgtcttttactgatgaggatttcgatcgggcacttgagctggttgttgatggcccgtatggattgcagccatctgttgctggtctgctcaccattggttcggttgatgctattcatcgatcggttccagccgcatcggctgtttttcaagtgatgaaaggcatgtctccaaaggtcaatatggatccgttcgtgttgcccttggtggatatgtttgatcgtgtaggcgagctgatggagccgtggaatcccagccacgaagtcatgagcggcttgattcgggtcgatctgccagacttcgatcgaggggcattccgtgaggcaatgattaacgctttctgccatcgcgattatgcacgaatgggttcggtgaggttcctggttgatgatgatgggttgaccatagccaaccccggaggattcatagagggtgtttccgaagataacctgcttactgcacaaccgcgttcccgcaatccgcagcttgccctgattctgaaagctgccggatatgttgaacgcaccggacgaggcgtggataccatctatgccgggtcgattgcggcaggcggttctttcccggattattcacagtccagtgctgaggaagttatcttgttcttgcgccgcgtggtacctgacgaggcattcgtaaccatgattggcgacgaggaacgtcgacgtggggctccattgccggtctggtcactgattgtgctctcgctgctgcgtgagcatcgtaggcttaccgtggtccaattgtgcgatttttctcatttggagcatcgacgcatcgtgtccgctgttgagaatctggtggaagctggtttggtggagggggtcggtagcgggagctctcgttcgtatatgctgagtgcccgagtgtacaaacgttcagaggggctggcgtcttacgtgcgccagcgtgacatcgatgccacccggcgcagtggccttgttctggagttcgccgaaaaaaatgatggtgtcgtcactacggcggatgtcatggatttgtttggcctgagctatatcagtgcataccgggtgttgaagaagctagaggatgcgggcaagttgcgccgcgaggggaatggaccgtcatcccgatacgtgttggaatgattggtacgcgtgaaagtaagttctttcatcacctttcaataattctttcatgtaagaactctctgtttacatgtaagaattattgcaagatgatgcaagatgcacacaaaacggggaagctctgcttgatgtgagcggggcttccccatatgcgctggtgtgtagatcagcctgtgttctgcaggccggcagcgacgccggagacggtgcacaggatgaggtagatgaatcctgcctgttggctttgcgagagctcttccttgtccaccttcttgcgcagcgacctgagggcgagcacctgggtgacggacagcgcgtccacgtacggggagcggatgcggatggcctggccgagcacgtggcggtgctgcagcggccacttgtcgcccacgatgcgctcaagttagtccggtcaatggctttggaaaatcatggggagtgcggctgcgcgggttcgctcctcgacaaggtgacttgatttgggaccgccgttaactttcgtcagacacatcgtaaatcccgtccaagtatccgtatcgtccgttgtgcttgtccttcgagaattcgacgatattgatgttatcgtcaagaggaatgccagccatgtgattcgtgttttcgataatgatgatttgttgtgaaaccgcttgtttcgctagataggaaaacaggcccactttcatggatgagtcttccaggggtcgtattccttcgtcaaacccatgcagaggcgtatcaataagcagccaacccggagtatgctttgactgttcattgagataatcatgaaatgcgagcataacaacgctgttaagaaatgcgcagtatcccttgccttgttcatcagccttggaataccctgctatttcgacatcaaaagaagatctgctgaaatctgcagtatcagcaccttgaaaatgacattgttgcagaatgctgcgtatggtgttattcatggaataccagaaatcactctggaaacattcgcgtggcttgtatttttcatcattctgtgttgcttgaccagcgtcatcgagtgccttgttgaaacgagcatgcagcgctatgagttccgcatattccgcatgcaattgttctgcatgggcaatttgctcaatatcttgttgcatgtgctgcgctgttggttgaatgtcggatttgagcgaatgcatattttgccgatgctgctgtttctccagatgcagctcctgttgcacctcatcggctttgtcgacgaggatggctagatcggtttcaacgtctgcttggattctgtggatatgctcaatttctgttgagacgattagaatgtcctgttcagtcggcacagacatgtggatggggctgtggcaaaactgacatgtggcgggataggcatgtgtgcgggcatgtttcattgcctgtagttgcaaatcaagacgtgcagcgtctgattcgtattgactgataagtaccttacgttggcgaataagtacctcaaggtgctcatattgttgattaagctgagagatatgtgagatggtatgggcatctcgattgaggagagtttgtctttgctgttctacgtgtaatgcttttttgtgaaggtcttccaaataggtgtgaatggtcttcccctcatttgttgcgatatggcgcatctcctcaaggtgtctgatgcgaggctctatatcatccaactgctgatggatgaactgttccacggcttttctgcgggcgtgacgttcgctggcactctctgtctgtatggagttgtcgattttttcatcttgaactagcacgagcaacgaggacagactttgtgtgagagttgctagagaggtacttttggggaaaagaatggaggggcgtgcacgtcctatttggtcctcggggacaatcatgagatgtctgatggcattccatgtgaaagcaactgtatggtaggtttcgtttgtcgctattctacgggttgattcaacgcctagtaaggcaagaagaaccgtattgattgatttaccggcacgtgatgaaacggagtaggaaccggggacgatcattgggttgctggattttacatggatagtgttctgaacgtgaatcgaacgactaagcgaaacctcaccgccgttggtcacgaacgtgacctgtgcaatttcataggcagttttatcggtaaaggggagctctttccctccgcaggcaaattccacggtttttgcgattctggttttcccggtgttcgaagcgccgataatgcagttcagcccgcatgtgagattaatggcggattccactccgtcctttctgattgccgaaattcgacgtatccatgtgtttctcataactggttgttctctttcgttattcggttcatgatggtttcataatcgttttttatcaagagctgaacagcctgtcgataggaggcagcgtaatcgccgtgcaatgcttccgaatattggaaacattccggagtggcgcggtacaacaggcaagtggaatccacggttgctgctccaacgattacgagttgggctaatcctgcttgtattcgtttgcgacgagcatcatattcggctaaagcatgtggaccatcgccgtgaagattgcgctgtccgaatccgaatgttttcatataggtggcgataaggtcaatggctgtgatttcgtcaattgtggaaggtctagaaagaaggggaaggcataatgtcaatcgtgttgctgtttcctgtgttgtgttaaataatgaattattcattttcgtgtacccactccagcatatggtcgttgaccagcatatgacacagccctttcttttccgctgccttaatcattgatgggaattgggctataactgaaccggatagggggaaaccggctgcctgagatagcgttgctcgcatgcgtaacagtccatcggcgtaatcagatgcgcaggtatcgcatattccgtcataaagatcaaccttcagtgcatcaaattcttgctctccgttttctataacatcccgtagattcctgcgcattccttccgcatcgtaaaaatattcacgttgcttggcgtattcaggacgacatgtctgaggaagatcgtcggaacagttgattggcttgtgcaagtgatcggcataggcggcttgcatctgcgtgaggtatgtcttttcaagatgatcatctggtttatccggtggaattggataagccttccaggggaccgaagagcgcccaaggtgcaatttgccgttgttgatgcgaccagacgccagaggtaagttttcgaaaatatcgaatttcggctgaaagcttatgccgtcgatgagaatgtcacgtccaccggcattcgcctggagtattgacagaagccattttcctgtggcagaaggaagctcactgatatccgtaactctaatatttgccttgataagctccttttgaaaatcggcaagggcatcaatgctgatatcgcagcaaagacgttctactttcgagatatctaggcgctgataaaactcggcggctttccaggcaggaatcttcttgcgaccgttataaaaacgagtcagatcagtatcgttgattccagaccagaccccggtggtaatagtggtctttccgggtttgcggtttcgatgatgttggggaagtggatttcttagaccgtcatcctctaacacagcatcgaagaaatccttcataaatccctttttgtggtggtctacgccagatatataagggtttacgagctgacagaagactcccagagcataggtagcagtagtttcggccaagtgagtctccttctcgtctccatttgtcttcatccgtcgccttcccatgaggtcactgttcctacgatggaagccagattcagacgaataagccggtaaaacactggaatatcgccagtatacgccgcttacagctggatcagagaagcgcaactttcgtctattgaaaggatttgagaccagacacatcgtaatttcttcttcaactcgatgtcatgcgataaccggttatagaagtagggcattgggctgttcatccgttgtgccgcagtgaagctgactggggcttttaactaatcacatgcatgagatctgcctgcttattcatggtgacgcgtcggttttctcctgaactgacgcgtcatgcttatccagcaggttggatgctcatgtggtggcctatgcaagcaggtctcgaagacccaataactgggtgggatcgagactggaatgagaatttcattgaaacatgaggcaatgcgcgccggtaatgtgtccgtaactgatatatacaactgttcggaagtggaattacggacgatggttgaacgcgatagatgtttgcgcgcaatccgtatgggttgttcgccacgtgatattgcactacgtacccctcaaacgatacttcaggaattgtggaatgcggaggaacgttccgctcacgcttattatcgatcggaccgtgtcagcggagttatttgctcctatgaggatttggttggtgcagggcgggaaccccaggggtgttctgcttcttctgaggatattctcttatgcgcggaggatgcgagagaaagagctaactgtttgcaagctatctttgcggagatcgaaaaactgccagcaggtcagcgcaatatcgtcaggggtgtactggtaaagggggcatctcaatcagatatggcacgagagctgggcgtgtcccgagctgcggtgtccaaacagctttcaacggctgtgcgcaaaattcgtgccgctattcgcgacgaaagcaaagaaacgaagaacacgacaacatcatcagtttgtgaaagaaaggagcattaatggttcatttcagtgttatcagagtgaaaggaagcccgtcatatgacttcgatgcatgcggagacattttggctatggccaaagctgtaggtgtcatgacggaaaacatgcgcactgatcgctgcgacaatacacagtgtgatggaagtcgttgtaagggaaacactatgtttcggttggagttagacaccgaaaatcgcagagttcatcgcagacgccatgccagatgaaacgcccgaggttaacacctcgtggcgaaacggcagtgcaggtgagggcagatattgggtctgccttcagcaacaggtcccgaaggaggacatcatgactgatcagatggtgctgcagacgcagcagtggctgaacaagacatacgggaatgatccccgattcaagaaaatcaacccggacggcagaactggttggccgacaatctatgcgcttactcgcgcattgcagattgaattgggcatccagtccactgccgataacttcggtccttccacccagcggttattcaagcagcggtatccgaatggggtgcggcagcaggcagttgcggacaagagcacttccaacgtgtattccatcattcagggggcgctgtggtgcaagggctactccactggtggcaacatctcacagcatttctacgacggaacaggttccgcgatcaggaagcttaaggctgatatgggcatagagggagattccagcgtagacgttgagatcatgggggcgttgctctcgatgaagcagttcgtgctgctggcctcttatggcggtatcgactccgtccgtagggcacagcagttcatcaacaaagcatatcgtccatacacgggcatcattccgactgatggactgtacggcagggagatgaacacggctcttatccaggtgcttcagtcgcttgaaggtttttcacccagtgaggcaacggggaatttcggcaacggaactagatctcgtttgaaaacgataacagcaaataacgcatcctctaatgagtcgtgggtctggctcgccagcacggctttggcgtgtaatgggatcgggggcgggccgaccttcgtatggacgagcacgttcgccaatatcgtgaaagcgttccaggagcgttatgccattgctgtgacgggctctattgattcgaccacgtggatgagcctgttgacatctaaaggtgatcctgaccgtccgtgtgtggcctgtgacactaggttcgaaattaccgacgccaggttggcgacgttgaaggcagacgggtatgaaatcgtgggacgttatctgacggagcctggccagtcgtcgttggcgcccaaggattactttaaggccatccgtccgggtgagctcgagcgcatcactcggggcggcatgcggttcttcccgatcttccaggagtactccacgaagctggagcatttcaccccggcaaacggcgctgctcatgccaagaccgctcgtgaggcggcgcagcgtcttggcatccctcccacccatatctacttcgctgtagacttcgatgcgaccgatgaccaggtgaccagcaatatcctgccatacttccgtgcggtttgttcgtctcttggtggtggatacggagtagggatttacgcgtcccgcaatatttgttcccgcgtcatcggtgcgggatgcgcgagtaacgcgtttgtgtccgacatgtcgacgggattctcgggcaatctcggcttccccatcccggacggttgggtctatgaccagttcaccgagattgacgattacaagggccagggctgggatctggaccgtgttgcctattccgggaaggtatcagcatgcgcttcactgttgcctgccgtgccagtgcctgcgcctgatcccgatcccgtctcgccagaaacggatccgctgctaagatgggtcgccgtcacggagcaggagtgtcgcaaagcccttgccgctctgggtacccaggtagcggtttacgaggacagcatcggtcaattcatcctggaatggctccgcaaacctgaatactggtcggaaggcggtagcgggacacaagcaatgtggcacgcatatactcctgaagtttcgactccgcccgacttggacgcggcgcgtgtggtatgtgccaatgtatgcgaagcacagccttcaattaaagagaaactgccatcgactcgagatgttgcacacatggctgcaactgctctcggatacctgacatggggtatcgaaaacaatccagccaaatatggtctaggcgatttaggtggctggcctctcgacttgttgcagatctggggtgcctatcgccgtgacggcaagcatgccgacttggcagcatggctctataagcaccttgggaaagatgaaggattcgggtacgatgacgttcttgcggatgcagatgcatggctaattgcttctagtatgaggaaacgatccggttcgacggttctttctgctgctatgcgtgaaacgtttaagcagagtgagacccatcgtatcgttcgattctacgacgaacgttttgcatcaagcgcagataatgtggtgagtgcatattcaacaatggcggacggtcttgatgcacttggtttgacaaatattggaatgagcgaaagcatcctaaaaaaggctgccggtacagacaagcttcctgataagcaggaagctgaagtgagtgctcgggcgttcgctgcattcattgatcagccaagacggtagctcgcataatgcattatgtgtgggcagatgtgtcgtctgcccacacattcgctgttgtgctttcgatttggaattcctctgccagatacggggaaacttctaaaaggccgctatgccgaggaagagtcctgtaataccggtggccatcaatacgatgatggtgatgattccggcgaagatgcgtacaggaagggtttcttttccatggtttgatgggctgtccgcaactaatctcattactccagctgtaacccagcaaactgcgcccaggactagtgccaggaattctcgacaccattccgtttcaagtgcgggaatgccgacgattgatgacgggtcgcttgccagtcttggcggaatagcgcataggatacgctccaatatcaggtaaggggtatcaaaatggatcagagtcaaagcgaatgggagctgtagcgccagtcctatccaccacagcgtgcgtcggatggtcgcgagtctgtcgcccggcctagtgtccggcttgccgccttcgccctccgtcccggcaccgtccgcgggcgtgtggtccccctcgtgcgcgtccgtcgtcccgtccgtgtccctttccgcgtccatatgtccccctccgatcatccgagtctgtcgctcggcccgcgcgcccgttccgtgcgcgccgtcgccggccagtctagggccgtgcgacgcgaacggggaggcccgcgccgtcaatcggcacggaacctccccgttcatcaagcggtcggacagccgcggatcagcccgtgttccgcaggccggcggcgacacccgagcaggagtgtcacaaagcccctgccgctctgggtacccaggtggcggtttatgaggacagcatcggtcaactcatcctgcaatggctccgcaaacctacgtactggtcggaaggtagttccggcacgcaggcactatggcatgcatacacaccggagccggttactcccagcgaattggccttgtcgcgtcaggcatgcggtgtcgcatgtgatgcacagcctgtcatcaaaggcacgctgcccaatcgggacatcgcccatatggctgccacatccttgggatacttgacatggggcgttacgaacgatccaatggactatggtctcggtgatctgggcggatgggctctggatttgctgcagatttggggaagctacctggcgaataccccgaaagaggacctggcgtcatggctgcacgctcatctcggcgagcaagacgctcgtatgggattcagttacagcgatgttctcgcggactgtgatgcatggttgctggcgcggtccatgcagagcaattcttccgaaaggtctttgtccaccgctatgcgggacatgttcgcgcaaagcgagacgaatcgaattaaacggttctatcagtcccggttcaagggaagtgcggacaacctggtcatcgcatttcgaaagcttgttgatggaatcgatcttggaatattcgataacgtatccggaagtaaaaaagcactgctcattgcgtcacatgcagaccgactcccgagtcaagcggaggctggtatattggcattatcctatgctgaatctcttgaaaatccgaaccgttaatcaatcatgattgtgatcgcattgcgtggaatgattcagccattccacgcaatgcgcctctggtaaaacgtcatagagtcattagagcggaaagtagcgttatcacaagaacgggaaagaccatgaccagcacgagaaacgatatgattcccacaaggacatgcgaggcggaagaggaatgatcacgaagttccggatatacagatcgcatatatgaacgcacgccaaagatgacaagcgccgcaatccagcagactacccccataatcaatactaaggtaagtctacgtacatactcagttgccgtagttaaattcatgcacgaagaggaagagaacgttaagactctgcagattatagtatcatcatcgccattggcgccccattccgcccacaaaataagtgctggtgaaagcagcagtaatcccagccaccatagcacgcgtctggccttgcccaaagccacatagcatctactcgccttaaggaatttggtagctgctttcggtgccaaagcatatttcttgccggaaaaattttctgacgtatcttccaggccatgttttttcccaatgtcatcgatcatagccggattcgctttgcaaatgtggcgttcgtttccggcatcgccctccgccttgatgccgtccgttggcccggtgctcccgcgctcattcgatggcttgtccatgtcccctccgatcatccgagtctgtcactcggccagcgcgcccgttctatgcgcgccgtcgccggccagtctagggccgtgcgacgcgaacggggaggcccgcgccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtcgccggccagtctagggccgtgcgacgcgaacggggaggcccgcgccgtttatcggcacggaacctccccgctcgcttttcccgatcggtcggccgggaatcagcccgtgttctgcaggcccgcggcgacgccggagacggtgcacaggatgaggtagatgaatccggcctgttggctttgcgagagctcttccttgtccaccttcttgcgcagcgacttgagcgccagcacctgagtgacggacagcgcgtccacgtatggggagcggatgcggatggcctggccgagcacgtgacggtgctgcagcggccacttgtcgcccacgatggccagaacccacttgcgggtgagctccatctcgttgagtaccttctcattgaggtcctcgcggtcgccgagggcaaggtacatcctggcgatgcgctcatccgtcttggcgatggacatctcgatgttgtcgatgaaggtggagaacagcggccattcctcgtaagcctgacgcatggtctccagatcgccgaacttctcgcatgcggtgccgagaccgtaccaggcggccaggttgatgcgggcctgagcccaggagaagatccacggaatcgtgcgcaggtcgtcgagcgacttggcgccgaggccacgcttggccgggcgggagccgatcggcagcaggccgatttcggtcagcggcgtaacgatcgagaaccacggggcaaagccgtcggtgttcaacaggtcgaggaagcggttgtgcgcggcctcgtcgagctgagcggccatgtcggcatacttctcggtcatctcggtgttgcgcttctccacgctcggcgcggactgcagcaaggtcgccgcagccacggactcgacgtggcggatggccagcaccgggttgccgtaacgggcgaagatgacctcgccctgctcggtgagcttgaagcggcacttgacggaaccgaccggctgggcgagcaccgcgcggttggcggggccgccgccacgaccgacggcaccgccgcggccatggaacagggtcaggtcgatgtcgtgcgactcagcccacttggcgatgcgctcctgagcggagtgcagggccagcgtggcggaggtcgggccggcgtccttcgaggagtcggagtaaccgagcatgacctcgagcttgttgccggtggccttcagacgagcctgaacctcggggatcttgatcatttcctcgagcacgtccaccgagttctgcagatcctcaagctgctcgaacagcggaatcacgtcgatggtgggcacgtcctccgggtgggagaaggccaagcggttgagctcgtagacatccttgatgttctgggcactcttggtgaaggagatgatgtagcggcgggcggccttgaggccgttgcgcttctggatggcaccgagggcgcggaaggtgtcgagcacctcgtgcgtcatcggctgcagttcgccgcgctcgccgtgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcaccggcggcggccagcgaacgctggaccaccttgaggtcggcgaggaagtcgtcgcaggagtggtacatgaggtcggcgtcgcgctcgatggtgtagtgcagacgatcggccatcaccagcatgaccgcgcggtgcatctccttggtggagatcagggcggccttgtcggtcagacgctcgctcatttccttctggtggctccagaggctcttgagctcggcgctcggcggcgtggtctcggcttccatcgtgaggttgcggcccacggtgcgggtggcttcctcaagggcggcgatcacgtgatcggagaacttgcgggccacggcgcggctcaccttggcggtgacgttcgggttaccgtcgcggtcggaaccgatccagctgcccgggtggaagaacgcggggcaagcgggctcgacgagaccggccttatcgcccaggacccagtcgtcgaagcgacggtaaaccttggggatggtgttgaacagcgtgttgtcgaagatgtcgagaatcgtgtccgcttcctcaaccggggtcggcttcttcagcgcgatcggagaagtgcggaacagggcgtcgatctcgttgtagagacggcgcaggcattccttcttatccgagccgccgaggcgcttgtactcctcaagcaattcggaaacgcggcgaatcttgccttccacggccttacgacgggcctcagtggggtgcgccgtgaagacggggtggaattcgagctggttgagcagttccttggccttggccgggccagtctcattgatgagctggtggtaagcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctttttacgttacgaagtccatatagtgcgccaagttgtccacctatagagaccgaatatcggacagcatatgagacactgtccgattcgcggaagatttgagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgagtaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattcggccgatctggccaagcgcctgcgcgaacgtgccaaggtcgaggctgaggcggccaacggcagcgtggacgaggcgctggatcttgcgtcgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcggcgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgaaccgctggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgttcctggcgggcattctggcatcggcgtggcgttcatccgtgcgacgtggctggctaccgccgcacctcggctacccgcgcatctgcctgaccgtgccgtcgatcgtgatcatggtgcccggtctgtatatgtaccgtgccatgtggtacctcggcagcttccagaccatgaatgcgctggactgggcgttccgtgcgttcatggtgattatctgtctgccgatcggcttggcgatggcccgcgtggtgaccgacaagtcctggcgctacgacatctgaccgtcatcttggctcccctcaggtgaggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacatagttctgccatggcggtagccgcttggcgtcatgattgaggaggggcgcagttggccaacgatttctggattctgctggccatggtcatctattttgcggccatgctgtccatcggattcatctactccaaacgctccaactcctcctccaaggaatactttgcgggcgggcgcggcgtggggccgtggctcacggccctgagcgccgaagcctccgacatgagcggctggctgctgatgggcctgccgggcctggcctacttcaccggcgcggccgacccgatgtggaccgccatcggcctggcgctcggcacctatctcaactggaagcttgtggcccggcgactgcgccgctactcggtagtgaccgacgatgccatcaccattcctgacttcttcgccaagcgtttccatgacaagaagggcgtgatctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtcggtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctggcgcagaccctgctgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgattgtggccagggtcacgctggtggtcatgttcctgttcggcattctggtggcatacgaccagaactcgtcgatcttccaggtggtgtcttacgcgtgggccgggcttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgtcgtcggaataattggcagcagaggctcgaatttcagccgtttgtacagtggaatacggcgtagctttcggacatcgctaatttgctgggtagtttgccgcatcgtgagctggaccgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccctgtctaccgccccaatttttcggtggataaatgtggataagtcggtggataaactatgggtgttcatcgcagttgcaggccatcccgcaattacatggaacgtaggggtttgcaggcagccagcgggaatcgccgtcgacggcgcgattcaacttggacgaatctccatggcgttcatgcaaaggtggcatgatggccggtatgagtagcttggtgcgtattgtcaatgccggtgttccggggtctcaggaccgcgtggatgtggtgcttcgcgatggggttgttgcgtctgtcggccctgctggaacggtctcggcttcggacagcacgatgcagactaaggcgcatacgacatcgttggaatacgcggcgaatgccattgcttctggcagcgtctcaatcccaacgtcggccgccgcacccgccgacgaaaccaccatcgacgccgacggcctgtgggttattcccggcctgtgggactgccacacgcacttcacgcaatgggctaagacgctgggccgactggacctcatcaatgcccgttccgccgccgaagcgatggacatgttgcgccgtcatctggatgagcgccgcgccgccgacacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggccggcattaacggtttgcgcgtggacgccggtgtataccccgagcggttgcgagccgccattgacgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgcacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatatggtgttgttggacgccgacccatacgccgccgatactccggaagccatgcgcgctatgccgcaacacgtcgtaatgacattgctgtgcggggagcgtacgtattgatgcaagccatcggcatgaagtgaccagaggtccgtcttgatagccgcgttgcacggaaaaacaagaaatccgcccctcgaagtgaagataggacacagcagacgccgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttggttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgccccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactgcgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcaccctcaagaacttctccgacgtctacccggacaagttcaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggttaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggcaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggcctgacggccgccggagcggcgcgccagctacgtgctggtttctacctcgcggctgtcgccgctcggcgtcgcctacgggaagcccaccgggcttcccgcttaacggctccgcgtatctggcacactgctcctctggcctgacggccgccggagcataagaagccccgcaaccgacatccatcggttgcggggcttcttgcgttgaaagaccgccctatcaggcttcggccggggcggctttcgcctcgtcatcggcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaacccgatgtctatttagaagtgcaacacccttgttggtcctgtaattctaacagttctaaacccgaaaaaaatacatgactaaacacgaaacaccgacttgacgaaatacagcaacgcggaccgtcctccggtcacccgcgacgagccgacgctgggctggtgcgaggagagcctcgacggggagagcgtgaccctggaatcgtgcgtggcgcgcacctggtgggtgacccagtggcccgaccggcccgtgccggcgggctggacgcgcgacatcctgcagggcggcaggatgatcgccctgacccatatctggaggcccatgagcatggagaaaagcgagaaggacctgcgtgaccgcgagtccagcatcctgcagcgcgacacgttgcagaaccagcggaaactgtcgcgcgacgaacgccgtgagcgccgcgagcagcggcagcgagaggcggagcaggacgcgaactggcccgacaccgaccatcaggggtatatcgccctgttcgccccggaccgcgacgcgctggccgtgttcgaacgcgacctgcgcgtgcgcgtcggcaagtaccatctgcgcctgtccggcctgcgcggacagcagcggcaggcgttgaccgcggtcctgccgctggggttgtgaccatgggcgcgcacggccaggaggactggttcgacgaggtcatgcccgggttggacgacgggcggcctggtgggaaacggcgattcccatggcccggccggcatgggaaggacgacggggacgaggccgaggcccgcaccaggccccgtatcggggtgcgtgtgggcgtggcgacggtgatcgtcacgggtctcatggtcggggccggactgacggcgggcatggtctccgcgaaccggcgcgaacggctggccgacgcgtcggcggcgtgcgaacgatccgcccggacatggtccgcgggatcggccgaatggggccgtgaccgcgaccggatcatgggatccgtcgacctcgacgcgctgcgcgccacggaccccgatatggcggacaccctcgaacggctttcctccgaccccgtcacgccggccggctgcacggccggaggcgacacggcaacgctcgacgcggacgcgaaacgcatctccaaggccgccgacatgctcgcgaaacggtcggaacggctggaaaaggccgtggcgaaggccggccagacggtcggcgacgccgaatcgtcacgggccaggagccggctcgaacatgccgtggccgacgcgcggggcctgctggcggggagcacggcggaccagtacaaggtgccgtacctgtaccgtcggctcggacagctcacggaacaggcggcggggctgctcgacgacgggtccgcgtccccggaggacatggaccggctctcccagggcatcgactccatggtcgcctcgctcgcctccggcacgcgatgacgggccgccatacggttatcggcccggcgcacgcgtgtacgggcaaacggatcaggaaacaggaaggaatcggtcatgccgtgtcggtcagagcgttccggactcatcgaacgcgccatagcatgcgtccatcgcgtcgtcccagccgggcaatccggttttcccgaatcgttgtgttggcgtcgtctgggacggcgttacgagctgccgggcccggcctcgtggatcgtggcggcggtggcggtcgtcgtgttcgtggccgtgctgatcgccgcgagggatctccttgtgccggccgtgcttctggttcctttggcttgcgtgatggtccttgtggtccgtctgctggcctccctcgcgcgatcaatgggggcgggccgatgatgcacctcatactcgtgatcgccgtcgtcatcattctcgccgcgtcctatctgctgacgttcgccctgtgccgcgcggccacgcgccgcgacatgctcgaggcccgttggcgtgaggagtcggccggttccgtgggtgaggagagccatgagagcgcatgaaacgcttgagcgtgccgggcgtcatggcggcttcccgccccatgggttcgcttcgggcctgttggcggcctgcccgtcggacggcagccacgacttctacctgtcgatgatgctcgacgttcccgtgccgcgcgtgcccgtgctgcgcgcacgtctgcaagactcccgccgaggggcgcaacgcgcatccgacgcacaggaagctggccgcgtggtgcaagtgcagcgtgggcacggtcaaacgccatttgtcatggctggaagggggacgtgtggtgatggagcagcggttccgtctgcgtgacggctcgccggtcatgccgcgctggcgccgttgacgatataggcgcccttcgtgggtgtcggcgtcggcgatcatgtgctttttccgttcagggaggtttcgtatggctgatgctcctgccggggtccgtgccggcaaggccgggggtccgcatgggttgcgggtcccgtccccggccgatccggggtatgtggagtggtgccggtccggcatgccccagaggatccgtctgctcaagctcgccgccgagaaacgccgccggatcgagcagggggtgatctgtccgaaatgccataggcgccgggtccgtgccggcgacacgttgtgcgcccagtgccgtcacttggaggatctgccccgctgccgggaatgcgggaggcggacgagccgtcccgtggacgggttgtgcgcccgatgcctgaaactggtccgggaacaggccaggccgatgtgcccgaaatgcggcaggtgccggtgcctcgagggcgaggacatgtgcggcaggtgccgggcgcaccgtgtgttgccatcctgttctcgttgcggcgcgccgcggcggaagggctcgccggacgggttgtgcggccgatgccggcagctcctttcggggaaggcgaggacatgaatctggcggacgtggccttggagaccctgtacgtgctgggtgtactgatgtgctgcgcgctcctgtcccgcgaggagggctcgcgcgagggcctgggttcgcgtcgcgcccgcctgttcatgctggcgttggcggtggaggcgatgcaggcggggttgggttcgctcgcgttccgggagccgtggggcgcgccgttcgcgccctggcaggcgttcgacctggcgggcgcggtcctggcggacctgttcctcgcacgggccctgttgcgcggcggcgggaatcccggtccggactaccggtgacgcgtaccgccggtccggcttccccttccgctcccccgatatcggcggattgtcgggtggatggcatgccggccggcgggatcgccggccgtggcataggatgtgttcatgcggaccgttcccctctcccggaaggggtgccggcggttggtccgatgataggaaaggaacgaggatgagcgaagaggacaaggtgccgtccccggacggcgcgggcgtggtgcccgagcctgagacggttcgcaggcgtccgaagtggctggcacccgtggccgtgggttgcgtgctggcgctgctcgccgtgggcggcgtggtcggctgccgtgtgtggtcggcgcgcgaactggccgaggcgagggaggcttgcgccgtggcggcggacggggtgcgtggcgcggcgaacgactacaacgcgctcgtcaacggccaggccgccgacgcctcggcggtcaccgccgaccaggtgaaggacgcgaggaccgtggacgcgctggccaaggcgttgaagaccacggctcccgagtatgaggggtgcgtggccgattccaaggccggtctggacgaggcgacgtcgaagctcgacaggcaggccgcctggtacaggacccatgccgcatcgctcgggaaggccgtcaaggcggtggaatcctcgaggctcgacaggacggtcgaggacgcggagaagctgctcgccgattcgaagggcagggtcgccgacgagaagacccgtagcatgttggagcaggccatcaaggacagggacgcggacgcgatcggcgaggccgtgaacgcggtggacgggtcggtcaaggccaaggcgaaggccgacgccgacgcgaaggccagaagggaggccgaggagaaggcccaggccgaacaggaggcccaggcggcggcccaggcgcaggcgcagcagcaggcccagtcctatggcggcggcaccggctacaccggcggcggctacacgggaggaggctacaccggcggaggcacgtacacgccgcccgcgaccggaggcggcaacggtgggggttccgcctccagcggaccaatcagcggagctcaagggtgcggcaacagctgtaccggcacggatgacggttactatcatcattgattcgtgaataatatgccttgttcgattagttcgaacaaggcattattgtttctgttgaattcgcttataaatattcaacggcttaggagatgggagaggtccttcgcttctgcgaaggacctctcccatctctcttttactccctgtgtttttcctgtgatatcggtgtggttttccggggtgtgcgggtgggggtcgtggagtccggcctgtggggccggttccgtgaggggcgggagaggcccgtcctgttgatcaacacagggaggagacccttatgggttttcgtcatgatagggcgtcggccgggcggagtcatgaaccgctcgcgcgtggcgcgcatggggcggggccggcacgcacggtgcttgccggcctggtggccgtggccacgctggccacgggcggcctggtggcgtcgaccgcgtatgcgggcggcgcgggagacaaccgtccgggcggcgcgaccggcggccttcccgcgggcatgttctggcagtacaaggacgacgcgtccggcagcttcggtccggccgcgaacgcggacggctcgccgcgcatcgagtcggtggaggccgcgtacaagcgtgccggcgtgagtgtggtgaacgacggcgtgtacgacgggccgggggcgatccgcgatacgttgcggggcgcgttgtcgaagtgcgtggccggcttccgtcagcgtcatccgggcgagggcgacggcgactgccgtgtcgtgggcgtgggctcggtcgcgggccagcagggcggcagatgggtgtacaacgggtccggcggctattcggcgtccgaatggcactcgtcctgggactcgcaaatcaaaccgtataagtattactacgcaggtacacaggagtatggtacttccactccgtttgatgatgatccgtcgaacagcgtggacaagatcgcgtattcgaacgcggctgcggccggcgcgacgccgaacctgatcatcatcgtgctggacaagtaccagccgaagccgccggagacgcctccggccccgccgacgaagaaggtggagcagggcacgagcgctgatggcatgtcgaacgagacggtgatctcgacgggcactggcgtgggcggcaagaggatggtcgtccaggatgcgatcgatccgaacggcatggcgtacaaggtcacgggccagaaggtcacggacacgaccaccggccaggacgtgtccgcgaagttcacgttcaacacggcggacgggcagccggccccgaacgatgtggccacggccacgtggaagggcggcgacctgccggaaaggcacacattcgagtaccgtctgaccatcacggtctcgctgccttccacgtcgaaggtcacggacacgccgtccgtcacgtggaacgacaagggcacgggcaaggccgacggccacgggttcccgacctggcggccgaacccggacaagagctggatcctgtaccgtgacggcaagtggcaagccgtggtcgatccgggcgagacgaacaagaccggcgcggacgacatgaagttcctcgacggggacacggtcggcagcgcggtgaacggcaccgtggaccccggtctgaaggaggcgcccgccaagctggagctgaccgacgactgggccgccgccgactatctggtcgacccgcaggacgcgtcgaagatccgcgtgttcgcggccgaggccgagcccgaccgcaccgacacggtcgacggcgccacggtgaagcactacacgcagaccagcgtcgcggacatcgcgaacaagggcaccgacgtgaccgacatgttcgacatcaaggtcgagggcaccgtggcgaccgccaccgcgaaaccggactatttgaagaccctgaagagcatgaggaagggcctgcagctgaccctgctcgtcccgttcaccgtgaacttcgcggacggcaagggcgcggcccgggtgcgcgaggacttcggcaggaagccgggcgacgaggtcacgttctgcacctcgccggacggcaaggagctgaccaacaagggcagccagaccgtgaacgggcagaccgagccgaccaacaagccgaagatctgcggctacgtgcctccggtgaagaaggacgtgatcgcggaatcctcgcagggcggcggccaggagagcgtggacggcaaggtcgtccacccgggccagaaggtcgagtaccagctgaccaccgagccgaagctgcccgccgacctggccaccatggtcacgagcgtggcgttcacggactcctatgacgagaacctcgtgccggacaagcagaccgtcgagatgatggacctgaacaccggcaaggtcgtgccgaagtccaagtacgcgaccaggtgggatgaaggcaggcacctgttccagctgaccgtgaaggaccagtcgctgatcggccagtggcgcgcctcctccagcccgcgcgtccagatccgcttcgagggcaccgtcaaggaggatgcccccgccgaccacaagatcggcaacaagtgggtgctgaccctgaacaacagcctgaccccgtcgaacgaggtgttcaacctgccgcccgtcttcaacccctcgaagaaggacacccagtccaaggagcagggcgacccgaccgtctcgatcgacggcaagacgatgctgctgggcgacaccggccactacacgatcgacctcgacgccacgcagaaggaccaggcctacaaggtatggcgattgggcctgacggatgatttcgatgacgagtacgtgagcatcgacccgtcgaggatcgagatcacgggcgacgacggcaaggactacaccaacgcgttcaacatccaggtgagggacggcgtcgcctacgcgtacgcgaagaccgtggacaccgagatccccgcgaccggcgagaccgtgaagggcgacccgcagccgaccgatctgaaggcctacgccgggaagtccgacaaggaccacgacccgttgaaggacccggccatcgaccagtcgctgctcggccagcactacgcggtcaccctgccctacacggtggtcaaggtcaccgacggctacgtggtgaagaacaccgcggtccagatcgtcaacaacgtgaggaagaagaccaacaccgtctccaacccgttgaagccgatcaacccgaagaaggacgtgaccgtgaaggtcggcggccacagcgtcgacggcaggagcgtctacctggactccacgttcctctaccagctcgacagctcgatcctgcccgcggaccgcgcctaccagaagatcgcgaactggggcatcaccgaccagctcgacccggcgtacgacaaggcgaccggccagtgggccgtgtacgcggcccgcgacctgtaccggggcggcgaggccatcgccaggaagggcgagagaatcgccggcagcggcttcgacagctcgaggctcggcggcgacatgttcaccgcgaacatcgacccctccaccggcctcgtggacatccaggccacccaggcgtacctggacctcgtgtccgcggacgacgcgcacgagcagggctggcgcgcctacgtgcaggtcacgcgcgtgaaggtcaccgaccgccacgagaacgtgttcaccgagcacgtgaacggcaaggacctgaccagcaacatcgtgtggacccgcacccctgacctgaccccgggcatcaagctcgagaagtgggacaggaggagcggctggccgaagggcgaccgcgacgactccaaggacgcgctcgacggcgccaaggacggcacgaccatcgtgttcaccatcaagaacaccagcaaggacgattccggccacggtgcctggttcaaggcgagcgacctgaagcttgaggaccacaccatcgtcggcgacggcaccgtcaccgacctgaagtacccggaaggctgggacagcctgatcctcaagcccggccagagcgtcgaggtgaccggcacgctcaccggattcaccaaggacaggcacaccgaccgcgccaaggtcaccggcaccccgttggtcgaatgccccgtggtggacaaggacccgttcggcgacgcctccggcaagccgtccacaggcggcgaagccggcgacggcgacggtcccaggcaggtgaccgtcggcgatcgcacgctgtgcgaggacacgcccgtcgagtccaacaccgacgactggaacggccgccggtcgctgctgggcgagaccggttccgcgatcctgcccgtcggcgtgggcgcgctgctcatggccggcatcggcgccgccgtcgtgatggtccgccgccgcaagtcggcgcatgacgacacggacgcggccctcatgccgcgccacgccgcctgacccgacggggcccgtccgatgcgcgtcgccgcgtggaagggccccttcccggggccggcgtcccgaccgggacgccggcccctcatccatgcaacgacatcgatcactcccctcctgttggggagggggcgggcgcggcatgcggccgcgcccataggagaaggacacgatatgaggaacatcatccgcatcggcgccggcacggacggccggaaccggttcgtcgcgatcgcgttgggcgtcgccctggcggtcgggccggccgtcgcgctgcccgcggcggcgctggccacgccggccacggacgccgcggccgcgagcacgacggccggcgcgaccatcacactgcaaggcgcagacggagcaagcctggccggccacacgttcgacgtgtaccggatcggcacgtacacggaccagatcctgaacggcacgcggatcagcagtctcggcgtgcgcggcgacacggcatccaacgcgtgggcggccgacgcgatcggcatcgccaacgcgtacgatccaagcacggccgacgacatcggcaaggtgtacggctatgatgacgcgggcaacatcgccaacatcaagatggactcccagaccaggcagttgcgcaacatcagcaaggccctggcccagtcctcgaggcggccggccgccatccagggcggcgcgaacctgacgaccacccagtccacgctgacgatcaacgtgccctccgagggcctctactacatcacggacagcgcgggcaacccgattatggtcggcacgaaatccggcaacgcgaacatcatgaagaacgacgcgaaggacccgcagtggcggaccctgggcgtcgcggtcgtcaaggcgaaaagcgtgagggtcgacaagaaggtccaggtgcagcgcaacggcaccacggtaggcaaggacggcaccgcctccgatccggtcggcgtgaccgtcggcgacaccgtcaccaacacggtcgaggtgaccgtgccgaacaagcaggccgcctccgccgtcaagttcaagctcatcgaccagccaaagggccagacgtacgtgcagggctcgctgagcgtccggctgaagaacgcgccgcagaccgacatcacggccgacgcgatcgtctacgacgggaccacgcagaacaacgcgaaaagcatccccggcgacccgaccctgaagaccgcggacaacaagcccgccgacccggatctcgccatccccgcaggcggctggggcatcgacggcaggaaacttctcgacaaatactccaacaggacgatcgtcatcacctaccgcatgaccgtcgacaaggccagcgtcaccgatccgccgaccaacaccatccacacgtacggcacattcaccgacggcatccacttcacgaccatcaccgaccaggacaaggccgacatcaaggcctacgacttcaccctgcggaaggtggacgcgggcaacgtgaacacgctgctcgacggcgcccggttccagatccagcgcaacggcaaatggatgaatctcgactggaacaccggcaaatggtcggatgcggccgaccagggttccgccaccgtgttcgtgaccggcgacacgaaccatgacgggacggccgacaacagggacgacgcgagccagaggggcctcatccggttcaagggcctcggctacggcacgtacacggtcaccgaaacccgggagccggccggctacgccagctacgcgaaaccgacgttcaccgtcaccatcgacgacgcgggcaccagcatccagtacaggggcaccggcaccgtgccgaacctgaccagcaggctggacaacaacaccgtccaggtcaagaacgtcgcgaatctgacccaactgccgcagaccggcggcgtgctcgcgttcgcgttctggctggcctgcgccatgcccctgttcgcgatcggcggcaccatggccgtgcgcggcgcgcgcaaccgccgcgacgcgctgacgctcacgcacgacggcggcaatccggccgcctgacacatgtcccggccctccaggccggggttccgccgatagggggcggggtcgcgtcccctatcggcctctcatcaccgaatgattcttttttatccggcccgccacgaggggttcgtacgggtcttggcccatccgtcggaagacattgcgagggatgggggaaggaaaaccgataatgcgcacatggctgaaacggatggtcgccggcatcgtgtcggcgggcaccctgatgggcggcgggctcctgacggcgggcaccgcgaacgcggacgagatccgcatgcccgacatcggcaagaccatcacgagcctgacggcatcggccgccacgacgtatccaagggagctcgtcaacggcggattcgattacctgcccgacggcggatggaagaccgttgacgcgccaagctacatgacgaacgcatacacaagcgtcgacccgaacaacggccagtacatgaggaacgcgaaacactccgacgccgatctcgcctcctgggtggactggcccggtttcgaccagtccaaatttgcatggaagaccgaccagaaaggcggccacgaccaaggcggattgaaggaccgcgcggaagcggtcgaactccaacaggacagcatggacggcaacacctacgcggaaatggtcgcctccgaacccggacgcaccatctaccagaacctcgccaccatccccggcacactgtacaagatccggttgaagcacaccagcctgtgcaaggacaacgtcgaccagatgcaggtcgtcatcaacggcacacccatcgagatgacccgagtggccgcgaacggcaaggccggcgacaaggtcggcgagaagtccaagaccatcggcacgagggtcacgaacgagaaccgctggcatcattccgaccagtgggagacctatgagggctactacgtcatcccggacgggcagaccactacccggttcggtttcaaggccgtcaactatctcgaccccaccaagggcaatcttctggatgatgtgaccttcgcccgcgcctacaagctgtcctacgacaagaacgcgtcggatgcgaccggcaaggtcccgtccgacgagaccgccgacaccgtcaggcagaccaaggccaggaccacgggaaccgtgaagacagtcgcggacgagaacgtccggtacggttccctcgctaatggcgatttctcctacccctcgttctccgacattcaggagaacgagcagggaacctatgccgatctgcgcacgttcctcaaatcggatgacggcacgctttggtacaacatgtccgtcaccgatctttccaagtacggaaagatcgggcagatccccggtttcgactcttccaggttcgcatggtccagtaccgagaacggttcaagggtcgaattgcagcaggatcgcaacaccaagaacacgtatgcggagatcgtcgcccaacaggacaacaccagcatctaccagaacgtgtccaccggcaacggcggagtactgtacaagatccggctcaagcacgccagccgccaatcctcccatgccgacaagatgcaggtcctcgtgggctccgacacggcccacgcgacgcctgtggagatgacccgcgtcacctctaacggccatggcgacaaggtgggcgggaagtccaccaccatcaccacaaaggtatccaacaccgatccccgagaccatggcagccagtgggagacgtacgaaggctattaccaggtgcccgaaggacagaagaacacggtattcatgttcaagagcctcgaagggttcaaagagtttgagaccctgcccggcaacaacgtcggcaatctcgtggacgacatcgaattctcccgttcctacaagttgacctatgacaagaacgcgtccgacgcgaccggcaaggtcccgtcgaatcagcgtggcaaggagaacaccgtccagcccgccgaatcgaagactaccggaaacgtgaagacggtggcggataatacgtcgaatctgccggaccatctggtgaacggcacgttcgattatcgcggcaacgagatcatcaacgagaaccagagggtctacggcgacacaacctacctcgccataatcagcgcgaagaccggcgtcatcggcaacccgctgcacagcaagctcgacaactgggattccggcaaattcggctggaaatccaacgacgacaccgccggcgccgacaccgtcgaggtgcagcgccgcaaccacaccccgtatccgaccaacgcgggcaacgtgtggggcgagatcgccgcagccaagcaaggcaagtacatctaccaggacatcgccaccacgcccggcatcatgtacaagtggagcctcaagcacgcgtcccgcaacgcggaccaggacgacagcatgcaggtcatgatcggcgaacccggcaagaccgtcgcacagcaggcgacccgcaccacatccaacgggtcggacaagaccggcagcgtcggcaccacgatcaccacgcacggcaccgcgcaggacggcaagtgggagacctataccggcgactacctcgccacctcgaccacgacccgcttcacgttcaggagcgtcagggactccaacggccagggcctcgacttcaccgccgaaggcaactgcgtcgacgacctaagcttcgacaaggcgtacaagctctcttacgacaagaattcttcggacgcgaccggcagcgtgccatccaatcaatacggcaaggagaacaccgtacagcccgccaagtccaagaccacgggcagtgtcggactcgcggctgacaaaaccgcttccggcctgacggtgcatgatctgaagaagaacgacaagggcaaggtgccctccaattcgaaggcggattccacgcagccggccgcgttcaaggctccggacgccaaggtggagaccatcgcctccagggccgcgggcgacgagctggccgtgaacggcgggttcgacaccccgaagtggacgatcgccaaggaggggcagggcctgccctgggtgtatgtgaagcccaatgcgggcacgatccgctcctacgcgcaggccatggccggacagacgggcgtgaaggccggcggcctgaccgccgccacgttcgcctggcaggatctcgatgccatcggcagcaaccagaacttcgaactgcatcgcgagaaggacgggaacacggccgccgacgtgcatgcgggccgtaccgtcgcccagaccgtgaacacgacgcccggcgccagctacacgttcagtatccgccactccagccgctccaaaggcaacgcgggcggcgtgacattgctcaccggccccgacaaggatcatctcaccccagtcaaactgacccgcaccacggtctccaagaccggagcgaaatacggggacaagaccggcgatgtgggaaccgtcgcctacacgcactccgattccatggacgccacggaaggcagccacgaaccgtgggaccattccgacgactgggaatcctacgagggcacggtcattatcccagccggacaatcccgcacgatgatcgcctacaggggcgtcgccaaggacggtactcttactgcctccgccaatgacagcatcatcgacgacctgagcttccgcctcgcctacaagctcagctacgacgccaacggcggcgacaagacggacacgtcgcagatcaaggcatcctccgacggtaccgtgaaatccatcgccgacaagacctccaaggttccggtccatgatctggaggacacggacgtgcccggccagtaccgtgatttcatcctcgacaccaccaaggtcaagttctccgatgtgaagtttgagaatggtgcatggttgaacgcgcctatgccggactccggcgacggcgcaaccgccatgttcccgttgaagattggtgccagcgccaccctgccgaatgtcggcgagtggaccgatggcagcgggcacacccattcgatcaacgcgatcatctcgctgcattcgtggaacggcggcagcatcagccgattgtggacccggctggacggccaaccgtccacaagccgtgacctgttctggatcaacaccgtcggcaggaactccgacctgccggcgcaagtgatcaaggcactcggcggcatcgacacgtcgaagcgcgtcggatgccagtggaccgtgaacttcacgtacgaggacggcacccccgtgcccgacacgttccgtggagtcaccggtttcaacgatctggacggctgggacgctcaacccgatctgaagttcgagggtgttcaactggtctccggcttcgacggtgcttacaagacccgcgatgccgagctcgccacctatggggtcaacggtttcgcaggcgccaagcatgactcgggccctgagtcgaacctcgatagcaagcagcagatcaagcatcgtctggccgccacgtggaccggctccagcttcaccttcggctacgatctgcagaaccccgagggacgcgatcgcggctgccgaatgaccttcggcgttccggtcacccgcaccaaggtgctcacctatgatgcgaacggcggcaagggcagtgtgccctcgcataccgaagcaggcaaggtggaagccgcttccgccaaaaccgccggcagcgtgcatgccatctccgatgccaccgataccaccggttccgctgagggcaaggccgtgtcgggtgtactgacggacacgacggttgatgccggtgacggtaccagccagcggacgatcacccgatccgacggttccgtgcgcgtggagaccatcgccgacacgggcgccgtatccggatgccaggtctactatccggccgccaccaggatcacattggcgaccgcgaagatggactccgactgctgggattccagccagatcggcaagaccaaccgcacgttctacggttggagcgcgaacacggacgccaacgacagggacgtgcccgtcggcgacaccatggaccggaacacgctgaacgcgaacgtcaggacggagatcgtcatgcccgccagggcgaagaccgtatacgcattgtgggccatcaaccccaccctgtcgtacagcgtgaacgcgcccgccggcagcaacgcgcccggcacgcccgcatcgcagaccgtgccctacaacacggccgccgccgacaaatccggttgggcggccggcgacacgggcaagattcccggctaccggttcgacggctggtacacggccccgaacggcggaaacaaatacgatttcaacacgccgctcaccggcaacgtgaccgtgtacgcgcactgggtcggcaacgggtacacagtcagattcgccggcaacggggcgaccggcggcggcaccccggatcaggcgttccaatacaacatcggccagaacctgcgccggaacgggttcacgcgtgacgggtacacgttcgccgggtggaagcgcgccgacaaccagcaggcgtacggcgacggccagtgggtcacgaacctgaccacgcagccggacgggatcgtcaccatggtcgcccaatggtcggccaacgaggcccacatccgctacaatccgaaccctcccgcgggcaagaccgcgggaggccagggcacccccaactgggatggccacaccggagacacgccgaccatcggccagaacggctggacgatcgacgggtacacgttcgccggctgggccaccagcccggacgggagcggcgccaggtacgcgccgggagccaggtggacggcgaacggcacgctcaccctgtacgcgcagtggacgcccggccaggccggcctcacctacgacggcaacggggcgaccggcggcaagaccgacccgcagactggcaagaccgacgagaagatcaacgtgcgcgacaacggattcacccgcgacggctacacgttcgtcacgtggaacactcaggccgactgcaagggcaatgcagtgaaacctaacagcgagtggacgttgcgtggttccagcaccctatatgcctgctgggccggtaacgcgcaaaccctcacctatcacggcaacggcgcaaccggaggcaacacggcggcacaatccggcaagaccggtgacgaactgaccacaaacgccaatggtttcacccgcgacggatacacgttcgttcgttgggacaccgccaaggacggttccggcaccgcatacggcgaaggcaagaacggcgtcagccagtacgtgatgaagccagcaggcaacgacctgtacgccatctggaaggcaaacccggcaaccatccagtaccgcaacgactggccgaacaccacaggcagcacacccgacaccaccggcaacaccggcgacacggtgaccatcagccagaacagcttcgaccgtccaggctacacgttcaccggctggagcaccagcaaacgcggcgacccaagcctgcaaccgggcgacaaacacacgcttgaaccgagaaccaccaccgtgtgggcccaatggaaggccgaccccgcacacctggtgtacaacagcaacatcggaaccgtcggctcggaaaccaagacggtggacggtgttgtcgaccagaccgtgaagaccatcacgaacccgttcgaccgtcctggttacacattctccggctggaacacgcaggccgacggcaagggcaaggcatacgccacgggagccgactacgtgctgacggccaacgacaagtccacgccgaagaacacctccgtgctctacgcgcagtggaaaatcaacggtgccagcctgaagttcaacccgaacggcggcatcggccatgtcgatgacgtgaccggcgacgccttctccaccgtcaccatccccggtgacgcgaaggagccgaagatcacccgacccggctaccggttcgtcggatggagcacggagaagaacccgcccgcagggagcactttcctgcagccgggcgaaggcaaggtcacactgcccgccgaaggcagcaccaccgtgtacgcccagtgggagccgagcctgaccaccctgccgttcacgggcggacaggcccaggtgccgaccatctggctgtacgccggattcgcgctcatgctgatcgcgctcggcgtgatgatgccgatgctacgcatgcgcatggccgcaaccaagcgcaccggtaagcacatgccgatcaccggcggaaagcacgcgaagtgacggcagcggccgaaaccgacgtgtgggagagcgtcgcggatgcggtccgcgacaagcgggcgcgcgacaatcgcgcccgccggctcgtccgccattcccggatctacgcggtcgccgcagtcatctgcctgatcgcgggcatggtgcttgtcgccatgccccgcatccagcagacgctcggcgaccgcgccgttgacgagcaggcgcgatccgtcagccagacggccgcgctgtttccggaatcctcccgtcaaagcgtcatccaatctgccatcgcatataatcagcgtctttatgaaggcggtcagccacagataggcgaacctgtgttcgatgggaagaccgagggcaatttcgagggcgatgccgaataccggcgtcaactgtccgtgaatgggttggatgccatgggtgagattctgattccgaagatcagcgtcgacatgcccatcctccacggagctggtcaagatgtgctcgaacatgcggccggccatctggcgggcaccagtctgcctatcggtggcaagaatacgcgcgccgtaatcaccggtcattcgaatctgaaaggcgcgaccctgttcacccggctcggtgaactcgaagacggcgacccgttctatatcaaggtcatgggtaacacgctcgcctatcgagtcaccagcaaacgcatcgtctctcctaccgacacgaaatcgttgcgtgtccataaggggaaggacgaggtcacgctcctcacctgtacggggcagggcaatacgctgcgactgcttgtcacgggggagcgcaacagcatgcccgatcaggcccccttgcccggagatgccacgggggacgtaaaaaaggcggcttttgtttcgggcgtcaccgtgacggggatattggctgtcggattttcgctttgtcgcagtcggcgtgccgtgggtcatcatataggtttgccacagacacatgatagtgacaatttgcgttagtaaaaaaaggtgttactatatgtttgtgaaacaaaaacacgtaatctcccgacatcggggtaaacccgaaaaggaagacacatacacgagaaagaagaaactccccatgacacacggcatcaccaagatcacagtggcaaccaccgccgtgatggcaacccttgccgctccggcagtcgcaatggccgacgaaaccacaaccaccggcgaccaaaccaatcaggcaatcacacaggcccaagacagcatccagcaggcacagcagagcaccaccgaagccaaccaggccatcgcacaggcatccccgaccggcgtgaccgaagcacaggccaaggccgacgccgccgcagccgcactggacaccgccaagcagaacctcgacgccgccgccgcccagcagcagacagccgcaaacaaccagcagcaggcgcaggcgaactacgacgacgccaataaggcccagcagcaggccgcacaggatgcgaccggcacggccgacaagatcgccgccgcccagcaggccgcgaacgacgcgtccaacgccatcaatgacgccagcaaggccatgcggcaggcctccgatgaccagtcgaaggcagaagccgacaagcggaccgcacagaccgcgaaggatgaggcctccgccgaatccgcctcccatcagaaggacgccgacaaggcccagaccgatattgatgcggccgacaagcaggccacggacgcgcagaagaaggccgatgacgcagataccgccatcagtgatgcgcagaagaaggccggccgggccgacgcggacgcaaagaaggccgcggccgacaaggccgccgccgagaaggagctggccgcggccaagcagcagcaggccacggcgaccggcgacaagacgaaggccgacgaggcggtgaacgtcgcgcaagccaagctggatgcggccaggcaggccgaggccaaggcgcttgaagccaagcagaaggccgatgccaaggtcgagcaattgtccaaggatgatggaggtctttccgacctggccgcgaagctcaaagcggcgaagaaggccgcagccgacgccgccaccgcccagcagaaggcggaacaggcgcagaaggatgccgacaaggcggtgtccgactcctcttccaacgccgaggcgaagcagcaggccgccgccgatgccaagagcgaggccgacgccaagaaggaagcggcagacgaggctcaggacaagctgtctcagggcgcagtggcctacttcggcgacaagggtgcctctcaggcagtcaaggttctcaccgatccgaccgtcaccgagtatcttgacgccattcataatggtgccaagggtgatgcgaccacgttggacaacatgatcgaggccctgaagttcatccaggaagccaatcagcttcgcgcgaaggaaggcctgcagcccctcaaggtcagtgacaccctgatggcacaggccatggcggatgcggattatgccaacaacaacgtgaaccatccacttcaattccccgccagcgaaaacctcgcctggggttacactgatccctttaagggctggtacgacacggagaagtccatgtatgagaaggacatgtccgacggtgtcctggattgcaaggcctcggacggcaagcccgtcaaaccctgcgcttatggccattacaccacgctggtcaaccccgatttgaccctcaccggtttcggcgtcagccagaacggcaacatcacgggtatcggcgggaacacccatagtcagctgttcaccgaaaacgctaacggaatcggctccgacgcgggccgcatcatgaacgttgacgcatacctgactgatttgactgcctaccgtgattccctgaccggagccgacgccgcataccagaccgcattgtccaagagcaagcaggccgcacaggacgcttccgatgcggccaaggcgctggccgccgcccagcagtccgcacggaaggccgctgaggaagcccagcaggccgcgcagaaggccagggatttgcaggctgccgccgacgaggcgcagaaagcgtatgacgaggccgtgaaggcgaacgaggacaaggccaaggcgttggaggaagccaggaaggatcaagccgataagaacgcggcttattccgccgcccagcaggccaccaaggaagcccggtccggagccgacgccgccaccgacgcccagaccgcagcccagacggcagtggacaaggcgaacacggcagtcgccgccgcacaggcgaagatcgataccgccgacaagctgacccagaccgccgccaagaacaagacggatgcggaagccgcgatcaagcaggcgaacacggacaagacgaaggccgcagccgacctggccgccgccaaggcagccaaggccgaggccgagaaggccaagcaggccgcgctcgacgccaagaccgtttccgacgcgaaggttgaagccgccgccaagcaggtcaaggccgccgacgaggccatcgccgacgccaaggccgcatacgcgaaggcgaaggacgacctcaacgcggccaccggcaagctcaacgacgcccagaacaccatcaagcgtctgcagaacgccgaggagaacctcaagaaggcgaacgcgaagctgacggaagcgcagtccaagctggacgaggcgaacaaggccaaggatgaggccgacaaggcatacgagaaagccaaggccgactatgatgccaagctcgccgacaagcaggcgtccgacaaggagctcgccgccgccaagcaggccgaagccgaagcccggaagaaggccgaggaggaagccaagaagcagcaggaagcccagaagcaggccgaccaagccaagaaggatgccgaagccaagaagcagaaggccgaacaggccaagaagcaggctgcaggtgtgacgaacaatggtctggcctccaccggatcggacaccaccgcaatcgccacgctggcggcgatcatgaccatcgccggcgccggctgcgtgctcgtgaaggtgcgctccgccaagcatgccgatggatggcatgcagtcgaggactgattctcaccgcaccaaacgtgttttgcccgccttcgacccgaaacaggggagaggcgggcaaaaccgtattcccacataccgaagcaaaacggtagcttcttttgttactatcagaaaaaagtcagtgaattgcgtgaaagggtctggctatgaacgatgtgggccatgcgccactcccaggcgacgtgctgctacaccaatacctgcaaccaaacaacatcaccatgtaccgtctggcgaaagccatgaacctgccacaaaccaccatcagtggaataatacgcgggaaaagacgcatcaccacaagcctcgcataccagctcgcctacgtgttgggcacatcaccggaatactggctggaattgcaaatgcactacgatattgaaaactacgacaaattcaacgaaagcggactgacggccctcattgataatacggtcggcgacactgtccaatcagaacgatgacgagcagaagaatccgctaacgccagtttcgtccatgcccactttgatggcctcgattccgccaattcgttttccgctgccgcgcattgtactgctgaggatattctgtgccggcgcttgtccttgtattttctccctcggagtggctgaatagggcttgtttccattggtttgcgttcatggaattctttatccggccttctcatccccaatgcgggaacaggtggcggaagagcctctcgccggcctcctgctcgtcgagcacgcccatcgtgtattcgtcgacgatgaaccgggtcctcgccatccgttccgccgtctcgtccgacatggtttccgttttcgcatcgccttcctcgatgcgcgtggggacgcggacgagttccagatcggatatcccctcgggcatggtcccgtccggcagacatacgacgacctcctctcccccgccatcgagctcggtcagcttgcagatgccggtgccgtccaccgattccaggtattcgcccagttcggggatcccgtcgcgtgtgaatctgcacatgcgcagcccctgcccatccattgatcccccaatcatgccggatgcccggcatatcccgtcatcatgctacttcctttcgtccgttcatgaatcagacacgccatcatcgccatccggagacgacggcccgttgcccggctgtcggccgaagatggattccccgtcgcccaacgctcccagggatcgcagctcgccgtcgaaccggtcgcgttcggcttgttcgcgcagttcccgctcccagatctcgtagtcgtcggcgtgcagcccctcgtcgggcccgaccttccagtcgaagcgtcgcagccggctgatgccgggcatgacggtgccgtccggacgtgtcaacggatggttgacgacgaccttgctgcaggtagaccactcgtcggtgacggcgaacccggatccgtcgcccagcgtctcgtattcgcccacgagcctcctgccttgctcgtaccattcgcacatgtgcagcgtgaacgacccgtcctcatgctcctcgtacatgaccgtctcctcttccgcaatcctagagctcgatgtcctgggcgagcgtggtggccgcgtcgtttttgtgttcgatccaccatgccgcgtcgttcatccgcagcacctgcctgcgcagttcggcgaacgcgtcacggtcctcgatgcgcgcgtggcgggcgagcacgtcgacctggctgagggtgcggcgtcgtatcggctccgcccggtcgcactgggatttcgagccccacagttcgcagaacccgtcaagcctgttgcgctgccgggacgcgatgccgatgcaggcggggcatgacacccgttccgcgttcctcacccgctgttcgacgaccacgtacgggccgtccacgttgatccgctcctggtgcccgcatgcgtgcgtgacgaatctccaagccatgacctaccgccttcccgaaaacaagaaccgaaccagcattcgaacaaatgttctattaaggcggggacatgcacccgtttgacgcccggcgggaacgctacgaccgacgcggggcgcgccgcgactccggcccgtattccgacgatgtcatggtacaatttattgtacaaacaggaggtgcgtgatgacacaggccgtggcctacagcaatttcagggcgaatctcaagacctatatgcgcagggtcaacgaggacgccgacacccttctcgtgaccaacgcggacccggaggacaacgtggtcgtgatgagcgccgacgactacgattcgctcatggagacgctgcgcgtctaccagaacccgtatctgagcgataaggtgatgcgcggcatggcgcaggtacggcagggccagacgatggcccatgaccttgtcgaagcgggcgcgtgatgctgctctgctggaccgatgacgcctgggccgactacctgtactggcaggctcaggaccgcaggaccctcaagcgcgtcaacacgctcatccgggatatgcagcgtaccccgttcgagggcatcggcaagcccgaacccctcaaatggggcctgtccggcgcatggtcgcggcgcatcgactcagccaaccgtatcatctataccgtcgccgacgacaggctctgcatcctctccgcgaaggaccactactgaatgacatgggacggaacggcctgtaccaccttatcgacgttttcggtcgactcggctttctctgacaggattcgctggcagttcctgagccggttccaatagcgctttcgccaggctgcgaacagtcccgccaccaatgacagcacaaacgtgcatagccataacacgacgccatttacacccttcatatctttcaatgggccgaacccaaatacggccacagcagtggggacgatccctcctaaatcaagcaccgcattcgttgctttggctttggtgtcgtttttcctgatgaattcgggaagatatcgtttgacgcggggatcccagtccttgatgttgtcgaatgtgatcgattcggttatttcgttcttcagaaacaaggtcgaggaaatcacgtaccgccattccagcagggatgcggagtcggcaagaccggaaccgatttttccatcgggccagcaatatgcgagggacaacgcgaacagccagaacatgaccacgcacatcagcctgataaatgtatggataggcccttctacgtagtaaaggagaccggatagccccatcccgatcaacaagggtattgggacaatcttcagacgaaactttgacggcatgacatctcttacgatgatggcacaggccacataccagcagtagacgaagcccacggaaagcagccacagcgacgttcccgcccctgaaaaggccattccctttccgccgtagttgacgcaggccattgccacccccgcatcccaggacgccagcatggacatgagaaagatgcccttttcgaatttcgttgacctatcacggccgagcatgggaccgaataccgcccatgaaaaggtcgcccatgctgccgacatggctccagcgactatgacgctttcttcattctgatctttccagaaaaaatgcgttcctatgtagaaacccaccagagccacggccaggtccagcagcagcaatgccaatcccggaatattcttcttcatgctcttgcctgtgctgttttcggcttcatccggattcgacgtatatgaattcatgatcggcttcccttccttccacctgccgtctcaaccaccgtatatccgtgatgatccgttttcacgtgttttgttgaatttattaggacatcgcggcggcgcttgtgccggccacgaacgcgagcacgacgaatgtggtgaagatggggtcccagaagacggtcacgaggatgacgatcagcacgatgttcagtatcacgccgacgaggtttcccggcttgtccatgtcttttctgaacagatggactcccatgcagaccagcaggattatgaacgcgaatccggtcagcaggaaaaaccagtaccagggttttccggcggtggcgaaggcccgttcgatcagagatccgttcatgacatcgtactgggaatgcagccagtgcttgtagaatgccagcgcgatgatgtaggccagggatgcaagtatggtggctttctcttctacggggatttgtctgatcacgttcctgattctagtgaacgatcagtcccgccgcgaagacgatcacgccccagatgaacgtgagtcgtgcggggtccgccttgtcgccgtggccgacccattcgagcgccgtcttcatgccggcgagcatcgtgtgggcgagcatgaggcagaacaggaacacggagaccgcgagcagcggggtcaccgttttctcgactgccatattcaccattcccgctcccaggaggacgaacgaggcgacggtgcaggccacggccgccgcatccgcgcggcttcttttcccgtgtccgatcagcgggtatacgcataggcagcagatggccagcaggacgagcggtgccagggtcagcgcggtttgcgcgtccgcgtcggagaccattctcaggtagtccgttttcctcaggcgcggcagcacgtggtaggagaggaatcccagcacggccgtcgacatggcggcggccatcccgacgcgcagcagcactcccttgcatatcgccgcggcatcggtgccatgttcctgctccatgcccttgctccttccgttcgtcgttcccatgccggttttcccggatccggttcccggaccgtttccctgttccggttacgacgataaccgggtttcccggctcgggcacgttcctgttcatgcccgagtcctcgtggctgccaccgtggccgccggccgttatcggcggccccgctggtggtgtccgtggaggcgtggccgcttgcccgtccgtcgcgtcttccgttttccggttccggtgtcggcgggctgattgggagagtgtgtcatgctgtcggttctggtgttgctgctggtggtggccgcggcgtcgttcgcgtatcgcgcgttctggatgctgcgggcccgtccgtcgtcccggtatgtggggagccgtttccgtgacgaggtggtggcgatgagccgtcgccagcgtcgtcgcgcgttctggggcaatgtgctgctgtgcgtgttgtgcgtggccgcgatggtgttggtcggcgtgctggtgggcggcatgggcggctcggtgtgaccgtccgtcgtcgtttcgcttccggcccgtcggcgtgtccggcgggctttcgtcttgtgtgtgggcctgatcgtcggaggttggtgtgatgtctggttcggctggggatgctccggtgttggagggagaacaccggttgggcgagggcatgcgtcgcggcgtgttctgtctggggctggtgccggtggcgacggggttgacgctgcgcgaggcgatgtggatgcagtgttgtctgacggcgggtgtggagcccgggccgatgcccgcgcatgcgttccgtcgcgccgaccggcatgcggtggaggacgcgatgggcgtggccccgggtctgatgcgcgcgatggccgcggatgcgaaacggcgtcggcgcatggtggatgcggacgaggaggggcgtctgcccctcggttcgccctcccccgtggacatgatgacccgtgatttccgcgtgcggccggtcacggcgtggcatcagaccagcacggggcgtgcgggggtcctgtccacgctggtggcggggtcgggggcgcctcgcatcgacgggccggtcatcggcgtggatgtgctgtcgcgtgagttgtggcggttcgattcgtgggcgacgtatgacgcgccgggcgttcacggcccgcatatgacgaccagtccggacgtgttcatctgcggtcttcgcggcaacggcaagtcgttcgcggcgaaggtgatggcgttgcgtgagatcgaggcgggccgtcatgtgatcgtccagtcggatcgcgagggcgagtggggccgggtcgccaatcatgtgggaggccaggtcgtctcgccgggcggcggccattatctgaacccgttcgcgttgccggaccgtccgtccgccggcgaggacgatctgtggcgtcaggaggtgctttccgggcgcaaggcggcgttcatgagcctggcggaggcgttgcgcgaggatggaggcccgttcccgttggatcgcgacatgcaggtggtcgtggaccgtgtggcggtgtcgttcggcactgggccgatgacgttggaggcggcggtggaccgtctcgcggaccgttcgtgggtggatggggagtcgccgtcgatgacgggtttcgagcatgagccggcgttggcgcgtgcggcggcggccgcggcggctcgcgtgtatgcgccgatggtgcgtggcggcaccctgtcgggcatgttcgacagggagtccacgatccggttggacccgtcgagcccgatgatcgtgttcgacacgtcgagtccggcgttgaacaacgagcagctcaagcgcgtgttcacggcggcggtgagctcgtggatcgaccgtctgctgcaggggcgtgacgggaggcggcggatcgtggtcgacgaggaggcgtgggatctgctgtcgaacgcgcgtctggtggactcgttgcagaccaggcagcggtccgccggccattgggggtgcgcgacctggctgatcgtgcatggcgtgaacgacatgacgcatgtgttcggcgagggcagcgagctgcgtggccgtgtcgaggagatcctcaaccagatgcagacgaagatcatcttccgtcagggcgggtcgaacatcgacatgctcagccggctggtcccggatctgagcgaggacgagcggcgggtgattcccacgctgccgcaggggctgggggtgtggagggtcggcgcggagcatccgcgtatggtgcgcgccctggccggtccgaccctgtcggccctgttcgacacgagcgatctgaggtccgcggcctgaaccgcatcgtttttgttgtatccgttttccgtattcgttggtgaggaggccgctgatggcggatgtgtccggggatcgtccctggtatgaggagctggcgcccgatctggagggcgatgccggccggggcgtggaggggtcgcgtgtcgattcgcgccgtcgggtcatggccgtgtggcgtgggttcgaggactcgcgtgcgggcgtgtggctggcggagcatacggggcttctggccgccctgtcgcgtgaggggtcggtgctggtgcgtcgtctggccgtgggcgtcctgctcgtggcgatggcgttcacgctgctgctgttcgcggcggcgggcggcgatccggtggccggcgggctgctgtccatgcccttctggatggccgcgttggccgtgtgcgccgtgctgtgggcgttctgggacgcgtaccgtgattccggggaacggctcgtggatcgtctgtcgtcggctccgggcatggccacgcgtcgtcaggtcgcggccgcgtgcggggtgcgcgaggtgatgcgcacgatggtgccgagcgtgctgccggccatgctggccgcggccatgcgggagcgtcgcatgggcggcgacccggtgtggccgaggccctggcaggcggccatgtacgtgggcgaatgccatcacgtcggtgtctggctgtcgttggagatgcacgcgtacgtgctgggaccgaccaggtccggcaagacagtgacggtcgtgatccccgcggtggtggaggcgcccggcttcgtgctggccacgtcgacgcgcagcgacatcatctcggcgacccgtcgcctgcgggagaggggtgtggcggatccgtcgaacggggcccggtacggcggccgtggccgtgtccatatcttcgacccggaggggttgggcgcggcggatccgctgacccggcacaacatgcgttggaccccgttgcaggggtgcgaggacccgaccacggcgatgcgccgcgcgcagaccctggtgggtgtgggcggattgggccaggggtcgaacaacagggagtggggcgtgagcgcgggaggctatatccaggcgcttctgtatgcggcggcgatcagcaacctgccgatctcgaaatgctacgagtggtcggtcagcccccgcaaggcgctcgaggccgcggacctgatccgcgagcatacgggcgaacgggagatgctgcgctgggcggacacgatccgtggcctggagaccatggacacgcgccaacggtcgagcgaatggttcggcgtgaggaacgcgttcgcgatcctcgcggacccgaaggtgcgttcgacgatggatttctcgccgcgcgacccgcgtctgatcgatccgaggcgcatggtcgaggatcatgacaccgtgtacgtgctcagccggccgaaatcgcaggcgggcggaggcgtgaacgcgggcctgttcgccgtgctcctgctggacacgttccaggaggcgtgccaggatctcgccctgtcgcgcgaggcgtcgggacccaacctgcgcaagatcgagccgccggcccggttcgtgctcgacgagctgagcaacatcgagacgtggggcggcctgcgcaacgcgatcacgcagggcggcggcaacggctatcagttgctcgtggtcgagcagtcgcgcgacatgatggtgcgcgactacgaccgggagaccgagcagaccgtttggaacaactgcaaccggatcatgctgggcggcgtcaccgaccgggacagcctcgaatggtggggcatgcagatcggccggcatgaggtcacccgtttcgagtccacgtggaatccgggacagggcccgctcggaggggtcacggaacgccgcggcgcggaggagacggtgctgccgtgggagctgagccgtctgccgcgcgggtggatggtcgtccagcccgtgcgcgaggcgccggccctggtccgcgccccgcatttcatggaacgcggatggtggcatgacgcggaaggagacaggtgatggacgacacccgtgacgaggtggacgagatcctggccggcatgacgggaggccggaccggtacggccggcggcgtctcatcccccgtgccgccggccgcggactgggcccgtgggctcgacgccgcgtcggcgtcggccgcgcggctgaccgtgctcctgtcggacgtgtacagggcgcatcagggcaaggacccgtcggccagcctggccgcgcagatcgagcagaccgtgcgcaacctgaccggcgagcctccgcaagagccggaatacgggccgggcctgtggacggcgatgccgcaacgctcctgggagacgatgggcatggcccggccgatcgactggaccggcgcgccctcgcgcacggagatcgacctgatgacgatgcacgcgatccgctacggcgaatggctgtgccgcacgttccccacatgggagcagacgctgcccgcctgctggatcgagcatgacgacgtggtggctgaggtgttcgccctgaaatgccatgcggacctggccgcggcctcccccaacggcggcatgtacatgccggccctcatgcaggacatccaccaggccctcgcccgggtcaaggaatacctgacggcggccggcacgggagaatcctcccacgcgcatcacatggacggcgaacagcatgcctcgcgccgacgcgcccgggaggtcgaatacgagtcgtggtatcgccggcgcggcggatggaagacggaaccggcgttcaccggccgttggcggggcggcgaggatttcgtctcctccacgctccttgcctacgggacgcctccctcgcccgcctcgcatgacgatccctccgccgacgtgctcatggccacgctggcgggctgcgaggagcggctggacggctaccggcgttcccgcgacggcatccgccgcatgcccgacgggccggaacgcgaccgcctgtcacgccagctcgccgcggacaccggcggtgatctgcgggaactgtccgaccggtggcgtgactggaggtccatggagctcgcggcccgcgaccggctcgaccaggccatcgcctccatcgaacgacggctcgacgaccggaaggcacccctgtcccatgaggaggccgaggaggcgcgcgcactggcgtcacggggacgcgccctgctcgacgaggccggggacccgcgttggaaccccgactcgtaccggccccgggacccggacgaggagctgaagctcgcgaaacggctcgaaggcatcgcccgtgaacgggatctcgattccctggaacagctcgaccggctcacggccacgatacgcgcgacgatcggcccgaggggaggcatgcgcccatgaccatgccggacctgttcgaacaactcgactcccctgccgagaccggcgacgattggatccgccgcctgctctcggaaccggacgagactccctcccccacgccggccgccggcgacgacggcaccgataccggccatgagcccgatcttccccaagaggaggaaaggattgtcccgccgcaggcctcaggaccgggggccggtggcgatgtgacggctcccccgccttccggcgcgcatgcgatccccctgccggcatccgacgacacgtcgccatccgatgacctggatgacatgcaccaggacgcgattccgggattcggcaccgatatggatgccgatgagcccgcccgtgcgggccatgccgtccggatcgtactgacggtgctcgccgtggtcgccgccgtggcgctcgtcggcgtgatcgccgccggcgccgtcaccgcgtccgcccgccacggcgcggaacaggcgcaggccgtgctgcgggagaccaatacgattgcgactcggttcgccaaagcccacaaggcgtccgacctcgccgacgcgaaggcatggagccgtctggacgcgcggatttcggacaacgcgaggatactcgacgagcccgccgcccggctgtccatcagggatgctggatcgttgaaggaccgcgcgggcaaggccaataaggacacgaacacgctggtgtcggcggcgaggagggccctcgccatcaaacaggaggccgacgcgcgcgaatcgctcgcgaaggcggtcggcgaggccaccaagctccgggacggcgcgaagcgcgacgacgacaccggcacggccatcgacgatctgacgacgatcctcgaacgggccgccgagcccggcaaggacgtcaccgtcaaggagctcgaggatctggcctcccgggtcgagcaggcgaggaagaccctcgaacaggccatcgccacgcaggcggagcatgcgaaggccaagcgcgcggccgaggagaaagcggcacgggaacgccaggagagggaacggcagtccgaacagcagaccgtccccgacccgacgccgccacagcagcaacagcaatggataccccaataccagtcgggacagtcgggacagtcgggacagtcggggcaatcgggcggaaccggctcccagcccggcaacggctggagcgtgccgtcccccagcgacggcaacggcctgcccggcaacgatccgggactatagcccatcatccattcgaaaggagcaccatcatgacggacgagacaccacgcaaaggcgagcacagggaacgtcagggccttctcggccgagcgagagaccggttcgagcggatggagccgaaacggcaggcgctgctgctcgccgtcgcggccgtaatcgcattggcggccacgatcgcgctcaacccgttccagtccacgacatccgatcaaccagaacctcaatccgcccaacaggcgacggacggcggcaaggatacgaaaaaccagtcccggacggacccgtcttcggaaccatcgggattcaccggttccacggaggacatcgccaacaaggtccggtcgatcctcaactccccggacggcggcaacatcgacacgttcggccagacgctcattcgccacggcgacaaggacctgggcaacgcgaccgacctgttcgacgcgatcggccggcaggagaaggaatccactgtccgcgcattggccgacgaatggtatgccgaggcgttgccgaaggccgccggataccggctcgacgatctcaaatccagtctgcccaaagcggaacatgccgtggacaggcttcccgaccccacgccggacgactgcacgggcctggccaaggccgcgaaacaggcgcgaacgttggtcgacgccggatccgacgactacgacaagctcacctccgcacagcagaccctcaccaaatcgatcagcgcatgcaccgccaacatgaccgtcgaccagatcgaccgcctgttccctcaggacggaccatcggtcaccatacccgacaccggaaaggaagcacaatgacagcggacaccacgcggcgggagcacagcggttccggcatccgtctcggcatcggctcctgccccggcatagcgaagatcctgccggccggcatccgaggcatcacattgcccgacggcacacgcgtgcgcatgctgcgctgcgtgacccgggagggcggcgccgacatccccgtcgccctgatccccgccaccggggcggtccacaaccgcatgctcggggccgccggcggccagatcgtcgagttcgccggcaggccacgtctctaccggcccgagaagggcggccccatcctcgcgttcaccgtcaccgacctgcgcatccgcgacaccgatgaggcccgcatgctgcgtgccggccggactcacggctgagaccgccactctgcttcgagccggcgcgggaacgtcataagaacacgctcacgaactcggtcggcgtgatgatggaagggctgcctatcctcacgccggccgagtccatggtcacgtcccgacgccaactcaatcgtccttaccgcgttggcggaacggaatgtgctggcggacagcatcacattggtgtccatcatcaccctcgttgatcagttccacctcgccgcgcgttccgcccgaatgctcccgatgaggtcgtcgagcgcgcccatccggcagcatctgcaatccgcgatccaacagactcaagaaaaccgtccattgttccgtctgttcccgttggagatggacacgacagcatatcgaatcatgcatcattccagaccttgacgccgccccggtgaatctcattgcgccttaccaccatcagcctcataccggagaatcaccccatgtcaacggcatgccgtcagttattgtccaatggatttcaaacgccgcgctcgggctcaggattcccccgactctcccgtttcctttttccctgatcagtttttcgagtctaggtccggcccacactcaggcagactgccggctcccgggaaacccatccgagacggacacggccactcgttttcgtctcatcgtcagttccagaccgaatctccttctccatggagccctctccggcttcggtcgcgtgcggttctgtaaaatgcctgcctatggcgaagacggtgataagggtcatgttcgatgatgcgacggctgcggaagggtttctcgagcgttgccgcggcgagggactggacgccgtggtcgaggacgcgcggccgatcggcacggtgaagcgcaatgggcccggtctggcgtcatggctgaaagcccatccgggctggcatgtggtggcggagtcggtgaatcggcgtgcggcgtgggccgcggcctggaagattcggcatggggagcgtcgcggcttcgaggacgggttgtgggacgcccaggcgcagaaccgtgatggcaggtgggtggtgattgcccgccgcgcctcgaaacgccgcaatatccccggcgagggcatggacccgttgttctagaacgatgtcgggccgcttgtcgtggactgccagtggagattccccgtttccacctgttccatgggtgatggccacggaagcatgccggtccctattcccgtttcggcacccatgaccaccgttttgtgggtgctgtcatcgccggcggactccgccagtgagcggacttcgcggatacgggcggaaagcatggtcgcgatggccgtgattcgcgtttcaggtacgagtcccgtgactgacaggcggtgtcccacctgttcctcccacccatcgagcttgccaaggtcatatctggtccagtcggatatgaggcgcagctgtcggcgggctgtcggcgtcttataagtcgcgtagaacggtttggccttgtagtcgcggttgtctatggcgagctctccgcaccacagagaggctccggtgtcgaacaacggcgcgggccggacccgcagtgtctccacgtcgcggatgagaccgaagttattgtaatggcggtcgatgttccgcatgaggtagtccacgagtagccaatcgtcggtcgcatgcaccaccgccgccccttcgcagccgaacagttgcgccgccctgatccactggtccctggcgctcaggcgattatccctcttcaccgattcgagaatctgccatgcggatacgagttcctcggtgtccgtcagcatttcgggacaggtggatactggcctgttgtcgtattcgccgagattatatctgactgctggtatgccgagcctggagcaaaggtccgatgcgatgagttcgttgaccggttcctgtccggtacgtccggctttgatcagtatcctggtgccgtcgcccgcaatggtccatcgtttcggaaggtcgccgccggtggatgcgtcgggtgcgttgaggctgaacctgtgggaggaggaacgggcagtcaggagggttcgtccaagttcctcgtcaaacgggttggtgaagaagttcacggtatcccattcgaggtcggatgattcgggcttgacccaatactggtcggaaaggctgagtccatgcgagcggttgaggagttccaccgccgatcttattcccatcgagtcaagtatgccgcgtatcccatcccgagtgggtgggatggcccttcttctccaccaagcatcgatgcttttcgcgtagatcgcgggtttgccgtgggagatgagctcgagaggcaaccttgaacaatccagtatacggccgctgccgacggcctttcccgatgaaggatcgtagtcgaaggccagcaccggatgtcggcgacacatgattatccgtcgttccacgtccgtttccctccttgctccggtgtcagtcactccatcgtatcccgtttccccatcgtcaccatcgtagtatgcgtgccgccgtgtccaggctccggaagaggggctggtggccggcgaggtttcgcaggagcgtttcgagctcggggatgggcaggtatcggctcgcgatggtccagacggtcgcgacggcgatgagggtgagtatggcggtgacggtgatccacaggatctgcctgatgagtccgccgccggtggtggcgcggccggtgacgccggcgagcaccgtgagcgtgacggcgaggacgatcagggtgccggtgtcccatgagtccagggtccgggtcattgcgtcggcccatcgggcgagttgttcgatgatggttcctgccgtgtcttccattgcgggttcctttcctccatggctgcggggttcggcgtctccacgcggggcgtcgggttttccggccgattacggttggccttccgggttttgccggggttgacgacgccgcttccttgtccggtgatgcgtgcgtcgaggttgcaccaatgctgttcctgccggccggaccggcccggcggcctttgcccgatgggctggtcggggtcgtcgatgtgccacatgtcccggtagatggccacgtcgcgcagcaggttgtggtcgccgtgtttccgcgccgtttccatgacggtcctcgaccagggctgttcgcccgtggcggcctgtcgggcgagggcgtcggcccgttgggtgatgaggagttcgttctggcgcaccaggtcgagggcggcggtgtttctggatgccttgatgggcgggatgatgccggcggtccagtcgtcgcgcaccgcgccgttgagccggtcgagcaggccgctgctgagccggccggccatgacggcggcggggtcctgccggtttccgtgctcgtccttggggctgatgtcgcggctgacgatggccatggcccgcttggggtcggtcatccaggcgcgggaccatagcgcgcgcagccattcccagttcggggacctcgtgatcatgctcacgatgcccgggttgtggcattggcggagtttggcctcgaggtgggggccggcgatgaggccggctgcgtagtcgtgttcgcgcaggagtcgtgtcaggctgtatctctcctcgtgttcgtcgatgcgggtttcggtggcggtgcgcgtgtcggggcgcgtcaggagcgtggagagcatgcgttggcgggcgatggcttcggggtcggtgtccgatccggacagcatggcttccgtctgccgggtcttctcgtccttgcatgcgtagaggaggtggttctcctcgcggcctcgtgtggcggccacgtattgcaggttgcatgggacgcgcgcgtcggaggggaacatggcggcgcaccggtcgacggtcatgccctggcttttgtggatggtggtcgcgtacccggcctcgcagttcgttttcgcccagtcccggggtatggtccattgccttccgtccgcgtcgcggcatgcgatcgcgtccgtgtcgatgcgggtgacggtgaacgccatgccgttctcgatgcggtgtccgtcggggccacgtacctggtggtcgttggcgcgggacacgatccggtccccggctcctatcttcaggccgtcggacagcgtggcgaggcgggacgggtccccgtcggacaggccgagcacgcgccgttcgaggatggtgcgctggttcatggcgcgcacctgttcgttggtgccggcgacgaggagcgtggtcttgcccgtcttctgccattgcagggtcatccggtacgcctcctcctcgcattcccggtcctcgccccagtggagacggtggtgggccgcgtattcggcgacgagccggcggcatgcctcgacgctgtccggtttcgcgcggtcgccgccggcgcgcaggcgcagcgtggctttgccttcgtctgcccatctggcccgtccgccgtcggggtcgttcgcccagagcccggggtcgctgcggaagcgccacaggctggtgagggtcgcgcaccggtgttcccgttcggcccaggcgagcaggccgcccggggcggcgggcgcgtcgagctgcatggggtcgccggtcagtacgagcctggctccggcccgttcgcacagttcggcgatggcgtccagttccggggtgccgaccatgcccgcctcgtctacgatgacgagctgtccggggtggatgaggccggcctgttcccgggcgtcggattcgctgatggcgcggcgtatccggtcgcgttcggcgggggtgcgcgccgcggcgagccggcaccggtattcgcgtcgcaggtcgtcgatctgcgcccggtgccgttcggatacgttgtcgaggagcttggcgatggcgatcgcgttggtgccgatgctgtcggcgagctcgtccctggcccggacggacagggtcaggccgagcacggatcccctcccgtgccgggtctcccatgctcgggcgacggcgcgcatggtggtcgtctttccggtgccggcggggccgatgagcgcgctggccgcgtgcgggttctcgagcaggtatgcggcggccttcgcctggtcgtcgctcagccggtttccgccggcccgcatggactggatgagccgggtgccctccccgggtccccaggcgagcgggtcggtccggccgaacgtggccatgacgcgtttttccatgtcgaggatcgtctggctggtgtatcggtcgagtgtggggtcgtcgaacgtgctgcgtccggcgcggctgacgagcgcggggtcgtcgccggcctgtcctgcacggtagcgggtcggggttattttcacgcagcggcggatggcgagttcggcgacctggttggcggtgtcggcgcgggccgtggggtcgagccggatgtcggcgaggaggcgttcggcttcggcccggatgttgctgagcgtccatgtggcgcgggtgcgttcggtgtgtgccatggcagcgtcggcgagccgttcgagttccgtccggccgggtgtctggtggtcggcgagctgtccggcgaggcggatgcccgcggcccgggaggcggtctgtcccagttctatggtcctgtcccggtgcgagtcgaccgcctgccacatggcgtcgatgctggtgccgggggcttcggcccgcagtttgccgtgccatcgtcgggtcagttctgccagtccgggtcgggcgtcggtcttgggcttgcgggtttccagccagacctgtttgtggagttcggcgcgtcgtttccatccgatcgtatggccggtgcggcgttcctcctcgtcgatgatggcggcgagccgggtttcgatctccctgtcgcgtccgctgaacgcgtcgatgagctcctcgggcactccctggacctcgccggccacggccctggtgccgcgtccgcgggcgcgggccggttcgtgccaggcccagccgagtcgttgggtgagcaggtccttgacgaggttggcgttgtattcgctcagttcgacggtggccccgtagacggcgcggccgtcgagcgcggtccattggccgtccgtggtgcggcgcacccggttggagatgaccaggtgcgtgtgcgggtgggggtcgccgtccctggagtcccagtggtcgaaggcgaagccggcgaccccgtcgcaggccgtgctggcgacgccgccggccccggcccgggtggccgcgtattcggcttcgaagtagccgatggtcatgtcggccgcctggtggaggcattcgtcgatggcgcggcgcgtgtcctggtcggcgaacgcccagaggatgctcacgcttttgggcacggtctgggtcaggtcgtatccggcgatgggcggctgcccgtcgttgtcggcccgtatgccggcctggtcgaggctgcggccggtttcggggtttcggcgttcgttgatgagcatgcgcacggtctcggcgccggcctgccgtccggtctcgccgccgagcagccggctggccgatccgatccaccggccgggcgggttgccttcggcgttgtagtaggcggctgggtcggggcctgtgagcggtccgggcgtggcctcgtcgggtatggcgccgtcggcctggagcgcctcgcgcgtgcggtcgaggtagtagtcggcgctgctgagtttggtcatgctgatggccatgcgtgctcctctcccttccctgcggcgccgcgggccggtccgtggcggcgcaggagtcgttccgcgtccccgtcctcgccggtccggtcgcatgcgtcgatgatgcggccgatctggccgtcgggtcccgcctgcgtgagggaccgggggtcgtgggtggcggcgagcgtgagcatgcgcatgagcaggatgtgggtgcgggcgcgcgtctcgatgccatgtcgccgtatggtttcggtgtccagttcgatggcgtgcgccctcgtcagcaggtcgtcggcgttcattctgagcctttcgatggttccggcgttggcggcggagcgcagcgtgcgccgatcgcgcgccgtcttgtagtcatgtgccttgcggcatgcgtcgccgcagtattcgcctcgcgtgccggtatcgagccgtgcgccgcattcgtggcacgatcgccgtgggcgggcacttgtcccggtgcgggtgagccggttccacctgttgcggcaccggtcggagcagaagtcgggcacgggtccctgggcgggcttgtacacgggttcgccgcacatgcggcagtggccggccggcacccgtcccggttccgccttgcgcgcctggcgccggcatcgggccgagcagtacccgtccgcccataccagggtctcggggtgcgggcaccgggcccatctgcatcggccgggtctgggccattcgcttgtggcccctgtggtccctgggcggtcgctcatggcctggccccttcgtcgagggaccaccatccgtggtccgcgccgttgcgtcctcgatggtcctcggcccatatgccctcgatgatccggtccatgccgacggcccgcgggcccgcgccgtcgtcgtggtccaggtcggcgcgccattcgtcgtccaccccgggcccgggttcgggccacatgccctcgagcgtgtggtcttcgcccgtgtcggtcatggccgggtccatggtccatgggcgtggacccctccagccggtcaggcccgcgatccggtccatgcccttgcggccgatggaccgggccaggtccacggcccaccggtcctcgtatgccatgagcgtttccggttcgagccgcatgagcgccgccatgcatctgaccgaccagtagcacagttcgaccgtcccgtggtcggctgggccgacggcctcgttgcgccatgccacccgccggcgcagttcggcggccgcctcggcgacgtcgttcctggatgccatcaggagcgactcctgcgacatgcggcgtccgcgttcccgttccttcctcagctcctcccggcgccggttccggcatgcccggtggatcgacagcggcttcccgcggcgcgggtcccgctcctccaccgcgagcccgcacaccgggcatgcgggcggctcctggatcatgttcccatcgttcatggcgcccccacccggcccgcgtctcccgtcccgtcgataacgccgaaccccgatatcggacgcccggacggcaaacaccatcaaaaacgttgccgttccgccgataggcggccgccgcgaggcggtgggtgcaagaagtccatctccttcggagattgcatcgggatgtgctttttcttgggttttctgatggcgtcgtaccttgtgactggctgtgtgggttcttggttctgtcttcgttgtttctggtttctgtgtcgtgctttttcgtctgtctgggtgctggttttcatgtcgggttttatttcgcgtatgtgtctgttgtgccgctgtttgttcggggccggctgccgcagggaggccgggcatggtgcccccggcgggtgccggctcctgccgaacggggagacgtccacggtcgggagcctgctcgtcgactgtcggggatgcggcaccggtcccgggcgcgccgcgcgatgcgcatggctccgctccatgtgcgtttggggagaccggcccgatggcgatgggctctcgggccatggaccgcatgaaccgggtccacccgccgacctgcccatatggtccttggaccgtggcccggtggacagggacgccatcgtccggcccggtccatggaccaggggtggtccgcgtggccgtccccgcatgggctttcgcgtggaccacgtatttggttggtccgccgaatggaccgtggtccgtcagggtggtccgcgatgccggccctcacatgggctttcgcgtgggccgcatgattggtccggcatgtggaccattggtccattcgcatgatgtggtccggaagcgcgcagggcatgctgatggcccacacgcatcgacgtggcccattcggcctcctggtccttggtcccggacgccggccatggcccacacggcgtgggcctgatcgtggaccgggccgtcttggatggcccatggcccctggtcgatgccgccctccgtgtccgatcggcccgtccggccgatagtaaagggggcggggccgtcatcggactccgtcccctttatcgtgtgcgactatgccaggtccttttttattcttcttgccgctttcttgtggacggtgttgtcgtcacgaacggaaacgaggttgtccaatgtgatgtttcccgccattcgccctgctccgatcggttcaaaaaaatagctattatcgtgatgataatcgtattcacgttttgctggtcggtcaggggaggacagggcccgtccggccccgccatcccatgccggtcacttggtcggcgcccaggggtcgattccggtctggggcttcggtgtctggtatccgtcggcggggaagtgtccggtgttgcgtacgtagttgacgaggtcggagtgtgcgatgtccgcccaggggtcgtttgcggtgttgtcgagggtcttggtgttcatcttcgttttcctttccggttggtgacgaccgctctttgccgcggtgcgcgtcggggcgtcaatgggacgcgcggggccccgcaggggtcgcgtggaccgttgacgtcccggcgtgcgccgtggcatggtgcgccaaggaaccgatcgggaaggaaaacgaagatggacgccgggacccgggccacgtcgtcgtcccggcttggttggatggatgccgtctccatcccggttcgtggatggcgttgtcgttgacggcatatggatgcggaagggctggatgatggggacggctgatgtcgatcgcttctcgtaccggtttcgtcggtccttcgaggatggcgggcacgtcgacgcccgtgtcgaactgtccggatcgagatggctgtatgtttccacgtccacggctttggccggcatccgtcgcctcgttgccggggttctggcggacatggattcggtgttcggccgtctttgatggacgtcacccgttcctgtctgaaacgcgaaggcggggcctccggcttatggatggccccgcccgttttgcttccctgtgattttccgatcactcgtcgtcgggtatggtgtcatggtcgtagatgccgaccatgcggatggtgcgtttcgcctcgcgtctgaagtagaccacgagcacgtcgtcgtcgaaggtgtggaactcgaagtggtttccgtccccgaacgggctgcgctcgagcgggtggtcgtgccatccgctctcctccacgcgccccttggccgccagttcgcagatcgcctcccttatggatcggatgatggacgcgaactgttcgtgggtgtatttctccttgaggggcagcgcggtccgccagaaatgcggcgaggccttgacgctccagttcactgccccacctcctgtgcggtgaggccgagttccccgagcacgtcgtcggggatggttcgcgcgtcggtggcgtcgtcagcgaccagcccgtactcctgggcctcggcgagcagcatgtcgcggcgtacgtcctcgccgagttcgcgtgcggccggggaggagaagacgccgtcgaacggcgtgcggttctcgtgggcgacctgggtgaccatcatcttcatggcggcgggcgtggtgatgccgttgcgcgcgaaggcggcgtcggcacgcgctttgacgtcgtcggggacgttgatctggatcaatgccatggtaagcctccttctccttatgtgttttccatataatatcataatctgcttggtgttgattcgggaatgataccgataccgttcgtccatgtctcggcccatgccgtttatttgaatcgttcctggatgggccgcagcgccccggtggcggcgagcaggagcgcggcctgcgcctgccgtcccgtgcggatgccgtcgagccggtatcggcttgtcgccttccatatctcgttttcgcgtttcacgtcgatcaggagcatgtcccgtcggatcacggtgccgtcgatgctgcggacgctccatgtgcacagccaggcgtggatggcgccggcctcgatggggcagccggcccgctggcatgcgtccagggtcgtcctgctggggatgatctggcgcggctgcgcgccgatgggcgggcggatccgctcgtccatcgcatcgaacgccttcgccgctccttcctcgtcgccggtgtcgatccattcgtccatggcatgtcgccgcatgttggcctcttctccgggtgagggccggcccggcgtatgtgtgggccggccttggtcgtgtgtggtcgtcgtcagatcgccggctgctggggtgccgcgggcgcgaacccgtcggtgaaggcgggctgcctggtttgggctcccgtggcgttccacgggtcgctggcgggcgtcgtcggctgctggggctgcggctgggccatgggctggctcggctgtggagtgcgtcccgcgaacccgttgtcgcgcggcgccttgttgtaggcgacggtgccggcgcgcaggctgacggcgaggtcggtggcgcgcagttcgaggatgcttcgtttcgctccctgctggttcgtgtattccctttgcacgtagctgccggtgacgatgacgggcacgcctttctgcttgccgtcgggtccggtcggcagcatgctgtgctgcaggtgttcggccaggtatccgctggcggtgcaacggatccatgtggtggcgccgtcctcccattggccggtctgcgggttctgggtgcggctggtctgggcgacgtcgaacgtggcccatatgccgccgtcctgtcgggtgtggaattcgatgctgccggtgtttccgctgatggtcagcgtgacctggttgatggtcgccatgatggtgttcctttccttgcgggttatggctgttctgttttcgggaggcggcccgtgccgtcttccgtgtgggtcacctgtcgccggcgcgatagcgtcggcctgcccggctcattggttggtggacaggttgatggtgatgacggggttggtgatgtcgggcatggagtcggctggcggccagtcgtcgatgccggcggcctgcatgatggcggcgaggcagccgctgtgggcggcggcgatctcccattgccagcattgcctgttggacagggcgatgaggtggtcccacatggggtagccgttttcgtcgagcgcgggccggccggcgttgagcaggccgatgagttttctgacctgggcgcgcaggcgttcggcttcgcgtgcggtgacggtgtcgacttgttgccagatgcggcgggtggtctcgtcgtcgatgccgttcgcggcctgttcccatgcctggttcctgaggtcggcggcctcctgggtttcggcggggtcgagggtgaggcttttcctccaggtgatgcccatctgccatgcgccggagtcggtggcctgtgtctggctggtgatggtggccgttatcctgtactggctcatgatggtgtcctttcctgtgtcgtggatcgtctgtccggctatcccctgttttttctttttggcctttcggtcaagcgcagcgttaccggccaaagcgggttccgtccaatcgatcgcgccgggcgcagcccgtctgcgtggcgatttgacgggttccgcgacgccggtatgatcgtttcggcttcagccgaaaaggccaaaagggaaacctggggccgcgcccctttgggggcgttcctttttccgatagggcttgcccgtccatcgtgtttcccgcatgcgtgcgggagaccgatgccggtcggggccggcggctcgggccggcgcggggaggtccgggaggggcgcgtggcccttcccggccgccggaggccgtccccgatcgcctggttggcgcgggcggggactccttggccgtgggtcagccgatggggtggacgggtatcatgaacgttttgccgtcggggagcctgcagggcgcttcggggtcggcgaacatggcggcgtagcgtccgatctgctcgtcgtcgagtccgagggggccgtcctgcgggtggggtcccgtgatgacgaacgtgccgcggatgatgatgggcttgccggcgtccgcgaggcggctgtcctggctgaggcggatggtgcggttcggcttgaggttcctgatcgccccctccccgtcacaccagagcgtggtccgccggtcgaggggcaatggttcggcgtatccgccgatcgtcttcccgatggccgtgatgctggggtcgatgtcgcgcagttccggacggcgcaaaggttcgatgacgagcgtcttgatggtgtccatgatggtggtcctttccttgcaggggtttgcctgtcctcccgcatgggcgggaggacgctgctgttattcgtcgatatggccggcggggatggtcctgcgttgtgccgccctgcggcggcgttgcggggtgtcgatgctcggcggggtgcgccgtctggtcttgcggccgtatatcttccagtcgatgccggcggccgtggccatgatcgctatgacgacgacgttgccgatggcttcggcgaattccgggcttgcgaggtattggctgatgaggtccattgggactccttgtggtttgtcctgagtttgtttccggccttccttggccggcatgtcacgccgtttgcccgccgatgtaggcgtcggcctcggccatggatgcgcagtagcgtccgtagccggcgtcgacccaatggccttgggccttgtggagctggtgcacgtcgtacgggcgtgcgccgtcgcccgtctcctcgacgtcgtaccggtatccgccgcgttcgatgcttttgatgatgttgcgtgccatggtgcttgctcccgtctggtggtcccttgttttttcttttcgaccggttggtcaagcgcagcgttaccggccaaagcgggttccgtcattagcgatcgcgccgggcgcagcccgttgcgtggcgcgttgacgggttccgcgacgccggtatgatccagaggcgaagccgaccggccgaaaagaaaaaggaatgggccggcccgccccttggggcgggttccgtgcgggggaatcgtgccgtgtccgcggcgtggacgcggacgggatgcgatgatgacccctttgggggccttgcatcccgggagcggacatgccggcggcgcggctcctccgtctgatagggcttcgcccgtttcgccgtcgtcccgcttggcggggcgcggcgtctgggtggggtccggcggcgtgggccggccggggtttgcaaaggggcggcgtgagcccctttgcccgccgggggccgtccccgtccgcctgcctgatgcgggcggggactctttcggatgacgggcctgccgtcggcgttttccttctccgtcatgtgagggggtggcggctggcgtcccggttcatgaggtcgcgcaggtcgtcgagcgtgtcgaggcattggcggcgggtgttctccggtgtttcgatgccgtggttggcggcgtggtggtgccagaggacggtttgggcgaggctggaggccttgtgcgccacgtcgtcgagcatttcgtcgagcgcttcggccgtccattgctcccagtgggggtcgtcgtccggcggggcggacagcgcggcgtcgagccggtcgagcatggtttgtatggctttggcgtcttcgaggagttccgcgatggtgccgggttgtcctttcatcgggctcctgacgagggctcgcacgtgttcgtcggggtcgaattgttcggcgtgttcgtgcaccgtttcggggatgggccggcccgaaggcacgtctatgatgaggtcttccccggcggggctgctggtttcgagccattgcccgccggcgaatccggtgtggagcgtccagccctgttgattggcggtggtttcgatggtgttcgcgtgcatggtgtcgtgtcctttccgtcgtggcgtccgatggcgtgtgccgtcggacgccacggctgtttttttctgtcggtcagcgcaggtatgcggggtatcggccggatgcggccatggcggcgaccatgatggcgaggctggtttccgggtcgtcgtccagtgcggcgatggcggcgagggtggcggccttcccgtcgccgtcccaccatgcgaggtaggcggcgagggcgtagggttgggcgacgggcccgccgtgctttctggcgcggtcggccatcgcgcacgcctcccgcaccgcgcgggcgaggcgggtctcgtcggggcggatgtgggggtcgccgaacccgacgttgagcgtttcggtcagcagcgtcttgttgttgaacgagtggggccgggcggccatgtcgatgacggtcgccgtgtcgagcttgggttcgacggcggcgatgagtgcggcgtccctgatggccaggcgggccgtcatgagcgtggcgaggtcgtcgagccgttccgggtccgcatccttgccgtcgagggctcgcatccatgtctcgagcgcggggccggcgatggtgcggacggcttcgcccgtcccctgttcggttgcggcccgcttgagttcctcgatgatgttccgggttgtggtggtcatggtgttttctcctttttgcgtcttttgttttttgaccttcttcggtcagcggatgcgtaccccgcgtaaggcggttccgtcatgaggcgacgccccgccgtcctgcggcgtgtgcggcggcgttgacgggttcgccgacgcgggtatgcttcgatgggtcgaagaaggccaaaccacgtgtttttgccgtgcccgcccttggcgggctccatgcggcggcatggccggcgggcgcgcggcgcggtcggccgggcgcgcgggcatgggccccgtggggggccgtgcgcgtccgggcggcggcgatcgcgcggtcccgccggttccgtttcctttcgccgtcgccccgcgtcgcggggtgcggcgcctgggtgggctccggcggccgggggccggcccggtttccaaagggcggtttgagccctttggcctgccgggggccgtcgccgcccgcccggcgcgggcggcgactctcgtcagcggcgcggtggcgtgtagtcgagcgtcgtcgcgtatccgctgtcggcggtctcctcgatggcggtttcgtatccggcttcgagtccctgctggtacgcctcctcccacaggtcgtatccgatgaggccgttcgtgtcccagttggtgttgctgacttcgatggccccggtgccgcccgggatggtctcgtggtcggcggtgagccattcgagcctgccgttttggtcgatgagcgcgaacctgccttggcttccgtccgtgaggtcggcttgcccggcctgccatgcgagtatcgcgttgcggctgtcggacgcgtgtcggccgcgcgtgtacgagtgggcgatgccgttgtgggcgatgaagccggtgcggtcgcctttgcggaagcggaacgggtgcgtgttcccggtgcacaccctgccgtgggtggcgaggcggaagtgcaggaggaacggggaggtttcgagggtctgccagtggtccatgatgaacgcgagcgtcttcatgttgtcctcgttgcggtagcggtggaggcgttggccgtcgtgccatgcgatgcccgccccgtcggggttggcgtcgctcatccgggcgagctgggtgaggcttggcatggtgtccgcctggctggtgacgatgacgcacatcagattcgctcccttcccgccgtcgtggcgttcgtgtcgttgatggcctgtgtggcggcgacgcggctcatggcccggatgtcgcgggtcttgagcttggggacggggaacttctggaagaaccgccacatggcgtgcatgtaatggacggcggcgtcgagtcttccggaggtgtcgtggtgccacgggccgaacgttcggaattcgatggtgtggcggtgcgtgtcgttgatggcggtgtccttgccgcagtagtcgccgtggatgagctcgcaccagcgggtgtcggtcatgtggcgcatgttcagcgcctcgcattgggtctcgtcgagcgcttccagcgcccagtaccagcgggccggggtctgccggccggtgcggctgatgtgcatgtgcccgcccgacaatgtgttgtcggtgtcggtggcgatgcgttcgacgagtcggcggatttcagcgaggtcgctcatggtcatgggttcgctctggtattcgagggagccgtcgtggtggaggctgccgtccgggcaccagccggcgatgagcctgtggttcctgagcatgtcggtgtcgtggttgccgtccacttcgatttccagtccgaaggtgaacggctcgcggacgggccgtccctcgtacgggtcccggtagcaggggtcctgcgtgttcgcgcaggcgtgccgttcgtagcagtaggggcagtagcgttcgtcgcactgctcgcagtattcctggcagtccgagcacaggcggtcgtcgcacatgcggcaccggtacccgcagtcctcgcacaggctgtgctcgcagtgctcgcagtagtatgcgcagtccccgcacatccgcgaaccgcattcgttgcatgtgcgcgcgcagtcgtcgcatacagtgttgccgcacccgcattcgacggtttccgtccccgcgcagtccccgcatagccatccgtcgcagtcgtggcaccgtacggcgcactcccccgactggcgttcgcagtgcccgcaccgacggtcgtccctttggatgtcatggttgtttccggtcatttgtcacgctcctatgtcgtcttgtcttccggacggtgcgcggcgggaccggatggccgcggcgcggcgcaagccgcgtggccggtcggcccggtgccgggaccgccttcggcggcggcaccggccggcagacacgcggacgcttgcgacgcgccggacgtccggtcatgctgtgtgccggccggccgggccggggcccgccttcgatggcgggaccccttttcgacgtgctcccgccggatggcggggcgcggcggcggatccgcgagcccttcggggcgagctccgttttcggcggcgacccggatccgactggacagggattcccaaaacaggtatcattgtttcctgtagtaggaaatcaaggtctggagggatcatggacggttcgttgtcgcggatgcgcgggaaggcggacttccgcctgatgcgggagctgctgggattgccgcaggagtgggtcgccaagcgcgtgggcgtggacgcgcgcaccgtccgcaactgggagagcccgaggtacttctatccgccgaagcgcgaggcatgggacctggtggagggcctgtggcggcggaccgacgcgaaggcggccggcctggtggagatcgcctcgtcggcggcccgcgtggcgcgggagcgcggcgtcgagccggcgccgctcatgctggcgtactggcgtgacgcggcccagtgggcgaaggcccatccggaggacgaggacgcgggcatgtggcggatcgagaacgcggcggcgcgcctggccgcggaccggctgcacgccatgggcctgccagtcgcgatcgcgtacgcggagcccgaggcgtgacggatgccccctatctcatgtcacgatagggggtatttgacttccatggttcgattgtatagtttggaatcaaggccttggcccatgctcctcttcccgtccggaggtcggggttgaagccgaagtcttatcggaggattggctgtccgcggattccccatgaaccggccgtgcggaacatgcgttgcgagaattgggagtctagcccctgcgaacgggtgatacggatcgacgcgacggcatcgattcgagttcgtgtccgacccttttgggtagtcatgcagaagaccgaaacaacagtcctccacaacccgggaacgttaccggtcttgacgttcccgggtttttatcgtctttcggagaggggcttcatgaccgccgcgtcgcatagggggtcggaactcgaccgctcccggaaaaagaaactcattcccatgtatcgcgcggcggccaagaagtacaggccgctgatcggccggcattcccttatcacctgcgaggatggcctcgtcatcgacatcctatgggagaagcgcaacttcgagcatctgtgcggcgtatggtgcgacaggccgccgcaggtggtccatgccggaaagaccatagaggccaattatttcttcgaccagctgatcaagggacgccttccctcctcggccatacattactccgattatccacggacaagaggcaaggccgaggtgctttcgaacgcgttggaccttgaaggcaacgtggatgtggtggtcgactccgacaaggccgaagtggtgtattacctcggcggcgaggcgtggtgcctgggattggattccgattggaacgggaaccggatgcggtcgggcctttgcaacggcaacgtgttctaccccaagagcattcgccgtcagtccgtatataaacgaatgaggacggacagcatcccccatcgcgtttcagcggtggaactggtcagcccctgagtccttgccgacgtacgcccgaagccttggcagcgatcgcatacgcggagcccgaggcgtaggacacgaacggcccatccgacatccgccgtcgcggccgtccgcgtccgacaacagatcctcattgactcttacgtacaaacgccgtacggttatggcatgacggaaatcaccagcaaggccagccgcttcgagatgcggctcacgccatcacagaaggaacgcctcgaccgggcggccgagttcaggggactcagcacctctcaatgggcgttgaccaacctgctcgtcgccgccgaccgggacatccgggagtctcatgtcctccatttggatgacgaggcgtgggattcgttcgtacgggccctggacgagcccatgccggaggagatggtccggctgctcgagagcgagccgatctggaaatgaccgatttcaccccgccgcggcgtctgaccgccgaggacgacgccgacggtttcgactgcggcctgccggttgtcaatgactggctgcggaaccagttgagaaatgccggcaagcagcatacggcggtcgcctatgccacgttctgcgacggcgcgccggccggtttctacacgttgggcgcgtacagcatcggccatgccgaggccaatggctggctcaggaggaacagcccggatccgatcccggcgatccttctgggcatgctcggcgtggccatgcgctaccagaccatgcacgtgggggcacagctgctcagggacgccgccatgcgggcgatgggtgcggcggagatagtcggagccaaggcgttgctcgtggagccggcctcggacagggccacgcgcttctacgagcattacgggttccgccacatcgaacggtcgggcaggatgttcatccctctccgttcggcgtgaacgggatgcccgtagaagagggaggcggggagggccgtggacggttctccccgcctccttgttttctctcgaatcgttttcgtcggcccgccgttcatttccttggcgggcgcgctctgccgtccgagtcgaattgggcgagctgtccgatggcgttgccggtgttggccagggccccggtgagcagtcggatccgttcgccggtgtcggcggtccggagggcgagtctgagctggtcgatggccgcgttcacgtggttgcggtagacgaggtcgtcggccgcgtccgaatgttccgttttcgcgggccggggttcgtccatgcgtggtttcccttccggtgtttggtccatgaggtcgagcgcccggacgccgaggccggcggcgaggtcgaggatgatgcggctgcgtttgctgccggtggcccatcggcgggtctcgatgcctccgatggtctgcgtggtctgtccggcccggatggcgagttcggcctggctgagaccttgtcgcgtccggtgccaggcgaggcgggtgccgtcccatccggcgggcggattgtccgtggcatggtccggttcgggccggccggctagcttttccatgctggtgtcgagcgcgatggcgacgcgggcgaggatcccggccgccatgttcgcggtgtcgcgttccccggaatcgtattggcgcaggctccggtatggcacgttcgcgtgtgcggcgagctgcgggcagctccatccccgttccgtgcgcatcctccggatcacggtggtcgcgccctccccctcttggggcgtctcgcccgtgagccgggcggggttgacgccgagggtcttcgcccattgccggatctggtcgggttcgagcgtggacagcggggtttcgccgttctcgatccgttcgacggtcgctgtgtcaacgccggtgagccgtgcgagggtctgttcgaggacgctttcccgttccctgatcgcgcgcagttccgccgcgccgatggggatggtcctgccgctgccgctcatctgtcgcctcctaggtagatgtcgaacaggggcccgggttcgacgaggccggtgccggtgtcgatggcctggatggcctcgagggtgccgatcatgttccgtacggcgggtctgcttcgggcggagaacgcgccgtgcccgtcgatgagttcgagtccctgttcggtgacgctgcggcgggtggatccgtgcagggcggcggcgagcacgctcggtctgacgccgtggccgagctcgcgttggatgttcgcgatgtaccggcatgcgatgcggatcgattcgcggcccatgggctcgccctgtccctcccccgtttccggtgccgtccgccgccggcggtacgggttcgacgccggttttttcacgatctccctaccgtcagcctggcagttggagcagttggagcagtcgtcgcgtctggtgccgggcgggtcgaacatggcgaggatggtccggcgcaggcatcggcgggtctcgcagtatgcgctcatggcgtcgagtcgggagtccatgagctgcgcggccctgatgcgtgaggggtcgccggattcctcggcgcggcttttcgcctcccatgcggcgtggcgcagccatcgccagtcgccggggctccagtagaggaccgcgtcggcaggcttgccgtcccggccggctcggccggcctcctgccagtaggcttcgaggcttttgcacggcccgtcgttgaggacccatctgacgtcgggcttgtcgacgcccatgccgaacgcgctggtggcgcagatgacgcgcgggtggccggcgaggaacccgtcctgcacccgtttcttgtccgcgtccctcatttcggcgtggaacgccatggcgtcgatgccttcggaacgcagtgtctcggcgagccgttcgcagcctttccggttctccttgtagattatgccgctgcccttgtgccgtttcgcccaggcgatcatggcctcgaggcgttcgccgggcctggcgcggaccaccgtgaggcgcaggttcggccggtccgcgtcggtcgtgaccgtcacggggtcggccaggtgcaggagttcgcggatctccccggcctgcgtccggcttgcggtggcggtcagcgccatggtcacggggcgcggggacagggagtcgatgaattcgccgatgcgcatgtagctgggtcggaagtccgatccccagtgcagcacgcagtgcgcctcgtcgacggcgagcaggctgatgcggatgcggtggctgaagtcggcgaagtcgggcgcgtgcaggcgttcgggtgcgacgtagaggatgcgcagttcgccggacagggcgcgcccgtacacctcggcgcgttccttctcgtccaggccggagtcgatgagcgcggcgggtatgccgcgtgatcgcaggtgccgcacctggtcgcgcatgagcgccctcaatggtgtgacgacgagggtgaacgtgccgggcctggcggcggggagctggtagcacacggacttgccgccgccggtgggcatcacggccatgacgtcgcggcccgagatgaccgccccgacggcctcctcctggcccgggcggaacgagtcgaacccgaaatagcgcttcagcgcggccagcatgtaatccccgttcccgaccattccgcttcccttcttttcacccataagtttgataccctcaagtatagcatattcatcgccttatgctggggtgtcattcccggctatcgccgtccccgcgcgcattcccgggtgtatggtgcggaagcggggtggcatggtgatcggtccggacggttgtggtttcgacatgcgttcgccttcggagatggaggcggatgacgcgcggcgtgaggcggatgaggcggcgcatgcgcctcgtatggcggtcacgtcgcgtatccgccgggtggcgcagccgccggatgggtatctgccgttgtccctgttcgacgaggttcgtctggccgatccggtgccgttgtatgcgttcgaggacgtcccggcggacgtgacgggcctcgcggtggattacctgtcccgtgtggcgcggggcgtgccggcgcgggatgcgttccgggtgccgttggcgggggcgcggctggtgggccggtctgcggatgcggaacggctgctcgccatggtggacgggttctccgaccgttcggtgcgggccgcgtgcctgctgtgcgggttcgacgcggcgtcgcgtcggggcccggcgaggtggcgggcgggcagggtcgtcgatccggggccggccacggtgtataacgtgcggcgcatggtggcgcgcacgttgaggttcatggaccgggtggggccggtcgtgtgggaggggttcacgttcgacggcggctacacggaccgggtcacgtccggcgacggggacctgctcaccgctgacggcctgtgggatctgaaggtgagccgttggccgccgaacccgacgtacacgctgcagctgctcgtctattggcggctcggcctgcattccacgcatctcgagtatctcggggtgcggcgtctgggcctgtacaacgcgcggtcggacacgatgtggagcgttcccgtggcccggatcggcgccgatgccgtgcgtgcggtggagcgggatgtgatcggctatgcggacggtctttgacgcgtggccggccggttctattcgcgggggttcgtggccgggagttccggcatggggcgggcgagtctggcggccgcgtcggcgagcagccggcgggcctggtccacggtgtgggcggcctcgtgttcgcgtcggtcggcgtccgcgatccttgccttggccttcgtgtcgattcccgcggccttctcctcggctgttttgaggatccggtcggcttcggtgttggcgtcggacaggagtttctgcgcctgttcgcggctttcgccgattctcctgtcggcttcctggtcgatcccctgtttgcgccgcgtggcctgttcgatctgttcgtccgcttttttcttcgcttcggcggtcagggtcccggctttggcccgcgccttgccgaggatggtcctggcttccgtttcggccttgtcgaggatggccttgcgttcgtgccttcggtgtctgtcatgatggttcctttcctgtcggccggtgcgtttcgcatgggtcacccgcgccggccgcgataatcggatccacgtcataggtatacgtgaatatgcgtttttttgatgattcacgtatacttatgttcatgcgtagggagttggcgatgaaccgcctgagggatatggacacgggtttcggcgtgcacgtgtatcgcaagccggatctggcgctggttctcggggaaacgggacaaaggctcgaccgcaccttgtcgagcctggtagcggcgaacgtgctggtccgcgccgcgcgcggcgtgtacgcgttcgcctggtcggcgcatctcggggaggcgacgctgcataccgtcgcacgccggctgcgcccccgacagctggtgtgggagagcctggagagcgcgctgagccgttggggcgtgatcagccagatcccggtggatcgcgtcacgttcatgaccaccggccgtgagggcttggccgtgaccccatatgggacgatcgagttcacgcactgcgcgctcgactggtcgaggatactccccaaccttgtgccgcgtgacggtgggatgacgccgctcgcgtcgaagcgttgggcgtatcgggacctgaaggccacaggccgtaacctggatctcgtggacatggatgaattggagaacgacgatggatgggagtgacatggcgttcgactacaaggcggtcgcggcgggcatcgcgcgttcggaaggcatgggtgccctgcttcccgtggtggagaaggaactgctgcattaccggatactttccgccatgcaggacggcggcttcttcggcccgatcgtgttccaaggaggcacgagcctgcgtctgtgccacgggtccccccgttacagcgaggacctcgacttcgccggcggcacgggtttcggcgtcgatgaccttcgggggttgggcgaatgcgtcaggtcctccctcgccggcatgtccccggacgtgcaggtgaaggttcgcgaaccggtccgggacgagggcttggtaaggagatggcgcatatccatccgcacggcggcgcaacgtcgtgatctgccgaaccagtcgatcaagctggaggtcgcatcggtgccggcgcatgagccgcagacgaggccggtcagggtcaattatccctccgtgtcggcgatcgccggggacatcatcctggcggtggaaagccccatcgagatactcgcggacaagcttctgtcgtttgcatgctcctcccatatccgccgtcgtgacctgtgggacatgtgctggctgtcgtccagggccgacgtggatgcgtctcgggcgttccggatggccacgctcaaggctggggaatacggggaggtcggagaatgggaggcgcgcgcaggccggctgcgtgagatcccgtcggtgttgtcttcggacgcctttctggacgagatgcgaaggttcctgccggcccgaatgctcgtcgccaccgtcgaatccctctcctggcgcgagtacgcctcgcaggcggtcaccgggctgtatgatccctccgggcccgcatgggcgtcgccgtatggctcgccgggtttcgggcggccgatgcctgagcccgaccagtcttccgccgttcccatgtggcgtgacgggggtcccgctctttcctgaggcggcgtcctcgccccattctcatctcatccgcagcgcgcgcagcatgcagcatggggttatggtatggttcggtgacttccatgaggcgggtcggccgcccgtagggcccgtagacggtgatggcgggttcgaccgggcggatgatgccggcgcgttcgagttcgagcagcgggtatgcggccggcgggtcgggattcgggtagaacctgccgtccggcgggatggccccgtcgggctcccaggagacgtccagcttcccgccgggtccggtgacggtcagtcccatgccgccgccctggtggcggccggcgagcaggcgccaggtctcgagcgcgtccgtctccccgccgtgttccgggtcggcgtgccagggtctgccgcgtgtggcgagcaggtggcggcgttccccgtcgaacctcgccgcatccagtcgcctccatgtccaccggtcgacctcgaagcggatgccgtgtcccctgatgagaggcggcacggccccggtgacggggttcacttgcggcctccgcggatgatgtgtctgacgcacatggcgagcaggacgaggtcgagggcggcggtgacgatccacagccatcccatccgcggcatgatcgcgcattcgatgatcaggaggatgaggatggcgaggcatgcgagggcgaggaggatggccttgcggcgttcgtcgtccatcactcccctccgtccgtctcgtcggcccagtattggtcctcgaaccagtggtcgaagcgcatgtcgcccgatccggtggcggggtccgaggcgagtgtggcctcgtcggccgccgggtcgtacaggcggtcgacgtcgaggtcgccgagccagtcctcgagccatgcctcgagtccgccgccctcctcgttgtcgtcgtcggcgacgagcctgacggccctgctgatgaggatctcctcgatgacgctgtgggccgcatggttcgcggtcgggtcggcgaggcgggcgcgcaggcgtatcgtggagccgagcatgcggtagaggaattcgcggtcgtaccggtcgaggtaccggtcgggcaggaggtccgtgacggggttcccgtcgtcctggccgaggtgcgtgccgcggggcatgcggcccagacgtctgatctcgatcctcgtcatggtctcgatcatggacaggttctcgtcgaacagcctgcgcatgcgggtgcccggcatggggtggtcgccgccggtgtcgttgttcataggttccttccttacttcgtgtatctcgtgtattccccgtggcgggtgccgatgagcgtgatctgcgcgtccacgatccttttgcgccgttcgagctcccgtatcccccggttcagccaggcggacagttcgacgcagccgacggtggccgcgtcgcaccggcgcaggtctcgggcgactccctggaccgcgagctggatcacgccgcagttcttgaactgcgtggcggcctgttcgagccggtcgacggggttcgggcccgcgctcatcgggcggtcccgtccgccatgcccagttcgagccgtcgcagccgttcctcgagtgcgttgatgcgcatggtctgggcgagcaccacgctcatcggcgcgggtcttccctccctgccggcgtcggcggccggggcgtgcgggcgcgtcgtcccggcgtccggcggttcgcgcttccaccgggcgatgcaccgttcgatgcgtttgttgccgatgatgcgcgggtccagccccgcctcgcggaagatcctgacggggctttcgccccgccggtagcgtgtgacggcctcgcgtttgaacgagtccgtgtaggtgatgcgcgtgcgggtgacccatgccacggcgtccagtccggacagcaatgccatctcggcgtccgagaaacccgtcatgcccatggcgtccccgcctccggtgcggtccctcccgggattccggacactcgtccggccggtctttccgtcctgtggtcctgcatgtgcggctccttgcctctccggggccctgccttgtggccccttcgcccatgccacccgtggccccttctatatcgggggattcctccgccgcgcaagaccgatcttccttcgtgtccgcagccccaaaacaaaatgttgacaatgacaataaacaacgttattgttgtcaacgtcagcaaaaatattgctgacggctgatagtcgaaggattatcgcagataaaggataagagaacagagccgctccttgagaagctcaaggaacagggatggcgcatcgaagccaagaagaaaggctggatgtgctacccacccgacaagtcgaagccgggcgttcccatacacaagacaccttcggatgccagatggtatgagaattgcttgaaatacctgagacgcggcgggttccacgagtgagcggtcgctaatcttgcggagacgaagtttcctaggcttgtcaccgcaagattagcacaccctctgttcccccatcaaccttcgaccgctagggcggctggatggcgtgcgcccatggaggcatctcccggcgcacgccatgcaatacatcggataggtgaaacatgacgagagcacgagaatggcaggtttcccttgacttcaaggcgagactcgacgaggacgcggcgttcgacctcatggaagccctcggaagatacggggcctcggtggcggtcgaccccgggcacacgggcggcggactgaccctcgccgtcgatgccccggacggggagacggcgctggccaaggcgcgcacgctcctcgaagagaacatgcccggcgcatcggtgacgggactcgaagcgagggaatgggccgacgccgtggcgcgaaaccgcgaacccctatacccgccggtggtgggctacgccgagatcgcgcgcatgaccggcgtcaccagacagagggcgtacgcgtttcccaggatcgaatcctttcccaagccggtgatagagacctcacagggccccctctattccgaggacgcggttcgcgcatgggcgcagacccgcgagctcagacccggacgtccgaaagcgatggaataggaaacgatgcgagagccccgcggccgcacggcgcggggtttattttttacaaggaggaagcggccgttccccgatggattcgtcgggaagggaatcggccgtcaccaggtccggtccggttggatcacgggacgtgtggcccggtccctgagccggaatgattgggtcattcgcgcatgggctccctcgagcatcacggtccaggtcgtcggggatacgatcctgagtccgatgccgttctggaatgccaggatgaggtcgttgcggaccggtgtctgtcccttgttccggttctccacggtgtagcgcacttcgagcaggtccttgcggatggcgtattccacgtccgtcaggagcagcccgtcatgttccccgtattccaatggacagggtgcgaattccgtgcctcggggtacgtgccattccctccattccgcgtgttcttccaagagcaaccccacatatccgacggccaaagcggtcagtacaatcaacacggcgatgacaacaaagctcattttcccctcccgcagaagaaggcatgacgaatatggacgaatctagaagcggacgagcattgaattccgcggaaaaggccgaggcggatgccccgaccaacaagcaggggctcgataccatcggcggcccgacgggaagccgccgatgattgtccgattccgatgaccgtcggcattgttttattgccgatatcgggctgatggcggataatcgggatcatgaaggatggaatcaatcaatgcgggggttccggcatcgagtccgttgatcatttcgacggtgtcggaatcgtcaggatcagaccagtggtcaataaggtggagataaagagggccaagcgtctgattgtcgaacagatccctcatcttgccgatatagaattcccaaagcggccggtcgaggatgacggcacgttgaggcctctttttataggggcgttctccaaggacggcctcataggcgccgccttcgtcacgccaggaatacaggcagcccagtcgttcctcgggtatttctccgcgtcggccggagcgtatcagtgcgcggagcttgtcaggcgtacggtcgccgaagtcgaggggatcgcagtcgtcgacgagtacaggcgcaggggcgtcgcactcgccctgaaaaggtacatcgatgcctgggccgccgatcacggcgcttgtctcgtattgtccgtgcccacgaatgaggcagcgcgtggcctcaacgagaagtccggccaccgcgtcctggagcccgatgtccttctcatgcttcaggtcgtatatgccgacggcggtccctgctcccttccctttgctttggaacgtgggcaggaggcaggatacagttgctgggcattccttccaatcgccaaacctgtttgtgttcaattagttgttgcgggtttagtcacgatgatttttcgggtttaggaactcccaatgaacacgcctgattggacggacgtgggcagtggggttagggaaaactattgcctgttccagattgcgatccagcttccgaatatcgcgaccctcccgcaccagcggttgtctttggtgttccacaggcggaagcgtatctggtttacgtcgctggtatcccaacgttgtgcggtgtactcgccggactggccgaaaccagtgccgaacggcccaatcgtgtaggccgcgtaatcggctttcttcccgtttggggattggacgttgatgtagaatgtgccgtcattattcgtggtgatggtatggcctccgcacagaatatacggcattcgggttagggaatcctattgcccgatcagcgcgcgttcccagatgctttgggcctccttgagagacgcgatttccggtcgcagatagaatctggcggtcgtcttgatgtcggtgtgaccaaggaacttgctgaccaccgcgatgttgactcccgcttccagggcgttggtggcccaactgtggcggagattctgcaccggcacgtagggcagcgactcctttttgcaccatgaggcgtagcgtcgcgcggcttgcggtggggtcaggtcaccgatgatacggcccttccggccgttgcggatctcccgcaatcgccggacggcgaatcggggaaggggcagaaaccggtcggacagttcagtcttcggcggcaccaccacttcgtggccggccacccattgcactccacgctggatatgagtgatgccggaacgcatatcgatatccgcccaatcgactccgtacccctcttccggccgcaacgccagacacgagtccacaatcagccaagcctcaagcgcatggccataaaagccctgtagttggcgacgagtctgcccgatggtcagtagacgcggcacatggagcggcttggccggcagatcaatctccaaacgggtcacatcgacctctaagtagccccacttcgcggccttgcgtagcatctgcctcaacaccgcccaagccttgcgggccgcacctggactcgcgaaccctgacagccacagctcgatgtcatccacgccgatgtcagccagctccatgctgccgaacaccggctccacatggcatcgccaagccgactcatagccaacgcgcgtgacctcgcgcaggcgctcgcaatagccgacataccggtcatcccaaaactcttgcaacaacatttcgacctccgaaaaaccacacgtctcgcggccaatccgctcggtatcacgtgtgggttttctcaccataaaggagccccgcatgtcgcagttaatcgaacaactcgttgattggctggtgcccttcttatgcggtggcgcggtcaccgtgctgggcctcatgcggcgatggggcagagcgatcatcaacgggatgcgcgagctcctgctgtgccagttagaggacctgcgacgcgaaatggtcatcgagcacgacggagtggcggacgaggacctcaaatcacgctcccaacgcctctacgactcctatcactcgctgggcggcaacggccacggcacatccctcaacgacgacatccaatccgcgccaatcgcgccgcgcaacagaacgtgagccccgcaatcccgcgagactccaaaacatctctgaaaggagaacacatgatatttaatcgcggaaagccacgccacgcccgtccccgccgaccatgggcaaccatgctggccacactgctgacgaccatcgccctggtgttcgtgccgggcaccgcgctcgccgacagcggtatggacgtgagcaaatggcaaggatgtgtcggcagcagtcaggccgcaaccgccaaggcatccggtgtcaacttcgctttcgtgaaagtcactgagggcaacgggtacactgattcggttgccgactgcacaatgcagtcgctcaaggccaacggcatccgtcgcggcgtctaccattttgctcggcctgatctcggcaacagccctgaggccgaggctgactggtttatcggccaaacgcgcggctatgtcaacgatggtgtgattccagtattggactgggagccatcgggcagctacgtgacatggagctggtgggcgctcaggtggttgcagcgtgtcgaatccgcatggggcgtcaagcctctcatctacacgtctgccagtgtcatcaaaatgaccgactggaccgcagtggccaacgccaactacggtttgtgggttgccggatatccgcgtggatataccggagagaccctgcgcaaccccggagccgtgccctacgacgtcagcccttggccattcgccgccgcctggcagtattccagctcgggtcacgtgcctggcgtcggttccaggatcgacgtcaactggttctatggcgatgccggaacatgggcgaagtacgcgggttctcagcccggcacctccgccaacccggccacgcccagcccgacaccccagcaaggtgcgccggtcggtgacgcacagtccttggcaaccgcagtgattcgcggcgactacagcaacgacccgcaacgccgtcaactgctcggcaaccgctacagcgaggtcatggcaatcgtcaaccagcgtttgcgtggcacgggaggcggtacaagtaccagcgcaagctggtacaccgtgcaacgaggcgattatctgaccttgatcggtgccggaaccggcgtgaactgggtaagcatcgcaaacctcaatggtttgcgtgccccctacgtcatctaccccggccagcgattgcggctcaccggtacgacatcctccacctccgccggtgcggggcgctacgtggtgatcggtgccggtgattgcctgtggaaccatttcggcgccaacagcgccaaggtcgccgcagccaacggcatcagcaatcccaaccaggtccgcgcgggaacgcgcatctactactgatccaacagggccgcgaatccaatcgcggccctcccggtaaaagaaggaataacaatgtccgatgaaaacgaactcaagaacatcgccaacccaataggagtcgacacgtctgcatggagcccagcggcagatgtgaaccctgcggtccccgcatggctcatccccaacaaactgtatgacatcttgaagtggcttgccgcactcgtgtttccggcccttgccctcttcatgggcacggtcggcccggcatggggactgccgtacgtcgatgccatcgtcaccacgctcaatgcgctcggagtactcgccggtgccgtcatcggagccagcgcactcaaagccaagttcactctcgcggcgtgagctatattttcgggcgatagattggctgcaaagtaccgtgaataattcggtcttgtctggtctgtggactgggcaaggccgaatttcgcgtatcatcgatcaaaccagattttgcaggtcgtcgttttattgatatcttggccgtaagaactcctcacatgagggattcggaaaaagaaaaccggtagcatgaccatagcatgacttcgactggcgggatatgcgacaaagcctgtggtgcaaggcgcggaagcgttcgcgtaatcagtcttccaaactgattacgcgggttcgattcccgtcatccgctccactatataggtttgtggctagggtactacccacaacattgcccgtaacaccaccgcccgcaacagaacacggccttggtgagtcgtatgtttgcgttcacagaaattgcatgtagtatgtctccgtgtatgcgtagcggtatgtgatactgcacacatgcggagcagtggcatactgacggtcgtcagtaactccggcccccgcgcagcggcggcaaatccgcctcagttcccagatggtgggaccggcacgccccgtcgagaagaaaagtgcgttatcgcagggtggatgacgagggtgccacttttcaaaaattccaaggttcttttcagtgtcgggtaaaaaattccctctacccgggtgtacgcattcgtgctttttgcttaataccgtaacgccttataagcgtaacgccgggttttggcgtacgtgatcgtaagagacaggcaaggttatgaagagaattgcagaatggttcgcagcggtaggggccgcggcgggcaggaaaggcaaacggttagtggcgatcgttgccgccgtggcgatgctcggtggcgtcgccggtgtgagcgcgaccgccatggcggacgatgggaatgcctccacgacacaatcgcagaccaccgatgagaaggcggccgccagcgcgcctgctcctctttccaccgagggaacaaacggcgtgccggatgatccgacgttgtctgctccggcccgcgagaagaccgttaccgccaatgaagacggcacgtacacggtggcgttgaacgtcaccggtgcgaagagcgcgggtacgggcgagatcgtgacgaaccagccactcgacatcgtgctggtgttggatgtgtccggttcgatggccgaaaagatcgctagcggttggaaccagcctacgaagattgactcgctcaagaccgcggtcaataaattcatcaatgcgacggctgcagagaacgcgaagattaccgaccagagccagcggaaccgcatcgccctggtgaagttcgccggcaccgagaagaccagcgtcggcaatgacttttaccgcgaaggctggtcctcctacaactacacgcagatcgtcagcaacctgacgtacgacgtctccggactgacgagcacggttaacggcctgagcgcgtccggcgcgacctccgccgactacgccttcaaccgcgcccaggcggcgctaacgtatcagcctcgcgccaacgcgaagaaggtcgtcatcttcttcaccgacggcgagccgaaccacggcagcgggtttgaccccaccgtcgccgccaccgcggtgaacaaggcgaagagcctgaaggacgccgggacgaccatctactcgatcggcgtcgtcagcggtgccaaccccggcgacacctcgagcaacctgaacaagtacatgcacggcatctccagcaactacccggatgccactgcaacgagcagtgagcatttgtggggaaagtcttggaacgccaacctcggtgaccgcgccgagaccagcagctactacaaggccgccacggatgccggccagctgaacaacatcttcgagtccatttatcaggagatcaccaagacggctgagtatgccgacgtgacgattcacgacaggctgtccagctgggtcgtgagctccgacagcgcctccgagaatggagagcccgcgggcttcacgtacacgaagacccggaaaggccagaccacggcgtgggctgacgccccggaggcgacggttgcggctgatggcaccgtgtcttggccggtcacgtccaacgacgacacgcttgaggacggcgtcacctacacggtgagcttcaatgtcaagccgacgcaggctgcgttcgacgaggctgttaagaaccacaaggacgatgccaatgcctccggcgacaacaacttctacacgaacgacaactccagcgccactgtcgactacaagaccgtggtgacctcctcgcagggcggcacgacgacgagcgatccgcagaccgccgcctacccgcagaagccgaccatcacccttccggtctccaagattacggtgacgaagacttggtccgacgacaacgagaatcacgcgaatgattccgtgcaggtccagctcaagcaggacggcgaggattatgccaacggttcagcaactctgaatgccgccggcaactggactcacgagttcacggtgcctgccggccctgaggggcacacatactcggtttccgaggtcaaggttgaaggctatgactccaaggttgataagactgacctcaagctacaaggtttgaccgcacaatccggtgccttcacggtaaccaacacgccttcttacgtgaccttgcccgcttcggatgtcaaggtgacgaaggttgtgcagggacatgctgctaattcggacttcggcttcaacctgaagtgtgtggatagcacggatgcgaatgctggtaagtgcgctgacgttaccggcttggccaacaatggactgactacgactgtgtccaaggacgaattgactgctagcggcgcgagcgcgacggttggcttcggcaatggggacctgaagttcagggttccgaccggtgctgacaatttggtctacacgttcgaggcttcggaggacaccgaaaagcctgctgccggttggaagtatgacaacgataaggtgaccgtcaaggtcacggtctccaggacggatgccgttgtctcttacgagtacggcgagaacgattccgaccgaacgaatacggagtcggcacagttcacgaacaagtatgtggctatctccagtctgccgctgaccggtggcacgactggtcgtgactggatggtgttcggcggtggcctgggcctgctggccctgctggctgctgcgggctacacggtctggcgtaagcgtcagctggtctgatttcaagaaacttgaggtggttttggcttccctcgctgaggggagctggccgccgaaggcggactgaggggagtcgatgaaggcttccctccccgaaaaaacaataaggatttgcggattgcggaggccttgctgtgggtctgcagcctccgcgattgcaagaaaatcaatcacaataaggaagagagggtttctcatgaagttgaggaagcttttcgcgggtgccgctgctgcggccaccctgctcggtggcatggccttcggcgccaccaccgccaacgcggctgaggccaacatctccagcacgactatcacagtcaacgccacggatgcaaaccagttctacaccaagccggttgacaccgctgacctgcaggctaacctgcgcatgttcaagtacgttgagctcgccaagtatgtgtctgatggcaacactggcgttgagctggagggtttggtctccggtgaggcagtggatgctgctttcgctgctgctggttacaacgaccagaccaagggtgattccctgaacgagtgggcctggctgggcaacactaccctgaccgccgcgcagaccaccgcttttgtgaacgcgcttaaggatctggctgtcacggacattaccccgacggcttctaacggtggcaagacccagaccttcaccttcgctgagggtggtctgtacttgattgtcgaccagagtggaaagctggtcgtcgaagataatgacactcacaagctcgtgtggaatggcaatgctccgattctcgctggcactgctatcacgggcgccgcgccgtccgtgaacaacgccactggcgttctcgccgctgccggcgttgtcgacctgaagagcagcaaggaagaaaccaccaaggctggtgccgtgacttggcagaaagtcgacaagaacgctgctgctctgactggtgctgagttccaagtgtacgaaggcgatgttagcggtctgtccgctgacgagctcaaagcgaagactccgcttaagttcaatagctctaacggtgcgtattctctgccgaccgccaatgctgatggcacttaccctgaaggcgccacggacacactgcaatccaacgctgagggtaagtacactctgaacggtcttaagctcaacaccacctacaccgtgattgagacgaaggtcccgactggctacaacggcaccttcgttggcaagttcacgatcactaccggtgcaaccgcagatgctgctgccaccttcgctggtaaggatgcctggaacctgtccaaggacaacaagggcaccttccaggtcaccaacgtcaagaacatcacccagctgccgctcaccggtgccgccggaaccatgctgttctccgtgatcggtctgctgatcgcgggtgccgcggtgaccgtgttcgtcaagtcccgttccaccaagcgcgctctcaacgcgtgagcttgactgctgcttgtaactgagcagctataacaatggccgatctgattattcagatcggccatttgtcatattggcggcatttcatacggatgacttgtaggccatctccgaatcttatgggcaatgtatggcattttgatttgaatgtaatggggccgggcatcgaaaataacttgtgtttcgccacaacaaacgtttcacgcaggctcggtaacaatcgccaagcgaacacaatcgtaggggaggtgaaggatgggtctgtataccccattcgtgggctgattatcgttcagttgccgtccagccactactcaggctccacttaaacggggataaaaacgaccctactaggggttaggcatgtccgaattataagtattactatcccgaactatggcattcaccccataatcaaggggggtgtgcaatgagccttccaacgagtgtaagggatgaggatgaccagtggtggagggacttttagccccgaggagatcaagtatctgaagtcgttgtcggcagtggcggaagccacggcgaagcgcatcacctataccgatgatttcaagcgttactgtgtagtccactacaacgaaggtgcctcacccgtgcgcatgttccgtgaagccggattggatccggctctaatcgggtacaagcgcatcgaacgttgccttgcccgctggcgtgaatcgcaagacgaaatcctgaactccggcaatgccaaagccggcgtggaaaataagctggggggggggcttcagattcggagcttttccgctcgggagccgcgggcgcaccaaacattccggagagtgcgcgagcagcgagagcttggcgcgactcggcggaatcgtcacttccggctggtaccggcagcgaatccgatttccacgtatcgcccgaacgtcgcgccatcatcttccccgtctcccgcaaagagcagaacaatgacctacgcgacttgctgatttcgcagcaggtacgtcgtatcgacgaactggagcgtcaggtcgacatgctcgaggccctgctgcacggcaggcggcgtaaggaacaggctgccaatacgttgcctgaggaacagacggatacagcggcggacaagtcgccggatgcagacgggcagtagcagtagcctgtctgtatccaatcagcgcgcgaaaccgcagggagcatcaggtacttgcccaacacgcacgctaagataggcatcgcaataatcggcatggcaatacatggcaatgagcaggtaatcggcgaggcggtgcatggagcaggaacccaacgagcaagaacctaacgaggcgacggaaatcgtaggcggcaaagtagagaccgtcgaggtttccaggcaccccgaggcttccatacccgagaccgatttgtctttggctgatatcgagcgccgtcgctcccatccgttgcgttgggcgttgattattcttgccgtactgtgcgccatcatcgcgccatactggttcggtcgctcgctggcggtgaataatactgactccattgtggccgtgctcgggggagtgtctccgcaaggtatcgcactggtcggttgggtggccgtggtgatcacgtacgtcggattggcgatggcggtggtcgtctcgccgtcctggccatggctgatcgtgttcgtgctcgggctggcctgtgagcagttcatcgcgggactcagcatgctcaatctcaacttctggtattccacgtacgtggtctacggcaagcaggccggtctggcaaatgccgcgaatctgggcattatgggggcggcgatcggcatcgccgtatacgccctggtgtttgttggtctgctggtgattatccggaagacctcgccgctgaacgtactgaccaaaagctgggcgagtttcattctgtacttcgtgattgaaaccatcgccctgctcgtggtgttgttcggcggattgctcaccactgtgtgagcgcacgtgagtcgccgtacgtcgctcaatactcaccactcactgctcaccgccgcgcaaaccgtgtgcccgatgtctatttagaggtgcaacaccccctgttggtcctgcaattatagcagttcgtcggcgaatgcctcggcgggccggattcaatttgtaagcgcaacgcttgtgttcgggctggctgccttcgattgtagcttggcgatctcctcgtcccatacctcgttgggcgttttgtagccgaggagcttcatcggggtgtcgttgatctcaccgacgatcgcgtcgaggtcctcctgggccaagtccccgaacccggttcctttgggcagatagcggcggatcctgccgttcctgttctcgttgctgccacgctgccaggaactgtacgggtcggcgaagtacgtgagcatgcccagcgcctcgtccaccagcatgtgcaggctcgcctccgtgccgttgtcccacgtgcggtcgacgcgcgcggccggcgggatgtccttgaagatctcgtattcggccctggccgtggcggacgcgctcttgtcgtcgacgagccgggcgaacagcctgcggctcctgcgctccacctgcgtgttcatgcagcgcctcgacggcgcggcgccgaccaccgtgtccgactcgaaatggccgaaccccttcctggatccgaccgcctcgggccggtccgcgatgggcacgcgcatcgggatgcgcggccctttcgccttcctgccctttttcctcgtccggcgtttcctgccgcgcgccaggtactggcgcaggtccagcgcccgctgcggcttggcgtagatccactggtaaaggcactcgtggctgatccgcatcgacgggtcgccggcgtaccgggccttcaaccgtccctcgatcagttccgggctccaccccctgcgcagcgagtccagcacccaggcgcgaagccggtccgagtccatgcgacgcggcttgcgggatccgcgccggcgcaggtccgccttcctctgcgcggccagcgccgaatagaacggacccgaggtccacggcccggtcttcagccgtttcggccggtagggacggtacgacccgttctcgttggacgcgaaccacaggccgcgcctcagctcgcgtgacaccgtggacttgtcccggccgatcctctccgcggttcgccgaatgctcagatgctgttcgcaatgcagcttctcgatcaggatcctctcctcggacgacaggtgcgaatactgttgacccatgagtgcaacaccttcttaagttagaaacttcgaacacttccaaccttagacaaggtgttgcacttctatttagaacccggggcgtaaacacgattgccttcaaagaagatggtcgtgactgtgctggaatcaatgttcggtgctatgaagcgaagcgttggttgtgtgtctaagctggccgcattgttgaatgaggctcaacttcggggtgtcgttttatcggctgtgatgttattgtggcgcgacacgccagctttataggcgatgagtggtggcatcagatgagttcgcttgtacgtctccattctttgttgaaatatgttatgcaaagtgtgtaattggcatatgaaactgtcatatttgatgtgttgcgttgcgtttatgtgaacttattttcattgtgcatatcgttatcaatttgttatcaaggacgatcgcgagtgaaatgcgctcatttatataatggctgctgcatggctgcccttgagggacgttcctctggcatggctttgcaatgagccgcgatgtggtcgtaaccaacgtgggattcgattgtgcggcgaagaaaaaatgatggggggggggagtcgccctccatcattcaggaaagggaactgaatggtttataacattcacatattgcaaacaaggaaaaccggtcgtgtggttgctgctgcggctgcatccgtgctgtgttgcatgggggctgtatttccagcgactatcggagtgactgcggcgtcggccgatgaacccgtcgaattggtcgtcaacggcggattcgaagacgatcttaatggttggaagtctggaacggtgtggaatagctccgcatcgtccattgccgtcactgcggatgatgtgcatggtggcagtggcgccttgagcgttactgatcgtacatcctctgatgctggtgcaatccagtctcttgatggcaaggtggaaaaaggacagacatataccggaagtatgtgggtcaaggccacggaagacggtgaattcaatatcactgtttgttcgggtaatggttccggatgtgaccagattgcgaccggaacggcgaaagcgggtgagtggacacaaatttcaggtactggaacgttaggtggtagtggtgatttcaccagtccctcgctggtgattgaaaacaagtatggcacgagcaatgccgacttcattgtcgacgacatttccgtaaccggttcggattctggttcctcattcgtgccgccgactacgggtacggcaacggcagccaaggctttcggcgactattcaaacccgattatcgattattggtatggcgccgatccgtgggctatggaatacaacggacgcgtatatatctacactacgggtgatggcacttctgtgaatgctgatggctcgttgaattatgactatgaatatgacagtactgggcagatcaaggacaattcgttcgctcaagtaaagaccatcaatgttctgtccagtgatgacatggtcaattggcgtaatgagggttacattcgtgtggctggagaacagggggtggccacctgggccagcaattcctgggctcctgccgtcgctcataagaccatcaacggtaaagagaagttcttcctgtatttcgccaatggcggcagcggtatcggtgtgctgacctcggattctcctgttggtccgtggaaggacgaaaccggtgagctgttgattaagggcggtactcctgaatccgctggtgtggtctggctgtttgatcccgcggtgttcgtggatgatgacgggcagggctacctgtattacggaggtggtgttccgacaggcgaggaagaacatccgaacacggctcgcgttattaaactgtccgatgacatgctgcataccgaaggtgaggctcaggccatagacgcacctgccatgtttgaggactccgggattgccaagataggtggtacttattactactcgtattgcactaatttcagccatgacaacgtaattgatggtaacacggtcggttacggcaatatcgcgtatatgacttcagacaacccgatggggccgttcacttatcagggtgagattctgaagaatccgagcacgtatttcggtgttggcggcaacaatcatcacgcgatggttcaacttggcgaccagtggtatatgacctaccatgcgcaaacggtggcaaaggaattgatgaacggcggtaatcttgacgcggcgcatggctaccgaaatactcatctcgatccgattacggttaacgaggatggttccattgccgatattgcaatgacatatgagggtctctcttcggtgaagaatctggacgcgtatcaagatggaggcattccagcttccaccattgcatgggattccggcattcagaacgcatatgacctgacttctggtgtgcgcgtggtcgatatgactacagacaattccgaaggtcagaagctcagcaatattaataatggtgagtggacgtctttggcgaatgtcgatttcgggaataacggcgcctcttcgctgactgtgactgcagctggcaaagccggaggcatccttgagattcgtcttgatgatccggattccgaacctgtggcttctatttcgattcctgccggtgatggatccgagtacgccgattacacgaccacccttgagggtgtgacaggggtgcatcatgtggtgttctccttcaaatccgatggtggtgcgaatgctcaggatgagctgtacgacatcactacgtacactttcacggagtcgcaggatgaaactccttcgactccggtggacaagtctgatttgcagagcgcagtgaatgagaattccggcctgaacgcttccgattacacggaagagagctggaaggtgtttgctgacgcattgcagaaggctcaggcggtattgcaggatgaatccgctactgaacagcaggttcaagatgcgcttgctgcattgaatagtgcacgtgccggtctgaagctggctgatgattccactgatggcaatgccgacggctccaatgacaatgcttccgatgccgttgatgacacggatggcgtggatttggcacaaaccggttcctctgtcttgcctggtgctgtgattgtcgcttgcttggctctcactggtgtgatcgtagcgcgagtgcgtcgcgagatgcgctagttacctcttggtaatgcggtcatcccgtagcggcagcctcgggatgaccgcacatgaaacctagaactggtacttgttcaagcgtaagttttggcagtggtaatgtccatcacttatccatatgcgggaatgtcttatcgtcattcattgctgatttgtgcgggcatgctattggaatacgcactcgatgttgagtgcttatcatgaaaggttaaaagacttatgaattatttacgacaaaaaatttcggctagtgctatcgcggtgttgtcgacttgtgggttgattttggcgccaatgccggtctttgcggatgattcaacgccatcttcaacgccatcggatggcagttacaccacgactgatagcggtgatggcacgtattccattcccatgttgaacacggatgttccggatatcagtgttattcgtgtgtcgaaggacgatccgaataacaaagacggtcgtgatgtgtattacatggtgagtaccactatggagctcagtcccggatctccaattatgaaatcctatgatctggtcaattggtggatagtcacgtacgtgtatgatcgcatttctatgagcgatgcttcatccttgcgcaatggagctagctcgtatggcgaaggcgagtgggctccgtcgctgcgctatcacaatggccgcttctacgtgttattcaatacgaacaaccttaatggcgcttatatctactacaccgatgatattgagaatggtccttggacgaagattgcccttaatcggggattccatgatccgtcattgtattttgatgagcaagggagtccttggattatctccggcgtcaaccaatataggctgtccgatgatttaaccacggtggtggagagccatgagaatatcatctctgccgaacagttcactgatgatcttggtgagactcctaccggatttgaaggatctcagactttcaaaatcggtgattatttctatactccaacgatttactggggcaaagacggtcgtacggtgatgctgctgcgcaccactgatttgcttgatggctccaaatacgaagccaaaaagtattatctaggtgctttcgcacaaggtagccttgttgaagtcgacaacggtgatggcacgacgtcttggcatggattcttcttccgagacacatatccgaccggacgtattcccggtttgattcctgcaacgtggggtgatgacggatggcctgtgtttggggacaataatcaggtaagcgcgtcggacacctacgacaaactgattgatttgcctgctgatttggagaatctggttcgccagcgttccctggtcaattcggacgattttgataatgacgcgcctcatcagtcttatcaggatcaggattggtggactctggaggagcctcctcaggttgacgattctctgattggaatcgagctggtggacaatggcgatttcgaaaacgggactgaatcgtggacccctcagtggaatggtacgcttaccgcgattacggatggttctctttctggaaccacgagtcttgctgtgacgaatcgtggcgaatacaatggcgctggcccgggtcaatctatggatggaaaattgcagcagggcgtgacatatcgtgccagtgcaacgattcgatacgaccatgagatggacggcgtcgattcatcggctgtgacttcccacctgttttatgtggcgattcaatatgcagacggcacaattaatcgtgtggccacaggaacagtgaaacgtggggagacgactactatcacaggtgagttctccatcccatccgacgctaatgtggaaggttccaaactcattgtcgaaaccgcgtggggtgcggaaggcacgtgcatggattacgtcatcgacgatatttccctgatcggtcttgctgatgagaaggaatatccggtcgccgaagaataccaacccaatggttcgaatcttgatttggtatgggaatggggacataatccagataaccgatattggtctctcactgatcgtgaaggctggttgcgtttgaccaatgggcacaaggtttccgccacggccaaatatatgaaaggcacttatggcgacctgacatattttgaaaccgcccgtaacgttttgtcgcagcgtacctttggcggatccatgtctgtggaaacccacatggatgtcagtcatatgaaggatggagacaccgcaggcctcgctacatatacccgtagttttgcctatgccgctgtgcgtcaagaaaatggacagcgaacgttgggcgtggtcaagcgtgtctacgacaatggcgtgaaggacgcggacggtaatatcgttgacgatacgattgatcgtgacgctgaagaggcctttgtatcgggcggcacagtgacattgccagatgatgcgaccaatgtgtggatcaagtcggacaacacactggataatgcgagtggtaagttgacgattcagtattggtacagtctggacggtaagcaatggtccaagcttggcgacgagcaggggccgctgacttacgattggagcttgtcgcactttaaggggtatcgaatcggcttgttcaattacgccaaggagaatacgggtggttatgtcgattttgattactatgacttgagcgacgtgttgacttctgacggcaaagctgtggatacgtctaagctgcgttcggccattgatcaggctgactctctgcagtctgcggaatatcctatggatgagtgggataagatgctcacgctacttgataaggcaaagcaggcgttggcatccgatccttccacgcaaaatgaggtggatgccccgcagcgtgcactgagtttgcagctcgcgcaattggcggttgaccgtcagtctggtgatggcggaaatcctggtggtggtgatcagaccggtgacggtaaccagtcgggtaacggcgatcagaccggtgatggcggccagcaacagtcttctactgctgatgataattcatctgaactgtcatcaactggttcgtccgtaacaccgatggtgctgtctgcaattgccctgatgctggctggcatcagtgtcattcggatacgccgctcttcgcgctgaaatatcgccgcagcctgttggttgcagcgattgaatgtgcggaatcagtgatgtgtcgcaatggtgggttgtgcgaatgctcggcaacgtggattcgtacaacccatcctgttatgttgagaccgcggcgtgagacatggtggagcatgacatcggcgtagaatgtgcgattttggaaacaaaggagctggtgtgtgggcggctggcagttttcatttcgaatcgacggcgttctcctgatatcaagtatggctgtgtatctatgttgccgttatgtggtgatgttagcggagtgagtaattcggatatggttcgcccttatgaacatatgtatggcttatgtcgtccgccgaagcatggttgcgattagcgaaaatcaggtattgcggcgttatgtccggcgccatgtcattatcgtatggcgcactcacgatacaataccgtcctagcatgggcgtcgcggcatgagacgacgcattgtgcagacaggtgtggcgtcgaacaacgaacgcgaggtaaacgtagatggcggtgaattccagcgtggagaaacagccggtcgaccagcaggcgagcggtgaggtgcaggctgaaatcgatacgcggtccgatggtgtttcgcccatgcccaacgatgtttccaaacataacgatgtttccaagcatccggtggcgtccattcccgaatcgacgctgtcgctggccgatattgagcgtaagcgctcgcatcctgcattgtggctggcttatgcgctgctggtgattgcggccattgtggtgccgtattggtgggggcgtgcgattgcggtgaacgatacgcagtggctgcttgataatttgagcgcgcttgagccgcgcggcgccgcgtttgttgcctggacggtgacgctgattgccgtttccggccttggtctgctggttgttgacgcccatcggcgcttgtggggcgcggtttttgtgattggcttggcggcggagcaactcattgccggcctgcgcattctgaaaattgatttttggtatgcgacatatgtggtgtacggagagtcgtcggcattggcgaatgcggcgaatcttggcattatttcagttggtattggcgttgccgttttcgcggtgctgtgggtgggattgttggtgacgattaaaaaagagtcgccgttgaatgtgctgacgcgcagttgggcgtcgtttatcttttttttgtgattgagacgattgctttgcttgttgtgatgtttggcggcctgctgacgttggtctgattcgtggtgtctggtgctcctgtataattgacccttggcgtatttcgcccgcggatagagagcgcgccggcatcgggccggtagcaccgcgcagcaatataaggaggatgccgtggcactgacggctgaagaaaagcaggaaatcatcgctaagtacgcgacccatgaaggtgacaccggctctccggaggtccaggttgctctgctgagcaagcgtatcgctgatctgaccgagcacctcaaggagcacaagcacgaccaccactcccgtcgtggtatgcagctgatgatcggtgaccgtcgtcgcctgcttgactacctcaagcgcgttgacatcaaccgttaccgttccctcatcgagcgtctgggtctgcgtcgataattgaagacttccgcccgagtacctaggatggtgctcgggcgttttacatatcgccagccaacggcaacaacggcaagagggttagaggataggccagcaggtaaggccgacaggagaacccgaatgaaggggttgacacgaggaacgacggccaaggggtcagtcgaaacaaggtatgtgacgtccgctgaagaggacagttgcggttcaagcgagtcgccgaaccgcagcacagtatgtaggaataattagaaaattaaagaaggaggaaccctatggagggtcccgaaatcaaggccgttgaggccgtaatcgacaatggatcgtttggcaagcgcacgctgcgcttcgagaccggccgcctcgcccagcaggccgatggcgctgtggccgcctacctcgacgacgattccatgattctgtccaccaccaccgccggttccagcccgaaggagaactacgacttcttcccgctgaccgtcgatgttgaagagaagatgtacgctgccggcaagatcccgggctcgttcttccgtcgtgaaggccgcccgagctccgaggccatcctcgcctgccgtatcatcgaccgcccgctgcgtccgctgttcccgcacaccctgcgcaacgaagtgcaggtcgtcgagaccgtgctcgccgtgaaccctgatgacgcttacgatgtcatcgccctgaacgccgcttccgcttccaccatgatttccggtctgccgttcgaaggcccggtctccggtgtgcgtctggcgctgattgatggccagtgggttgccttcccgcgttggagcgagcgtgagcgcgccgtgttcgagattgtggtcgctggccgcgtgatcgagaacggtgatgttgccatcgccatgatcgaggccggtgccggcaagaacgcctggcacctcatctacgacgagggtcagaccaagcccgatgaggaagtcgttgccggtggtcttgaggccgccaagccgttcatcaaggtgatttgcgaggctcaggacgagctcaagaagatcgccgccaaggagaccaaggaattccagctcttcccggagtacaccgacgagctgtacgcccgcatcgacgagatcgctcacaaggatctggacgaggccctctccatcgccgagaagctgccgcgccaggaccgcatccacgagatcaaggagcacgtgcgcgaggtgctcgcggacgagttcaccgatatggacgatgccgagaaggacaaggaactcggtaacgccttcaaggaactgcagcgccagattgtgcgtcgccgcatcctgaccgaggactaccgcatcgacggccgtggcctgcgcgacatccgcaccctgtccgccgaggtggacattgtgcctcgcgtgcacggttccgccctgttccagcgtggcgagacccagattctgggcgtcaccacgctgaacatgctcaagatggagcagcagatcgacgcgctgtccggtccgcagtccaagcgttacatgcacaactacgagatgccgccgtactccactggtgagaccggccgcgtcggttccccgaagcgccgcgaaatcggccacggcgccctcgccgagaaggctctcgtgccggtgctgccgagccgcgaagagttcccctacgccatccgacaggtctccgaggccatcggttccaacggttccacttcgatgggttccgtgtgcgcctccacgctgagccttttggctgccggcgtgccgctgaaggctccggttgccggcatcgccatgggcctcgtgtccggcgacgttgatggcaagcacatcttcaagaccctcaccgatattctgggtgccgaggatgccttcggcgacatggacttcaaggtggccggtacttccgagttcatcaccgccctgcagctcgacaccaagctcgacggcatccccgccgacatcctggccgccgctctgcagcaggccaaggaagcccgcgccacgattctcgaggtcatcaacgagtgcatcgacggcccggccgagatgagcgagttcgctccgcgcatcatcaccacctccgtcccggttgagaagatcggcgaagtcatcggcccgaagggcaagatgatcaaccagattcaggaagacaccggcgctgaaattgccatcgaggatgacggtaccgtcttcatctcctccgagggtggcgaggctgctgagaaggccaaggccatcatcgaccagattgccaacccgcacgtgcccgaggccggcgaaacctacaacggcaaggtcgtcaagaccacgtcgttcggcgctttcgtgaacctcacccccggcaccgacggcctgctgcacatctcccagatccgcaacctggccaacggcgagcgtattgacgctgtcgaagacgtgctcaaggaaggcgacaccgttgaggtgatcgttcagggtgtcgatgatcgcggcaagatctccctggccattcctggtttcgaggatcaggagaacaacgcccgcccgagccgtggcgatcgcgatgaccgccgtggcggccgtggccgtggtgaccgtgacgatcgccgtggcggccgtggccgtcgctccgagcgcgatgaccgtgacttcgacgatcgtgacgaccgtccgcgtcgccgtcgctccgatgacttcgaggatgattacgacgaccgtccgcgtcgccgtcgctccgatgaccgtgacttcgatcgcgatgatcgcgatgatgatcgtccgcgtcgccgtcgttctgccgaccgtgacttcgacgatcgcgatgaccgtgatgctcgcgactcccgtgacgatgatcgtccgcgtcgccgtcgctcttccgatcgcgatgaccgtggcgatcgtgatgaccgccgtggcggttcccgtggccgtggccgtggctcggaccgtaacccgcgctacgccaccgacgacaactacgacgactaccgcgccgaccgcgaagagcgtactgagcgcccgcgtcgccgcgtccgtcgcgactttgatccgttcgaggactaaatccctctcacggatcggtcgcggcatagccgctcccctcacctacgggaagcccgtagggcttcccgcttaacggttcggcattcgaggactgatcgttctctagcttctctcgggtgagaagggcttgatcgcaaaccaaaaggcttctataccgtttcattcggtatagaagcctttttggtttttcggcttcttcgcgctgcatatttcgatgttgaataaggcactcgtgctgccgccatgtacgtttagttgtcggttgacaactattcccatgcatcaagaatggcggatgatcatcgaaggtactcatgggcgttgatcactgtggcaacaacaaaggccgggcccttgtgagagcccggcctttatgccgtatggcggcggattaatccttaaaggctaatccgttgtcaatcagcgttacagaatcgccatgcacacgaagtccagaatgaacagcgcggccacagtccagatgatcgggtgaacctccttggccttgcccttgcaggtcttcacgatgcagtacatgatgaagcctccggcgatgccgtaggagatggagtaggagaaggccatgaacacggcggcgaagaacgccggaatggcttcggcgatgtcgtcccacttgacttccttcagggaagcggccatcatgcagccgacgatcaccagcacgccggcggttgcggcggacggcacggcggagacgaccggggccaggaacgcggacaaggcgaagcagatcgccacaaccacggaggtcaggccggttcggccgcctgcggcgatgccggcggaagactcgacgtaggtggtggtgttcgaggtaccgcagatggcgccgatggaggtggcgatggagtcggcgaacagggccttgtccatcttggaggagaagccgtggccgttctccagagccttctcatcctcggcggagaagatgccggtgcggcggccggtgccgatgaaagtgcccagggtgtcgaacgtatcggacatggagaaggcgaagatggtcacgatgaccagcggcagcttggtcggatcagagaacagtgccgggaagccctcggcggagaagatcgcgccgaaggtctgcggcagctgggagaaggtctcgctgatggactgcgagttggaccaggtggtcacgccgaacgggatgccgattacggtggtgatggcgatggccagcagcatgccgcccttaaccttcatcacggtgaacacaatggccagtacgaggccgatcaggaagacccacagcaccttgtcgttgaagttggccagacccggggtagccgcaacggcaccgcccttggcggcggccttcggatcgccgggagtgaacttgatcaggccgacgttcagcatgcccacgtaggccacgaacaggccgatgccgccgccgatggcgtgttgcagggactccgggatggccaggatgatcatcttgcggatcttggtgacggtgatgaggatgttgatcaggccgcacaggaacaccatgcacatggtctgctgccagctgaagccgaggccgaagcacacggtgtaggtgaagaacgcgttgaggcccatgccggcggcctgggcgtacggcacgttggcgaacaggcccatgaccagggtgccgatgatggccgcgatgatggtggccaggaacacgccgccccacggcatacccgtctgcgacaggatctgcgggttgacgacgatgatgtaagccatcgcgaagaacgtggtcaggccggccagaatctcagtcgagacggtcgtgccgttttccttcaaatggaagaacttctccatttactctctacttccttgggtttatgcggggctgcgcaccgcgtgcataatgctgcggctggccccggcgagaattgcgactcgccctgatcggcctgcccaacgcgcgtcaggcgctgcgcacccaatcagaaccgtggccgattatagcttgtggaggcaacgtgaacgggtccgggagtagactgactgccagaataattcggaacaactcaggggacacgcaggacacacccgtggaaggaaggcgcgcgatgaaaccggccgtcgaagtcagcatcacctcttggaagaagaatgtcgtcaagcccggtcaggagtacggccgcgtactgctgatgcccggcaccggctacaactgcgaccgtccgctgctctactggtcggcccaggctctggtcgaggccggctggcgaatcgaccgcatgaacgtacgcaacgcttccgacgacctgtccacggtgattccggtcctcaatcaggcgattgacggctgggtggccgccgcgcgcgagtccggcgcgggtaaagccggtgattccggggatggcgttgccgccgatgattctgctaccgtgctggccgatggcgcagctggctcgccgaaccgtgattccgacaccccgtccggccctcgcctgttgctgatcggcaagtcgctgacgacgatgacctacccacatgtggcctcacactacggtctgccgttcgtgctgctgaccccggtgctgcatcacgccgacttcgatccatccgcccgggtgattccggtgccggctgtcggcgatgatatcgtcgccgaatccgaggccccgagcgtggccgaagcaagggcgatcatccgcgcggaacaggccggccagtcgcacgccgccagctcccgatactccggcccggcaccgctgatctgcgccggcaccgccgacccgttctacgatcaagcccgcgccaacgcgctcaccccgcacgtgcacgaatacccggatgccaaccattcgatcgaggtgcccggccactggcgtcgctcgctcgactatctgaaggaagtcaccgcgtccgtagcccagtacgccgccacgctgtaatgccccgcgacacgcccgaattctgcaatgtcgctgaccatccgtaatctaatcatccgtaaaccacagaccgttggttgaagtgcgcgcgagtgcatttccgaagtttggttcgccaagccagcgcaggttgagagatataagcccgtcaagggccggcgaaggtcgcttcgcgagattatattgctctgcctgtgcgcagggcttttttgttgcccggccgaaagttccgaactccaagtcaacggccgacttaggaaggaacgccatgaagaggcccgaaaaggaagcggtagtcgctcagcttacggaagaattccgtaacgctgacgccgtctacctgaccgagtaccgcgggcttaccgttccgcagatttccgatctgcgtgaaaagctaggccgcgatacttcctacaccgtggcaaagaacacgctggcacgcatcgccgccaaggaagcgggcattgagggtctcgacgagattctctccggcccgaccgccatcaccttcgtgaagggcgacttcatcgaggctgcgaaggtcatccgtgacttcgccaaggacaacaaggctcttgtcatcaagggtgccgccgctgacggcactgtctacgatgccgagggcgccaagaagctggcagacctcaagtcccgcccgcagctgcttgccgaattcgccggcgacatcaaggcatcgatggccaaggccgcgtacctgttcaacgctctgcctaccaaggctgtgcgcacgatcgacgccctgcgcgaaaagcaggagaaggctgcctgatttacgccctcacggcatgaatcagtcgcttcgataatttaaacaataaggtttattaggcagcggatctaccacttcgtccgccgccaagattgaaaggaagccataatggctaagtacaccaacgatgagctgctggaagccttcggcgagatgaccctggtcgagctctccgagttcgtgaaggccttcgaggagaagttcgacgtcgaggctgccgctccggttgccgctgttgccgctgttgctggcgctgctgctccggctgaggaagagaaggatgagttcgacgtcatcctctccgccgtcggcgacaagaagatccaggtcatcaaggctgtccgcgccatcaccaacctcggcctggccgaggccaaggctcttgtcgacggcgctccgaaggccgtcctcgagaaggccaagaaggaagatgccgagaaggccaaggctcagctggaagaggctggcgccagcgtcgagctcaagtgatttgtgcggcataagccgcaatcacagcttttcgaggaaccccgcacctgtgtttcaggctgcggggtttccgcatactgagtagactagttgacgaggacgaggcggagaacgcgatccggcgtggaaacacaaagctggcaatgagcgaaagttgtcaattctgtgcccagtaatccgccaaaagccggtaaaagatgacacaatggcacgtagtgtggtcaaatagtgtgtccaggaaggcggtcacggtgagcgagtggacggtgaagatcaacggtgtcgaccggatcagcgtcaagccgggggagtgcgtggaaatcggccgtaagccgttacgcccccttgccgatgatggcaacacccgccttgacgtcgccgatcaaaccaaatcgatgtccaaacggcacgccatgttcacggtaaaaagcaatggcacggcctcggtccgtgatcttggatcgaccaatggatcgtatgtggtgcgggaaaatggcgatttgttgcgcttgccggccaatgccgagttcctgttgccgacgtctcccatgcgcatgcagttcggcgatgtgcctgcggacttcattcgtgtcgacgatccagtggcaaagccgctcgacctcaaggtgcctgatttgtttggctatgcggttcacgaagcaccgcaggagccggatgcggcggatatgtccgtcgacgatattcttgatttgcgggccggcgagccgaccgccatcttcagcgcggataatgttcgacgcaaggtcgacgagcttgaacttggctcgctgaatatcacgcagccagtgacgaaaaacgatgagccggccataccccgtgatctgttcgcggatgcgttggcccagcatgccgagcaggagaccgaacgcaaaaaccagcaggccatgaactccgtggcactgccgaagcagcagaccgaacctgagtcgacgattgtaacgcctgcatccaagcacagcaggatctccggtattgttccagtagatgccatcgcccatgccgttgttaagcacgctcccagcacaagcgagccggcagtggcgtcggcggcggttgttgaatccgatgcagcggctggcgcaagcaagtcagccgaaaacgttcagtccgctccgaataccaggaatgccggcgattctcagccggcggacactgtcgaacagcatgctgaagttgcccagcctgaagccgcccgggaagccgaagccgctcaatctgaaaacacccagcctgagaccgctcagccggcaaccgcccagtctgaaaccgaccagccggcagctgacgtaccggacgatcagcagcggaccgcagccgaagcatatcaagaagccaccgcagcaggcgtagcagaccagcagccggctgccgaaaccgcccagcagtcggtatccgaagcatatgatatcgactccacgggcgtacacactccggtcttcgagcccggctcggtgttcgagcgtgtggccaagggcgagctgaaagcacaggagccggcagtcgaagtcgatggcctgacctctgacgaggcaaaaaccacgcaagatttcaatgttcaattcgaagtcgcccgtcatcccgaattgctggcgttcctcgccatgaatccgtacctgtacgacgacatgtattcttggctcgccgcccgtggcgaggccgatattgacgaagccctgtctcacaacaagggctatcaggaataccgcgaagcggttggaaagtgagtcgagagatgacccagagccagactcagaaccagaatctcacggaaggtctgaatcgcatccgtcgctggcgtgaccaataccgcagcatgcagccgccatcgccgctcgaggatgtgaatcaactggccgcgaagctggagatgacccatgcccatccctccggcatcgcccagctgttcgcttccggccatgtccggttggattcgttgttccgcgacacgggtgtgcttaaggccgccgaacgccatattgggcgcgtgctggatgaccaggccgccaaacgcaggatttccggcgtggcggagttgtcgctcgtggtcggcgtggccacatggaagggcaacgcgctgccggtgctgttgtacccggtgagcgtcacgatcgaggatgatggcttgtcgaccaccattcgattcaccggtcgcgtggccctgaacgtcgcgttcgtcaatacattgcgtgagcagggggtgttcctggatgaggattccctgtttgacggtgccagctatgacagtggcactcccgaaacttccgcgatgttcgcccgtatttcgtccgaagcgtcggagcgtatctccgacttcgccatcgagcgccagattgtgctcggatgcttcatggacccctcgtcgcagatgatcagcgaaagccgacagttcatcgaccagctggagaacggccccaccggcaatgtgctgttggacgcgcttgccggcgacgaatccgcccgcaccgcgctcaaagatgccaatattccgcaatacagtcctttcgacgtagacccgcatgccgagtacgaagtcggcgatgtggacaatacggtgcgatatgccgcgtcacttgctgccaatggccatagcatcgtggtcgacggcaccttcccgaagggcaccgcggagcaggctgtggccatcgcatcgcgctgcctgatgaatggtcgttccgtgctgtacgtgcccggcgtggccgagcagaagcgtctgttcatccagacggcttccgccaatgagatgaaggcgcaggtactggatgtatccgatgaacacgccaacgccgcgcttgataagcagctgattgccgcagtcggattccagcccggagtcgccacccagcgattcgaccagctggccgacgaactcgtgggcgtgcgctcgcgcttgacccgctatctgggcgacctgcacgggggcaacgataagtggaatgtgtccgcatacgagaccattcagaatctggcccgtatctccgtgctcccgacgcaccctgccacccacgttcgacttgacgagtcaagtgccctgagcatcgccaacgatattgacacatggatcggcaagatggaacgcgccggcgagctcggcgaatacaccatcggcccggaagacaccgcatggtacaaggcgtccatcaccactgaagaacaggcagtaaccgcctaccagcgcgtggacgatttgctgcgtcgcttcctgcccgccacccgtgagcaggtggcacgcaccgtgcagacctgcggattcccggttcctcccaccacccgcgagtgggagcgtcaggttacggttttgaagaatctgcgacgagtgcttgacgtgttccagccggagattttcgagcgagacatcagctccatgatcgaggccaccaagccgaagagccagcgcaaggccgagggcacgtcgatgggattctgggagcgccgccgccacatcaaggaagccaaggatctgctgcgcgtcggcgcgcaggtcgaggacttgcacgaagcgttgaaggtagtcgccaagcaaggggagcagtggcatcagttcgtgcctcacggcggttggccggtgctgcccagcaagctcgacgagatcatctccacccaagaggcgctggtcagcaatatgaccgcgctggataccgtgctttccaccacacccgctggtggcaatctggaaaccgccgatttcgagaaggtggaagcacgcctgaaagcactgctggatgatcgcaaggcactggacaccttgccggagcgttgcctgctggagcaggaattcgcctctgccggactgaacgaactggtcgccgatctcaacgctcgccgagtgagcgtggagcaggtgcgcggcgaagtgcagctggcctggtggaccaccgtgtttgaggacattgtgcgttcgtccgccatcatctccaaccaggatggtgccgcgctgcaggccgcatccgaccgctttgcgcaggtcgatgtggagcacgtgcgctccatcggaccgatggtgtcgcaggaatccatgcgccgcctgtgcgacatgctgttctcccgcactcaggaagccaaccagatgcacaccgtgctggcagggcgcgccagtgtgtcgctgagcaggattcgccgtgatcatccggagattctggccgcggccaagccgattctggtggccgcgccgggtacgctcgccgcactcaccgagccgggtgtgctggctgatgtggcgattctcgatgcgtgcgcgcacattcccgctatcgagttgctgtccatcatcggccgcgtgcagcaggtggtggtgatcgcccactgcgcgacggtaaccagcgaaagcgtcaagcagctgatcgacacgttgcctcatatcgaggtggatgctgccccgtctcgccgtgcgccgcgcctgtccgcattccttgaatccgagggatatggtcctgttcgctatgatgtggccaccgagccggctgccggtgaggtgcgattccaccgtgtggaagcgagcggtgtgccggttatgtcttctggtctggtggaatccagccagccggagattgatgaagtggtgcgtctgattacgcaacgtgccgccggttttgccgtggttccttccagctatcgacttgtggtcgtgatgttgaccgacgcattccgcacacgcttgggtgccgaattgaagtcgttggcaggcaaatccaaggcgatgggccgattcctgcgccatgtgcggttggtttccttgcgtgacgtggccggaggtcgtgccactgacgtgattctgtcgatgtgctatgcgaaaaccacgcacggacgtctgcttcagcagttcggtccgctcgaaagcacaggcggtcgcggactgttgctggatgccctggcattggcggaccacagcttggatattgtgtcggcctttggttccgaagatttggatgaagaacgactgcaccaatccggtcctcggttcctgaagaccatgttgacgtgggccgaacagcttgacgaccgtccggtgcttccgttgcgtgatgcggcaggcggcaacgtgctgttcgacgatatcgccgacaggttgcgcgcgcgaggactgaacgctgctgttgattatggattcgacaagggcgtgaagattccgctcgtggtgggattgaaggacaagccgtttgccttggccgtgcagaccgatgacgcgaactttatgtccgtgcaatccacgcgtaggcgtcatcgtttgtcggcacaggatctcatttccttgggctggaatgtgatgaccgtctggagtgtcgccgccttcgtgaaccccgataaggaagtcgaccgtatcgtcagccgtatcggtgagatctatcgcgaggttgaataaccatggcggaatactcggctacacggcgcacaccgcgcaagcacaagcgcgtggtgatgaagggcactgagcagtttgacgctgacggtgtcaaactcgagcccggagacatgcagaccgaccaacaacggcaatccgacgacgacaaacgcatcctcggcgaactgccgccgcattgggccgtttttaacgagcgcgagtaggagttggggcgcactctgtgcgccccgatactgtgttttccgcagccgacaggctgcggaaaacacagtatcggccgaaggccgattccgcttcctaccgcacaacggccataatcgctccggcctgttgcagctccataaccttggccgcggcctccggcggcattgcgaacgacaccagtcggtcgttgcctcccaatgcgccagtcgcatccggtttgccgacattcatcaccgtggcgttctcggccagcgtgcaatcagcaccttcgcaaccgacggcggaaaccagtctcacctgatcgccggccaatacatcgtcgacgctactggccaagcggacttcaatcaccgtagtgccggtcggtgctacgggcgcatctctggccatatgcgtggaaatgggatcggctgcttcgatatcgatttgcgctaccttgcccaccacatcctcaatattgcctgtccaagacgggcctgccgcagataccggcatatcagccaactgaacgtcggcggccagaataatgtcaccccgtcgaatcgagcgggcggccaccaccatcggctcggtctccaccacggccaatacggcttcaagcccaaacagcactgcgagtcccacgcacaacgcagcagtgagtcggcgcaaggcatccgccatgcgccgtcgccgcaatgagccgcgcgcaggcggcttaataaacgaaaaggtcaccatgcaaccatggtgacctgaagtttttcgtaagcgcaagccaaatcgacctatgtggttctagcttgccaagttatccacaacgcttcaaacccgtgcaacagacagtgcccgtagtgccaatatccgcggcataccgccgtcgacaccgtcgtttacagaggaaaagcgggtgtacagaccttacttgccggatttgtcggtgcggtagaagccgtgacccttgaactcaatcggcacggcggaatacaccttgcgcacctgctcctgcgagcacttggggcacacggtaatcgggtcgtcattgaacgactgctgttcggtgaagtcatagccgcagttcttgcaacggtaatgataggtaggcaacggattcctccaacaaagtcatatttctcgcggatggcccaaacgccatgccacgcaaccgttcatatcctagtcgccgccctgacacattggcgttacggtcttactagccagcttgctgttgccactctggttccatcggccagtgtgcgtggctggttggtcagtctggcttgcgccgagtatcttggccggccggccagctcaacaggcccgatgagctaagccgcaggtatccctccggcgtcagcactccgtcggccggcacatcatgtggttcggccggcaaatcaatgtccaacacctcccacggccagcacaccgcaatcaggggacatgcgggcttgcggcgagccaaggcccggtcataccagccggctccacgccccagacgattgccctgcgggtccactgccaaagccggagcgatgaccagatcggccttctccaacgcttcgggcggtagaactgcgccagttggctcatcgggtctgtgatggacggtgctgggagagctgcagctaccggcattgttcgcgccacccactgcatccatcgagcgcaatgattccaatgaatccagcacactccagccaatttccaacccagaccccaaccttggcaccaacacgtggcagccatgagcccgcagccatcgcaacagtggccgggtttcgatttccgaacccatcgacacatatgccgccactgtgggaccatcctgaatcatgtgtgctgggaaccgtcgcaccagcaattcaccggccgctccgcgttcttccgctggaacgcgcttgcgccgagacagtatatggtggcgcagcgtcgctttatccgtcttctctgttttctctgtgccgctgtagtcgctgccgatattcatgccactgcccacttcgctcataccgcacaatctagtgtttccatcgtaaaacgaaagtggccacggtagcggcgcaagaccttcatatggctacaataaaggccgtgtcagttttccagtcgattaaagaggcgttcaagctggaccaccagatccgcccgccacgtctcacccatcccggttttccgatagtcctgcgccccctgaccatggatgatgaggacggctggaacgaagtgcgctggcgcaacaacgactggctggcaccttgggaatccggtgacccgatgcatggcggctccatcacattcaatcaatgggtgcagcggcagcgccgtaacgagcagcatggcgtcggcgtgatcttcgccatcgaataccagatgcgtatcgtcggccagatttcgttgggagccatcgtgtatggtgccatgcgtaccggcgtggttggttattgggtcgatcaacggtgcgccggccgcggattcgcgccaatggcactggccatgcttgccgattgggcgctcggagacccattcgggcccgcgttgcatcggctggaaatcgccattctgccggataatgcgcgttctttggctgtggtgcgtaaggtcggagcccatcatgagggactgcgcgagcggtatatgtatgtcaatggccagtggcgtgaccacgtaacgtttgcgctgttggctgaagatatggggcaagggttcgccgctagactcgccgccgccggttccagataagcgtcgaccggaagaattccgctccgacacgcccggacggaaagccccagttcgtcggcacgtctcctatccttgactctatgggttatgagtcactgagcactgtcgtcgtgctggtgattgtggcgattattatcgttgtatggctgcccgtacgtacggccaacggcatgaaacgtgtggacgagcaccggcaggatcgttattcgccttccctgcatatcgttgatgcagagaacggcagacgattcggagacatcaagccgcataaggcgaaaggggcagcaatgccagcatcaacaccgtcagcgaggctgacatctgagcacatcgcccatgtgcgggaactgcgccgcgcggccatccgccgccggcagattctcgccgtatgcctgcttgccataaccgtgttggtgtttgccgtatcgttccccctgcatttcagtccgctgcttgctcttattccgttcgtgctgttgctgctggtgctggtgctgggagccaatgcctcacgccaggcccggcaatgggagcgcaaggtggtccgctacgagcgggctcatagcggtacgggctggtccaagaaaccgtctgccgagtccaaggacagcaagcgtgtgaacaaggccgaaccggttgcggccgtaactgcgcctgccgagaagcctgccgagcagattgaggatgctgccaccgaggtcatggaacagcggcagattcgccgcgcgttacgcgatgccgagattgagcaggccaaggccaaggcgttgcgtcagtccgccgccgcatatcaggccgcggaagagcacgccaaacagtctgagaagtctgatattgcacagtccgccgccgataagcctgccgccgagccgtctgctatggtcgatgaatccgccgaccgtaagtccgctgccgaaaccagcgaatcttccgccacacctgatgcctccgttcgcacagacaagtcgattgagtcggacaagtccgtcgcccctcgagttgaaccatcgcttacggtgcgtgacgagcgcgatgagcgcgacgatgccgctgccgctgccgatgccacgtcggaactggtcagcgtacgccctgcccgagcactggacgtcttcgatatgtccacctcgcaggatctcatctccttcactttgggtggggaacataacgccgacaacgctccggaaagcttggagatcaagtcgacccgtcaggtgtccaaggcggaacctgtcgaacccgcagtggcggaaaagttgattgacgaggcccgagccgtcaaggccgcggacgatgccaaggccgtcgatgcaggcaaggctgtcagcgccggaaacgctgtagacactgagccggagcggcgcgatgatgccgatacggacgccgatgacgaggctgcaaacgccgcccagcgagccgcattccacgaatccgaggaacgtgccgacgtcgaagcgccagcggcgaccaccgattcgttgggcgcaggcctggactccattcttgcccgccgcggcaactgagcgttgcgattcgacgattttctctcacagcgttagcactcgagttggcagagtgctaataatcgcgctacgatgtgtcctagcgcaaagggacaacgcaagtgatcgtcagcctcttgagacgttctggcgcggcattatcgaactacaagtagatacgaggtgacccacagtgtcgattaagctcacaccgttggaagacaagatcatcgtcaagcaggccgaggcccagacccagaccgcttccggtctgtacattccggacaatgccaaggagaagcctcagcagggtgaagtcctggccgttggcccgggccgtcgtgatgacaagggcgagcgcatcccgatggatgtcaaggtcggcgacaaggtgctgtactccaagtacggcggcaccgaagtccactacgagggtgaggactacctcatcgtcggcgcccgcgacattctcgccatcctcggctgattagtcgcctagcgaacttcaacaaccccgactgttcccacggacagtcggggttttctcttgccaggcggaaaggggctccccccggagaggggagccgaaaaccgctcccaccaaacgcccagccatgcctgctatgcataagggtgcatgcgcgcaacgtagttgagttcggcgttgcaccgcatctacactgggtaacggattggggtccctatggaagaggctcagtcggcgacttggccgagcggcttaagacattttgcgcaagacggcaatagatcgacggtatgttgtttttttccgtgtcgcaggttcgtagcgtcgtcgcgctgtgccaatggttgtctctctaccgacgctgagtgccgtggcatgaggccagcgtcggcagtgggccacgaaatggcgatgtgccgatgctgagccgcgttggtgtcgttatagggccagtttttggaccattgccgacggcaaatcggcgttttgtgtcggcgacggtccaaaaactggcggtctgccgacgataagtgccgtcatcgtcggcagaccgccaggtattgtccccgtgccgacgtaaaaagccctgccatcgtcgtcaccgagccatcttgtgactcactgacggcggcagcagggcggaagaggccgaaatcatgcgcgcggtgcggtctcacacctcgaatccggcctccaccagcgcgtgatcgatgtcgcgaatcaaatcgtccgtatcctccagacccacggccagacggaagaagccgcggtggaactcaggcgggtacaggtgctggcgctcgtcatcctcgccgaggaacacgatcagcgattcgtcatggccgagcgagacggccgacgtaatcacattgagcttggaaacgaaccggttgtgcccgtcatgattggtgtcgaggccgaacgacagcacgccgccgaacccggagtccgggcgggccagctggctgaccgccacctcgtggtgcgggtgcgattccagaccggggtacgccacgaaacgcaccacatccagcgattcgagatgcttggcaatcgccaaggccgaggcgttgtgctggcggatgcgcagcggcagtgtcaccgagccgcgattgatcagccaggcattgaacggcgagatgatgccgccgaagttcacctgcgcggtgaagcggatctggtccgtgcgcgccttggtggtggcgatcgagccgcccagcgcgtcgccatggccgttgatgtatttggtgagcgattcgatgacgatatccgcgccgagatcgagcgggcgcacgttgtacggcgtgttgaaggtgttgtccaccgaaaccagaatgtccgggttcgcttcgtgggccagtttggcgatggtggcgatgtccgagaccttgagcgtcgggttcgccggcgtctcgatatgcaccagcttggtgttggggcgaagcgccgcgcgtacgttctcgggatcggaggtatccacgatggaggtttcgatgccgtacttctccggcagaatctggttcaacaggcggtaggcggcgatataggtggtgtcggagaagatcgcgtggtcgcctcggttgaggaacgtggtgaacgtggcggccagcgcggccacgccggaagcgagcaccaccgcatcctcggcaccttcaagacgggccagcttttcttccagatagcgctggttcggatgcctgttgcgcgtgtaaaggttcacgtccgaactggaccagttgatgtccgaggggtcgtagggcagcgcgtaggcgttcgccagcgtgatggggcgacggatcgcgccggtttcggcgtcgaccccgttaccgaggtgaatggccagcgtgccgaatccgagcggctggtcgtcgaatgattgtccgtgatgtacaagatcagaagccatgcgcccagcatgccagcatgcgccgtgccgcgcaaacaggcgacatcgctcgaaaaccgcgccattgcaaggttctagagcaccatataagaaaaatgattgggtgaagtgcggggtgcagccttggtcggggctgtttgcagggccgaagcgggccctgaaaacacgctgtgagacacgccgataaaaccgcagaattccgcggtaaaacaaggttcgcgtaggggccgatttgcatacctggaaaatctgtggttatatagccaagttgcctgttgaggtcaaacaccgcggcgggaaacagactggcggatttcccaagcggtcaaagggagctgactgtaaatcagccgcttcgtgcttcagtggttcgaatccactatccgccacgccccgatagctcagtggtagagcacttccttggtaaggaagaggtcgtgagtccaattctcactcggggctctctggcggggtagctcagctggctagagcgtacgactcataatcgtaaggtcaagagttcgagcctcttcctcgctacaaatcgcgcccgctaaccggtgggcgcgcactatacctaagaacacagaggtgaatgacaatggctaagagcgccgacatccgtccgggcatcacgctggcctgcaccgagtgcaaggagcgtaactacattacgactaagaaccgtcgtaacacgcccgaccgtcttgagctcaagaagttctgcccgcgctgcggcaagcagaccgtgcaccgcgagactcgttgatcgcaagtatcacagctttacaaaacccggcccattcggccgggtttttgcgtattgcctccggaggcgagtggcagggtgcggaatcagtatccgcatcgcgtgagaaacggcagaaatcccgcgtctgaacgaacccctcgcgggcgttctgtcgtttcgggccgccaaaacggcagaaatcccgcgccaccttcgttcagacgcgggcgttctgccgtttcagccgatgattgcctcgatatcgcacctgcgccactaagatagtaagccatgacaagctttgcagacatcaccaccatgggcgtgggcggccccatcgcccatttcatcgagccgaccacgcgcgtgggactcatcgaagccgtggaggaagccgattccaaaggcctgcccttggtcgtcgtcggtggcggctccaacctgcttgtttccgataagccttttgacggcgtggtggttcgagacgcccgacgcctcatcactgtgccggacgaggctgcaccggtagagggcgaggatcgcaccgtgcatgtcaatgccgaggccggtgccaattgggatgatttcgtggccttcaccgtagagctcgggctcgagggcgtcgagggactgtccggcattcccggcacagtcggcgcttccgtggtgcagaacatcggtgcctacgggcaggaagtcgccacttcggtcgaatcggtggaagtctgggatcgagacaccaaaacaacgcgcgacctcacacccgccgatcttcgattcggctatcgatactccgcactgaagaccagcatgtacgccggccccggccggccggccggccgattcttcccgacgccacgttacgtggtgctttccgtcacctttgccctgacccactcggccgaaggcacggtaggttacggacagcttgccaaagcgcttggcgtcgaagtgggcgaccgtatggccaccgccgacatccgcaaagccgtgctcgcagtacgtgccgccaagggcatgctcgaggaccctactcgctacgccttgcctgacatggccaccgccaagcgcgaggccaatatcctgaccgatctggagcgtctggcctccctcaatgaggccgccggcattcccgttggcgatgacggtctgcctgctcccgactacaatcgccacagctgcggctcgttctttatgaatccgattctgaccgccgaccaagcggcggccctgcccgaagatgcgccgaagttcgacgcgactctgcctgacggcactcccggcaccaagacgtccgccgcctggctcatcgaccatgccggctgccataagggatataaggtcgatgcggacgcgccggccagtctatccacgcagcacacgctggccttgaccaatcgtgggggagcgagcgcggccgatatcgcagctttggcgcgtgcggttcagcaggcagtcaagagcgcgttcggagtggacttggtgcccgaaccggtctgcgtcggtgtgctgtaatcgcgctattgattgatggagtgggttattaatcccatatattgcggactctgagtcttattaatagacaagacacgcgggctcttctatactcgattgtcggtattgtgcgcattcggtgcgcaaacaacagagaaaaaagaagagcactatgcaactgttccgtacaaaatccgtcgaacagaccattgccgaaaccggtgaagagggccgcaagctcaagcgcaacctgacttggtgggatctgtcaatcatgggtgtggccgtagccgtgggcgccggcatcttctcggtgggcgcgcaggccgccgccttccacgccggcccggccgtgatcatcagcttcctgatcgccggcatcgtgtgcggcgcagccgtgatgtgctacgccgaattcgcttcgatgattccggtggccggctccgcctacaccttcacctacaccacggtcggcgagatcatggcctggatcatcggctgggatctgatcctggaaatgctgatggccggctccgtgatttccaaatattggggcgtatacctcaacgatttcatgcgcctgatgggctggaacgccaacaccaacctgacgttcggctccttccacatcgatatcgccccgattatcatcgtggcgttctttaccacgctgctcgtattcggcaccaagatcggcgcccgcgtggacggtgctatgaccgtgctcaagatcgccatcgtgttctttgtggtgatcgtcggcttcttctacgtcaaggcctccaacttcaccccgttcattccgccgagccagccggcctccaccgtggaaggctcctccgccgtcaccggcgtgatgacccagccgttgtggcagttcgccaccggcatgaccccatccgtgtacggcgttcctggcatcctctcgggcgcggcgctcgtgttcttcgcgttcatcggattcgacgtggtggccaccgcctctgaggagaccaagaacccgcacaagaacgtgccgctcggcatcggcgtgggcatgctgctcatcattgtcatgtacatgctcgtggccgtggtgaccaccggcatggtctcctatgccgatctcgccaagcaagacagcccctcgctggccaccgccttcgaactggtgggcgccgactgggccgccaagatcatcagcttcggcatcgtgctgggcctggccaccgtggttatggtgctgttgctcggcctgacccgtatcgtcttcgccatgagccgcgatggtctgctgccgcgcggcctgtccaagaccggcaagcatggcaccccggccgctctgcagatcgtcgtcggcgcggtggtggcgctcgtggccgccttcttcgacatcggcgtgctctccgacatggtcaacatcggcaccctgtccgccttcacgctggtggccatctccatcccgattatgcgcaagaagcgccccgacctgccgcgcgccttcaagatgcccggcagcccgtggattccgatcctcatcgccgtggccaacttctggttgatgctcaacctgtccgtgctcacctggattcgtttcgtggtgtggctcgtggtcggcttcgccatctacttcggctacggctactggcatgcgcgcctcggcaagggcgacctgaccgaaacgctgtccgccgaaaccgataaggccgttaacggctgagagcgaggagcgtcccaacaggcgcgtacccttgtatcagtatttgttaaggaggattccatgccatatgtaatcgctcagccttgcgtggatgtcaaggacaaggcttgcgtggacgagtgccccgtcgactgcatttacgagggttcccgctcgctgtacatcaaccccaacgagtgcgtcgactgcggtgcatgcgaaccggtgtgtcccaccgaggccatcttctatgaggatgatctgccggacgagtgggcttggtacaaggatgccgctgtcaacttcttcgctgaagtcggcgatttgggcggcgcttccgccaatggtccaatcggcaaagacccggaacaggtcgccgcgctgccgccgcagaaccagtaagctgatttgcggataagcgctgcacacagcgcatagttcggattgaaccctcggtctatcacggccgagggttcgtcgtatcttaggaacataccgtccaagaaaggggttctcatgggcttccacgcatattcgtcgccatacgactggtctcgtatcgccggcttcaaagccaccgccaaaaccgtgccgggtggcatgatcgacctgtccgtaggctcgcctgtggacccggtgccgagcagtgtccagcaggcgctggttgccggcgcagacgcccccaacgcccatggatacccggtcgccgccggcaccgccgaccttaaggccgctatcgatacatggttccgcgaactgcgcggggtggatctgaaatccatcaacgctgccgccgtacccaccgtgggttccaaggaggccgtggcgctgacggccagcctgctgcaccttggcgaaggcgatgtggtcgtccaaccggctgtctcctacccgacttacgaaatcggtacccaacttgccggcgccaccgtggtcaaagtcgatgatgtgaccgacgtcgattcctgggtgaatattccgaacgtcaaggccatctggatcaactcgccgtgtaatccctccggcgaggtcatctccgctgactggctgaccgacatcgtggctgctgcccgtcgcatcggtgccgtggtgctctccgacgaatgctatgcgttaatggactggcgttcggtgcgccgcaatacagccgcgtcctctgcgcctgccgcgtctgcatctgctgcgtctgtgcctgccgcaccggtggccgaatccaacgagcccgcctccgataccgcattcagtctctccgccacgccatgtgccctgaatccacatgtgtgtgaaggttcggcagctggcatcctggtgctctactcgctgtccaagcagtccaacatggccggctaccgtacggctctaattgccggcgattaccggctggtcaaggaaatggccgaataccgcaagcagatcggccagattatccctggcccagtgcaggccgccatggccgcaggcctgaaggacacagccgctgtgcacgagcaatggaggcgttaccgtcgccgcctatccgcgctggttgacgcactgaaggcatatggctattcggcacaaatgccctccggcgcgctgtacgtatgggtcaaggccaagtccggcgactgctgggccgatatggccgagctcgccaagatcggcatcatccccagccccggcgaattctacggcgctcccgcctacctgcgtttctccgccaccgccaccgacgaggccatccgttccgcctgcgaacgtctcacggcgtaatgagatcgtaagtggcgttgagccgttcacgccccaaactgggcggccttgttgccgaatttgcggcgcacagcgtccagtgcggcctcggcatcatgcaaacgcgcctgtgaggtctggccgcgggcattgtcggcctcttcgagcatgtcatccagtgaaggctgcacggccgtagccgccgccttactgagcgaagacgtgctcataccggccaagcgaatagttttgggcaggggagtggcagactccgccgaggccggtagccccagcatgactttcagctgccgcacgcattccgggtacagcacgccggccgtatcggtcggccgctccatcgtaaaagaccgggtctgatagctcaggtcggcgaaccgcaacttcaccgtcagcgtgcgcgccaccagccccttgcgccgcagcgtgctggttacttcgtcgcaggccgaacgcagtagcccacacaccacgcgcatatcgcgtgtatcctcggccaaggtttcctcggacccaatggatttctcctcgcgtaccgtggtaatttcgcgggaatccaacccgtgcgaggccgcccataatccacgtgccgcagccggggagccagtggcacgagtcaatgcagcctcatccagctgagccaattcagccaccgaatgcacgccccaagcattaagccgcttctccaaagacggcccgattcccggaataccacgcaatggcatcatctgcacgaattcggccgagcgggccgcgggaatcagcagcatgccgtccggcttggcattggtcgaggccattttggacaccagtttgttacaggcgatacccactgaacacgtcacgtggaagcgctcggccacctgagcgcgaatccacgcgccgatcgcgctcggccgcccccactccagcagtgcggcggacacatccatatagccctcgtccaccgaaacctgctcgaaccggtcggtgacggtcaaaaacacctcatgcatgattcggtgcgacatcatgcggtaatacgccatatccactggcagaaaaatgccgttcgggcacaaccgatgggcgcgcgcggccggcatcgccgaattgatgccgtatttccgggcttcgtagctcgcggcggacaccaccgcgcgcggcccggtgccgatgattaccggcttgcctttgagcccggggttgcgcgccacctccaatgaggcatagaaggcatccatgtcgatatgcagcacggtgcatccggtctcgtcgtggccccaatcgcgtttggcggcctcaagtctcggtgcggtgctcatgccaccattgtaggaatgccgaacgaggtcatgctcactatgtggcgcgcatgacgcggcgctcattgtcataatgccgaatatcgccggaattccaagggtttacgcactgtgcggctgtttcgcatggtgggtgcgattccacggaatcgtccacattgcgtcactgtccgtaacgccttccaagtcaatgcgcgctgtcccggctctccgagtagcgtaaacctcatgaagaaggcagtggtcggtatcctcaaccgtgttcccgtggttcttatcgtgattggtgaggcactggtgatttatttggctacggccgtcgccaaacttgcgttcacccagctcgatccgctgtactcggtgtggtatcgcgtgggattcatggcggtgctgttgctgctgtggcgcaggccctggaacaaggcgaagcgagcgcaactgtttcaccgcgacgcccgcagctgggggctggtcgtactgctcggctgctcgctggtgctgatgaataccctgttttatgtggccatcagcaatatggatatgggcattgccgtgtctatcgaatttttgggaccgctttcggtggcggtgattaccggcaaaagctggcgcgagcgggtcggtatcggtatcgcggcggtcggtgtggtgctgttagctggcatatcattggccaatccgtccggcaatggcacgtttttgtatggtctgattgcgattttgatcggcgggtcgatgtggggcatgtatatcatcaccggccggcgcgtggcggctggcggcaattcgctggataatctgtgcatcgccgtgaccatcggctggctggtccagtccctgttccttggcgtgccggctgtggctcatgtggttcaccccaaggccgatgccacgtgggcgcttgagcccggcggctcgctgaagctgctggctctgctgtttgtgatttccctgatggcctcgttcattccctatgtggtggagcagatcacgctgcgacgcaccacatccggcgcattttcggtaatgcaatccatcaatcccgccatggcggtggccgtgggactggcgttcggcgagattcccagcgttggtgaaatcgtcggtgtggcgttggtgatttgcgcggttatcgttacgttctccggcgacgccgcacccgcggacgttcaataatgtgtcgttcggcacgccgtatccgcaggacgtggtacagtaatttgctgttgcgcattattgcgtaacgtggagtcatgcctgagtggccgataggggcaccctgctaaggtgttagtcgtgtaaacggctcgagggttcgaatccctctgactccgccgattaaggttccgggtgaaagctcggaacttttttgttttccggaaactccgggttaagtaactcctgaaataaccgaggacgggcggtctccgcttgtggtaagcggagtcggaggtacgccattgtccgtccgcctccaaaccgccattttagtgggcgaacgagtgcggcacgtcgggaaaagtccgagcgacgaaagaaaaatgtccactaagtgagacttttgcgtggtgttcgtgaatggtgattgaagattaaccggtttatatattgcttgtccaatcgcttgctcatcgcctccctccccgcagtacttgaccgagatgggcggtaccctagagagagaagaagagttccgaagggcgggcaaagatgagccatatcgctgggcaggggcaacatcgctccaactcgacacgaaccaaccgtgcggcgctgattatcgtgttcgtgatcgtgctcgccgttgcgctgggcatcggcgcatggttcgcaacccatcgcacggacggcaatggccccgcacacgccggagtgtcggacgtcgcgttgaataaagcgaagaacacgcccaaaccggtgaccgaacatcacggcaattcaccggattgcccggatacggactgcatcgccatgctggtcaacggcgatttgttgttccatgagggattgtggagccatttccaaggcccgaaccccaacgccacggatggcaccgccttcaacttcgacccgctgttcgcgccgatgaagcagtacattcaggcttcggacatcgccgtgtgcgaattcgaaaccccgatcgcccagcgcggcggcccatatgccgcgtacccgatcttcaacattccgccggaagtggcggatgccgcccgcaacgtgggatacaacgcctgcacacacgccaccaaccattcctgggatcagggggcggatggcatcgcccgtctgtgggacacgcttgaggccaatggcatcgcccagaccggctcgtacaaaaccgaagccgactccaccaaaccgttggtcatcgattccccgaccggcggcggcaagctgggtctggtcaccggcacggtctccctcaacggcatgaccgccgacgaggactggcaggtggatcgtctgcgcgaagacggcgacccgaatcacgacagcgacatccagcgcgcggtagacaaagccaacaaggcccgcgagcaaggtgccgatgtggtggccatcgccatgcactcggtgcaggaataccttgattacgccgattcctggcagatttcggaagcccatgagcttgccgacactggtgccttcgacgttatttacggtgccggttgccattgtgcgcagcccatcgagaactataacggcacgtggattatctacggtctgggcaacgccgtcaccgagtcggcgaacacgccggaaaccttggtcaacaatcagggtgtgaccgcacgcatccagttcgccggcaagaagggcgtcaaggggtcgtggcgcgtcaaccgcatcgattgggtgcccaccgccaacgtgcatcaaggcaactaccaatggtgcccgatatccagcgaccatcccataggcacatgttgggacgaagcctacgacgctcagatacgccaacgcatctgggatgtcatctattcgatgggcgcggaccagaacgtcgtcaaggaatggaacatcacgcaggagcaggcggcaaagcaatagttgctcggcttggtctcaaggaggggaagccgcaaggtgacgcttttcccgccggcctcctaatgtggagcccatgaccgagatttacgaaacccaaagcgaacgcaccgatctgcccctcgtcgtgatgccgtccgtgcttgactcgatgatcgagcccatcaaggcccagttccccgcgctccacgacgttgcccgcgtgcgtatgttcgaggaattcacgtccgacgaggcgaccatagccgagcgtctgaaggatgccgacgccctgctggtgggcggctaccacatttcggacgatctgctgcgcaccatcagcgggcaggggcacgtcaagtgcatcgtgttctgcggtaccggcgtcgccagctacctcaatctcgataaggcgcgcgagctgaagatccgcgtctgcaacgccgaacattatggcgatcacgccgtggccgagcacaccttcgcccttctgttcgagctcatccgccgcgttggccaactcgataaggacgtcaaggccggcaactgggcgtgggccagcggcgatggactgcaactcgccggccgtcgcatgggcatcatcggactgggcggcatcggctccaccgtggccggcatcgcccgcgccctcggcatggaggtcgccgcatggaattcgcatgtgccgcccgagcatttcgaacgctccggtgccactccggtcgacgatctcaacaagctcatcgaaaccagcgacgtcatctccgtccatctgccgctgaacaacgccacgcgcggcatcgtcaccgccgagaaccttgcgcatgtgaagcccggcaccctgttcatcaacaccgcccgctccgaagtcatcgaatccggtgcgctgcttgcccgactgcaaaagggcgatgttcccgccgcactcgacgtgttcgaccatgagccgctgaccgccgacgacgccatctgccatgtgcccggcatcgtcctgaccccgcacgtcggctggcgtgccgacggcgcgttcaaggagctcacccgccagatgatcgcctgcctgaccgcctacttcgccggcgaagactataacgtcgtcgtctccgaacgctgatagccctgcctagcctcgcgctcaatcgaacacccagccagtcgaccaccggaacacgctcatgcagacgattctcaacacgcccgacgatcctgcccacgattcgctcgtcgaaaaaaagtccgaatttatcggcgacgccgcccatgtcgatacgctcgacgaggcgctcgcgttcgtggctgcgatccgtgagcagcatccgaaagcccgacacgtggcgtatgccgccgtgtgcggaggcgcggatgggcgactgtccgaacgcatgagcgatgacggcgagccgtccggtaccgccggcaagccgattctcgacgtactcaagcagtcgggcaccaccgattgcgtggttgccgtcaccagatatttcggtggtattctgctgggctccggtgggctggtccgcgcgtactcatccgccgcatcattggcgatgaaagccgcccgcgccgcccgcatcatgaccgccaagcgataccgggttcgcctcgaatacccgcagttggcccgattccagcagatcctggcgcagcttggtggcagtcaggaggatgaatcgtatgcggtgaacgtcgagttgaccgcggtggtgccgcaggatgattgcgcgcgattcgaggagcgtgtgcgggaagcgttcaatgccgctgtggtgccggctccgattgacatggtcaacattccggttccgctcgcgtgacgcctgtatgactaagctgggcatcatgaccgacgagaacaccaccagccagcagacccagcccaccgaggccgcaaccgaggccgcggccgagactgcaaccgacacggacgcccagcagcaggaccaaggcgcgcagtccgcagccgagtccgccgctccggtggatttcgaaccgctgaccgctacatacgagcgtctgcgccattccaccgacccggccgaactgtccgaattcgcccgtcggccgttgcctgaccgtgccgatcaggcggcgttctcccgcgccaccgcacttttggaggctgtggccggcaacccgcacaccccggtggccgatcgtgtgttcctcgccgacaccatgccgttcccgaacgtattggtcaaactctccgaagaccccgaaccgtccgtgcgtcaagccgtggccgccaacggggacgacaagaattggctggtcggccgtctgaccaaggacccggtgcctgcggtccgggatacggcgttgaaaaacaagcgcaccagctggaagatgcggcttgagggtgcgcaggaccccactgcggatgcggagacattggatttcttgggcgtacttggcaccgaatccgaagagggagcaccggcggtgctttcttcgatggtccgccgtgccgtggcactgaaccccaatacgtccgaagcgatgcttgccaaattggccaacgacccctcggccgaggtgcggcacgccgtggaaagccgccgctaagcacactattgctgtgttttgccgcgcaaatttggccggcaatcaccccctgtccaccattgtgagcgctcacatctcactatgtgagggtaaaaagtacataatttggcggaatcatggcatttttcttacggtgtggcgcaatcaaacggcgttagactggggctatgagtgagattaccgagagtgaagagcgtctggcccgtccgttgattcgactggccaagttggtcggtgtcggcacgagttatttgggcatgagccatgactaccacgagatagacgatgacgtcctgatcgaggtgctggcagcgctgggcatcgacgcctccagcgagagcgcccaactcatcgccatccgacgcattctgaacgagcgttacgcccgattggtggcacccaccgtgctgcatatcgccggtagcgaggaccgggtgctggtgaacaccggtattctggacgtgccttcggcgagcatcacgctggagaatggcgagccatatcaaggcaccattgaagttggtcctggagatggatcccaggcctacgacttggatggtacgttcatttcgaatgcggctgtggtcattcccgccgatctgccgattggttaccatacgctgcacgtcaaggtcgccgaccgtgtgcaagacgccactttgatcagtgcacctgatcgcgtcgatctgcttgacccgatgaagggcggcagtctgtggggctggatggcccagctgtactcgattcgctcctccaactcctggggcgtgggcgattacgaggatctgaagaccatgctggtggacgccaagcagaagaccggtgccgacttcgtgctcattaatccggtgcatgccgccgagccggtgtccccgctcaccccgtcgccgtatctgccggtaagccgtcgcctgatcaacttcacgtacatccgtcctgaggcgatcgccgaatatgccacgctcagcgagggcgacaagaatgccgtcgacggactgcatgccgacaccgaaccgctgaacggtgattcccagctcatcgaccgtgacgccatgtggcgcagcaagatgcacgccctgtggattatctttaaggccggccgtaccgccgaacgccaaagcgtattcgaccaattcaaggcggactgtggttccgacttggaggcgtatgccacgtggtgcctgtgctacgacaagtggggagcacccaacggcgaggagagcaactgggagcgcaagttcaatcgcaactccccggaaatcgccaatctgcgcaagcagtacccggacactttggacttctaccgctggctggaatggattgccgccgagcagctgtcctccgcccaacaggcagccaaggacgccggcatgcatatcggcatcatgtccgatatggccgtcggcgtgcacccctccggcgctgacgtgtggtggaatcccgagcgcttcgccaagggagccacggtcggcgcaccgccggacatgttcaaccagcaaggccagaactggagccagccgccgctgagcccgatcaatctggagaccaccggctacgaggcctaccgcaatatggtgcatggcatgttcgcccgtgccggtgcggtgcgcatcgatcacatccttggtctgttccgcctgtggtggattcccgagaaccgttcggctatggatggcgcttacgtgtactacgactcagacatcatgctgggcgttctggccatcgaggcctctcgcgccggcggcgtggtcgtaggtgaggacctcggcgtggtgccggaccatgtggccgattccctgtcgagccacggtattctcggttgcgccgttgaatggttcgagcagtgcgacggcgtgttccgcgccccctcccagtggcgtccgtatgcattggcctccgtgaatacgcatgatttgccgccggccgccggttacctggaatacgagcacgtcaagattcgtgagcgtctgggcttgctgaccggcccggccgaggaattcgaagcctccgccaaggccgagcaggatgcgatgctggccatgctggtcgagcagggttatcttgatgccgactttgccgaacatcgtgaggatcacgaggcggatatcgtcgacgcgctgtaccacgcactgaagggttcgccgtgcaagctgctcgccgcctcgatcaccgacgcggtgggggagaagcgtgcgcagaaccagccgggcaccaacaacgaatacccgaactggcgcatcccactggccgacgccaagggcaacgtggtaccgctcgaaaccctcttcgacacccccggtgcccaacgcttcgcccaaatcttcaattcctgacccgctttacctccctctgacgagccgagtcgttaagcggacagtccagtggactgtccgtagacgaggcctgaaagaagcgatagctgagagaaggcagggaattgcctcaccgtaggtgagtcggttagccgaagtgggtgggagagaaaccataaataggggaagagaagccataaacccaatggagtgtccccagttgccctatgtcaagcccggcgatatactagtggattgttgtgtttccctaaggggtccttcaaagcgctatcccactcgccatcgaggactttcagggagcccacggataatgaggttcgacgcctcttggatgcggccctgaccaagccacaccaagcagctgagacccggaacacaatatagaaaaggtaatccagtgaaaactttcactccgaagccagctgatctgactcatgactggtacgtcatcgacgccaccgacgtggtgctcggccgtctcgccacccaggctgcaatcctgctgcgcggcaagaacaagccgacctacgctccgcacgccgattccggcaaccacgtgatcatcatcaatgccgacaagattgctctgactggcaacaagatgggcaaggagctctactcgcactccggccgtcccggtggtctgcgtcgtgactcctacgccgagctgctcgagaagaaccccgagcgcatcatcaagaacgctgtcaagggcatgctgccgaagaaccgtctggccaaggtgcagctcgaccgcctgcgtatcttccgtggcgccgagcacccgcacaccccgcagaagccccaggtcttcgagatcgcccaggtctcgcagcaggccaagtgaaacctgagaggagataagaatcatggctgaaaacaccaacgactcccaggttgtcgagaccgaagaggagctcaccaactacaccaccgagaccaacgctggcgctggcaccggcacctccgcgattgagccgggctacggcaccggtcgccgcaaggaggctgtcgcccgtgtccgtctggttccgggtgacggcaagtggaccatcaacggccgcactctggaggagtacttcccctccaagctgctgcagcgtgaggtcaactccccgatcgttctgctcaagctcgaaggcaagttcgacgctatcgtcctcgttgacggcggcggcaccaccggccaggccggcgccatccgcctcggcgttgcccgcgctctgaacgccatcgatcgtgatgccaaccgcgccgccctgaagaaggctggcttcctgacccgcgacgctcgcgtcgtggagcgcaagaaggctggtctgcacaaggcacgtcgcgccccgcagttctccaagcgttaatttcgcttgtcctgtaccgagcatacaaaggctctccgcggaattccgcggagagcctttgtgtttgtgtcgcgctgtcttgagtgtgactcacacctgcttcatcagcgtgatgctcagcgccggcatggtccagacattgtcgtcgacgggagtgtccggtgtatcatccacaggggcatcgggcatatcagctgatacctcatcccgaggcgcggacgaggtgccgtttgcggcgtgatctgttactggcatcgcgaatttgatggtatccgcttcattctcagtcgaggattccgtacgctgcatggccacttcttcgaccatcttgagtactgtctcgctggcgtccggtacatgctgcgtccagacggtggtgtcaccgttcaaatcgcattcctcgacctgagtgccatgcccggctcggcggccgttgatttcggccgagcaccatttaggcgtccagtgggtgtctggcggcaggcggaatgtgcggtcgtcagcggtgccgttgaccacaatgcacacgtccacctcactgttggacagcaatcgcatggtgaagctacgtacgcccagatcgaaccagtcacgctccatcggcgtggtaccgtcgggcaggaaccactgcacgcggcttgagggcttgagtaggccgatctgggtcagtcgggtgaagaaatcctcgtggtgatacaggtccagtgatttacgcagcgccaccagtcgagacacggtttccaagcggcgcatttcgcgcgtcttgttggtggaatacatccaatcccacttcagccacgtgatgtcgttgtcttggcagtaggcgttgttgttgccgtcctgcgtgttgcggaattcgtcgccggcgagcatcatcggcgtacccagcgagagcagcagcatgccgatcatgttcatggccgcctgttcgcgtgccgcaatgacgtctggatcatcggtgacgccttcgacgccgaaattggcggaatggttcaccgacgagccatcattattgttttcgccgttggcttcattgtgcttggagcggtatctggtgaggtccgtcagcgtgaaaccgtcgtggcaggacacgaaattgatggaggccggagcgccacgccctggttcggtggcgaacagatcggccgagccgcagagtcgcgtggccatctcctgcaaactgatacgcccgaaatcggagccgccgtccacatcctcaagccagaaggtgcgggccgtatcgcggaagcggtcattccattcggcgaacggcacggagaattggccggtgcgccagccgaggttgcccagatcccacggctccataatgagcttcaggttgcccagcagcagatcggaacgcagggcgtagaggaacgggtgatgatgggtgaattcgccttccaggcgggccagcgtgacgccaaggtcgaagcggaaaccgtctatgccgatacgcttggcccagtatcgtaatgagtcgatggcaaaggtgaccacatgcgtgttggtgaagtccagcgtattgccgcaaccggtggtgtcttcgagtcgtccggtattggatttttgatggcgatagtaggccaggtcgtcgaggccgcgccagcagaccgtcgggccttcgacgccgccttcgcatgtgtggttgtagaccacgtccatgatgacttcgaagccggcctcgtgcagtgcgcgcaccatgtctatgacttcttggcgcacggcggccgcgcccttctcctgggcggctttagtggcgtaggagggttcgggggcgaagtagctgagggtggagtagccccagtagttcttgcggccgtgttcttgcaggaagagctcgtcctgcttggccataatcggcagcagttcgatggatgtgatgcctagaccctgcagataggcgagcgtggtggggtgtgcgagtccggcgtacgtgccgcgcaatgattcgggcagccacggtgcgttggcggtgaagcctttgacgtgcatctcatagatgacggttttgcgccacggcacatgcgggtgctgcgggtcgccctcatgcttatgggtatcgcgatcgtcgatggccacggacaccggcatatggccgagcgagtctacggtgctcatggcaccatatgccgagccgattaccttgcggtccacgacatcgcattcataggagaaggcggcgggggtgagctccatggagccgtcgatgcccttgccatacgggtcaagcaggaatttgtatggattgaagcgcacgccgtgtttcgggtcccatgcgccgtccacgcggtagccataacgcatgccgtcccatgctttgggcaggtgcacgtaccacaggccgtagttcggcccggtcatgcggaacaaggtctcgcgcagatacaaatgttcgataatgcgtgtgcataccgggaactcatgaatctgctggataaaggagatattcgggtcctcgaacaggcggatggcgtcttggaagaaagcgctgggctcatcaatgggctccagtacgcatagccaaacctgatcggcagtttcggaacgaacaacgacgtcagccccaccgtcgtcagtgaagtacagccctgggcgagtggcgtaacgatgcaacggtgggtttttcatacctccattgtagacgtgttgtcacttttggtggaagcccttgatttcctgccgcgttccgcagcaccgcagatgccgtcgagataattctcggcgaaccgcaacgcggcaccgatgatgttctgatcttcggcgcagtagctcttgcgcagattgaaatggtcggtgccgaacgggctgcgtgcgatgacgcgcgtctccagatcctcgatgtcgctgtcttcaagatgctgggctgcttcaccgccgacaatcacgtcgcccgcgatgatggatcgcgcgttgacgatggcctgcgccacgtaatccagccactcatccatgcgctcgcgatgatgccgttcgccctgctcaagcacgctgaagaagccgggaatgctttcgtaatcctcgggcaaggtctccggcgagcagtaggtgtccatgcaaccgcgctggccgcagtagcattcgcggccgcccggcaccagcgtcatgtgttcgatggcgccgttgcactggttcgggccttgatacagtttgccccccgcgatcaccgcgccgcccgggcgtcgctccagatagacgcacaccgcatcggtgagcgtggagtcgaaccagagttcggccatggctgaggcatcggaatcgtggatcatcatgcacgggtaatggaccgattggctgatggtttcgagcgtgagcccagtgttgcccataattgtgccgaagatgatggtggtggcgtcgggggagaggatgccttggatggcgaacgagacgccgagcaccttgccgtgcttcttttcgacgtcggcggcgaagttgttgatgatgccgccgatacgctggtagtaaacgttggtgttgcggtaaggcagggcatcgttgcgtttttcgatgacgttgccgtacaggttaatcgcgcacaggcgcagttcgttggaccgcatcactaccccgatggcagtgcgatgatcgggattgaactcataattttgcgccttgcgcccgccggtggaatcctgcagttcgcctttgcggatgagtccgtcatcttctagtgcgtgcagattttgggtgatggtgggcaggctgaggccgagttcgcgttccagttcctgcttggtgacatggctatggccatacagatactgggccatggcactgcggttgtgcgctttcactgcggtcgatggcattgccctcatgtttacccctttgtgcgatgagatatatgcaagtttactttatgaaagtggctttcatgtgcctcgacgcggaggttatgaggcaacaatcgtatatttgtaggcgattttgggtacttttttaaaccaactttctagaaatgtggagaaaatgattgcttttgaaaacttactttaaaaaagttctcggattgtgttgtttgcaggcatgtgattttcggtaaaaagtgaacaaaaagtaccaaatcgccggatagagtgaggatttgttcgatatttcgcacaactcgtaacaaaaactgttcaatatcgcacgtgaaacgccgtcgattttgtgcgtatgcatcgcgccggaccgttcagtatattgtgcctcaggtcacatatgcaatgtgacaacgcatcaccggtcattttcggttactgaggcggtatcccgctggtgcaactgaggtgacgaggcgatggcccagaactttgccatataccccaagaagatcgaggaggaccccaagtggcagaagcaaagaagaaggtcgaagctaccaagccgactccagaagagaagcaggccgcagctgaggccgaagttgacgcgctggttgcccgcgccaagaaggctctcgtcgaattcgagaacctcgaccagaagcaagttgatcgtatcgtcgccaaggcctccatcgccgctctgaacaagcacctcgttctcgccaagatggctgtcgacgagaccggccgtggtctcgtggaagacaaggccaccaagaacatcttcgcctgcgagcacgtcaccaactacttggccggccagaagaccgtcggcatcatccgcgaagacgatgtgatgggcatcgatgaggtcgccgagcccgtcggcgtggtcgccggcgtcaccccggtcaccaacccgacctccaccgccatcttcaagtccctcatcgccctgaagacccgttgcccgatcgtcttcggcttccaccccggcgcgcagaagtgctccgtcgaggccgccaagattgtgcgcgacgccgccatcgaagccggtgctcccgagaactgtatccagtggatcgagcacccgtccatccaggccacgggcgccctgatgaagcatccgggcgtggccacgatcctcgccaccggtggtccgggcatggtcaaggccgcttactcctccggcaagcccgccctcggcgtgggtgccggcaacgccccggcctacgttgacaccgatgttgacatcgtgcgcgccgccaacgatctggtgctctccaagcacttcgattacggcatgatctgcgccaccgagcaggccatcatcgcccacaaggacgtctacgaccagctcatcaaggagctcaaggtccgtaaggcctacttcgtcaacgccgaagagaaggccaagctggaacagtacatgttcggctgcactgccggttccggcgtcaagcccgtgctgaactccgcggtgccgggcaagtcccctcagttcatcgccaaggctgctggcttcgagattccggccgacgccaccattctggccgccgagtgcaaggaagtctccgacgacgagccgctgacccacgagaagctcgctccggtgcaggccgtgctcaaggccgacaacaaggagcaggccttcgagatgtgcgagaagatgctcaagctgggtgccggccacaccgccgccatccacaccaacaaccaggagctcgtgcgtgagtacggcgtccgtatgcacgcctgccgcatcatctggaaccagccttcctccctcggcggcatcggcgacatctacaacgccatcgccccgtcgctgaccctgggctgcggctcctacggcggcaactcggtgtccggcaacgtgcaggccgtgaatctcgttaacatcaagcgcattgctcggaggaacaacaacatgcagtggttcaagatcccggccaagacctacttcgagccgaacgccatcaagtacctgcgcgacatgtacggcatcgagaaggccgtcatcgtgtgcgataaggtcatggagcagctcggcattgtcgacaagatcatcgaccagctgcgcgcccgctctaaccgtgtgaccttccgcatcatcgactacgtcgagccggagccctccgtcgagaccgtcgaaaagggcgctgagatgatgcgcgaggagttcgagccggacacgatcatcgcggttggcggcggctccccgatggatgcctccaagattatgtggctgctctacgagcacccggaaatcgccttctccgacgtgcgcgagaagttcttcgatatccgtaagcgcgccttcaagatcccgccgctgggcaagaaggccaagctggtgtgcatcccgacctcctccggcaccggttccgaggtcaccccgttcgccgtgatcaccgatcacaagaccggctacaagtacccgatcaccgactacgcgctgaccccgtccgtggccatcgtggacccggtgctggctcgcacccagccgcgcaagctggcctccgacgccggcttcgacgccctgacccactcgatggaagcctacgtgtccgtgtacgcgaacgacttcaccgacggcatggccctgcacgcggccaagctcatctgggacaacctggctgagtccgtcaatggcgagcccggcctggccaagaccaacgctcaggagaagatgcacaacgccgccaccatggccggcatggcattcggctccgcgttcctcggcatgtgccacggcatggcccacaccatcggtgccctgtgccacatcgcccacggccgtaccaactccatcctgctgccgtacgtgattcgttacaacggccagattcctgaggagcccacttcttggccgaagtacaacaagtacatcgccccggaacgctaccaggatatcgcccgcaacctcggcatcgacaccggcaagaccccggccgaagccgtggagaacctggcgaaggccgtcgaggactaccgtgacaacaagctcggcatgaacaagagcttccaggattgcggtgtggacgaggactacttctggtccgtgctcgatcagatcggcatgcgcgcctacgaggaccagtgcaccccggccaacccgcgcatcccgctgatcaacgacatgaaggacatcgccgtcggtgcttactacggtgtctcccaggcggaaggccacaagctgcgcatcgagcgcgagggtgaggccgctactgaggaagcctccgagcgttgattgcaggcggtttgtggttggtggcaccatcagtagccaccaaccgcggtgttgcagcttagtgtctgcatagcgcgacacaaggagcccgaccccattacaggggccgggctcctttgcatatgtggcgctccctcagccagcaggtacctccatggggcggtaacccactcatggggcggtaacttggtgaaaaccccatggggcggtgtacaaaaacggctctattctgcggaaggtaaaattttaccgtccgccccatgggtcaattaccgccccatgagtgggttaccaccccatggaatcgctgaagcgtcgctaaatcgccgcaataatgcagccaaaagcaataaagctggcaaacgcctcggtaatgccggtcaccacgggcttcaaggttgtgcgccgtgtaaccaccggcaacgcaacggcgcgggccaacagcagcacagtcatcgcaatcagatacgggctgcgtccagccggcacggcggctagcagcaatagcgccacatgccatacccacgaagccgccacgtacgaacgcttcccgcgttcccggatcatggttttgaccaccaaaaccgacccatactgcgtcagcgcaaacagcacggtggcaatcagcccgctcacgggcaatgaacccgcgggccaccaggcgtgaaggtcgaatatctggctcaaatctggcatattccgaatcgcggcgcgtgcggcggtgacatcagcggctgcgcacgaggcatgtgctgcgttgatgggcataacacatgccgtctcaacagtgctgccaaacgactcgatcaccgtggccatggccgacgcggcaatcaccgacacggcattgccccacagcgagcgctccttcctcagccacgaggacagcatcgacagcgcaaccagcactatatataagggagcccaacgcagtatgccggtatgcgtaatcaggaatggcaagccgatgacgatgagcgctacggcataagtgagcatcggcggcagataacggcgtgaaaagtgtgctttgaaccagtgcgcggcgctgaactgcacgcaatagcacacggcccacgtcgccaatagccaaagcgtatcaagattaggcccgccgataaagaagccagccacagcgggcagcataaccattacccatgcgccaggttggttgtcgaaccaatcgcgtttaagagtcttgcggcgggaagtcatatctgtcatgatatcgcagcgaatggttctcaataagaacccgttgtctaaatgaaagtgcaacacccgttagattggaaattgcctagaaaacgttttctaggcaatttccaatctaacgggtgttgcactttcatttagacaacgggcccttgcgcaggtgccgtaagactccgcggacaaagcgatgaggcttcccccgcgagaagggaagcctcatattccattcattctattcagcgatgatggcgcctaatcaccgatcatcctttgggaacagcgcatcgaaggcatgttccatcacggacttacggcggatcacaccgacgagtctgccatcagcatccaccaccggcagtttcttgaactgcttcttggcgaggattcgggccacctctccgacatgctggtcgggcgtggcggcaacgaccttacgcgtggcgatgtccatcaccttcttgccggagagcgcctgcaccttggaggccacggtttcgtcgtcgaacaccaccatcgtcgaaccggtgccggtggaaaccgtacgggattcataggtggcaatcgatttcatgacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgattccgccgatggactgttcctgggcctgcttgaacagggaggcggcgggggccacgtatgcgccggcgtagtgatgctcggcgggctggccttcagtggtttcggccgcgacttcggcggaggcttgcgcctcggaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcatggatgtttctgcggtgaccagaagcgaggtcgcaatggctgccgcgatctggcggccggtgttggcgatggcgtttccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatacccacgcctcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgagataatgacgaccggactgctccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacaactgcgatgccaatgaacatcgggcgccatccgaaactgtcaatcaccagaccaccgacaaccgggccgatagccgggccggcggccatgacgataccggccatgcccatggcggtgccgcgcttatccggcggatagacgagcatcggcactacggcgaccaatggcagcagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacaacgatgaatcgggtgtgcgaatcaataggctttacggaactggtggcggacccgagttccgcggttttctgtgaggtcacagcatttccttctgttggtaacgtcatgtgtggcgatccggccccatgcttgtgtcaagacacgaggacaccgatgagtccggacgtaaaggaaaagccgccatccgttccgcattcatatacggcaaacgattcgcggctttgcgtaagttgatggctatggtgagcgattcatgcgacgtcgactgcggatgggccatcggtacatcccggcataaggcgtgtccccgctacaccagcatcgagaatagggccatttgtggattggcaaacagaacattgccgacgaacgacccacggcaggcgcgtgcgatgaacatcgcgtagcgatacaggttcatggcatctccttgatgagtcttcgtacggcaggcatcgagaagcctatcatcattcaaatcgacggtgaaacccacgcatgctcgacaatacacaaaatcttcacaagaggattgggcttacgcatacgctccgcctgaataacggtccggggatgaatcaggggcgagctaagggttgcgtctcgtgtttccgtcatgatttctggcaaaatagtgaagctgaacatgcgcggaatcgaccggaatcggaaagggactaatcatgcgagttctcggcaatatcctgtggatcattcttggtggattggccatcgcaatcggatgggcattggtgggactgattctgtgcatctccatcatcggcatcccgttcggcattcaagcgttcaagatggcgggactcaccttgacgccgtttggcaaaaccgtgcaatacggcggcggagtcggctctgccttggccaacatcctgtgggtggtgctggtcggctgctggatggcgctcggctatctgggtgcaggcgtgctcaactgcatcaccatcatcggcattccgttcggcatccagtcgttcaaaatggccaagctcgcgctctggccgttcggcgcacagatctacagtttgtgaattactcgaaatcacatacctacaaaaccaaagattgttgctgtaccaacgtctagtcgttggtacagcaattacggcaacatctccccttacaggaagaagtcgtcaatctctgcttcattgtgcaatatctcggtttcagagacaccaatgaatcttgccaaatcaacagatgcggcgaaacgtagctgtatatttaaatcaagattgaatgcataagtctgcagctcccctagtttccggtatttttcgagaagagtttccaatatttgcgcgtattgcacgtcgagattcgcgacgaacaagtccgctttgcgctgatattcagcgatgattgcccgctctcttgcactcaatatgttcttgccaagaccaagcacattcgaagcgacaattgacccgataagcgcgcccacaacgggaacaggaataagcgtctgaccaatcgccgctcctaccgccgcgccggtagcatcaagggcattgatagttaccaagctcaagaaaccgtcatcatcaatctctccggaacggaatttcatgacagcatctatgagtccaaaagttccggacgctatcgcccctgcgctcggagccgaaagatgacagacattggtcaatccataaattgcatagcccgaaaacccgcctttgaaggcaccctctgctgtcttgacgcctccttccttccaatcctcagcggtaaactgccatatttccttgccttcttcgtgcttttgatacacgaaaatgccgaagttcaatccaccttggatagcagcacccaccccggcagctttgttagcctcgcctagattcggctgagctttgtgatatgcagcagccttatccgtattggccttattggagatttcgctcttttgctcggatgtctgccgtttaatattgtcggtttcttcagtaaaagtccggtcaatcgcttctctttggacctgatcatatttcaataccgatgattgcatccatttgtcccaggacagtccccggatgttactttcctcttcgataagctgcttaattttctgcacttggttactggttagcggttgtccgttgagaaagacttctttatcgccatgcatgaccgcacgaaaaatgtccatgtggtcctttgaaaacatcatatccatagaacggtattccgcagatgtcttcagctcgttcattaggttcgcatagaactttacctgcactggcttgccgttaatcaacaaatcagcaggaccattatcattaagcgtaattgttgatttttccaacccttcaaatgctcgtctggcgttagcgattcccgtctgcgcgaattcagcgataaatccatgcataccattttcaccaccacgcccactgttgacaatgttcatgacattttgattcgctaaatcaaggttccttagcgcattagcttgtcgctcggcgagatctttcagctgacctgtttcattattaagaatctgtctcaatgtgtccatcagagtagacacacgtagctgattcaaataatcaatatacgcggcaatgccctgagcaacattgttatcgatggcgtgcttgtcagcagtattcttgtcagtcatcgagttccagttccttgttaatcatttgcgctaaggtgagcgtcatattgaccagtaatcccgcctgcattttctcttcgtgggagaactggctgtaatcggcgcctgtcaccgcagcattcgcacgctgtacaccatctatctgagtttgcgttgcctcagtcaatgccgcgacttcggcattcttcgcattgaatttgcgaattaatacttccacattctggcgctcaagcaaaagcttgtcagcagtttctttgtttttatgattcgcataaataccagaaccaattgccgcagcgcccgccacgccagcgatggtccatccaaccggaccagccaggcccaggaacgcggttccggctgacatgccaccgccacctgcagccaatgcaccgccaccaagccaagccagagcagcactatttgctgcagctccggataatgcagaaatggcagtaccggtcgaagctacaccgaaggtggtggccacacccattgcagccgtaggtcccatggttgctactgcgattcccaaagcactgagggtggcccctgctccagaccctccttcagctgcttttgcttgcttttctgcctccttaatctcatcctctttattctcgaacgtcgttacttcggtattgatcttatgcagttcaacggcaaattcttttggcgtattagccaattgattgatatgttgttcaacatacttgacatgcacaatagcgatttttctcaagtcatacagcgcttgcgtacttttagctaaatcatccgctacgttttcatagcgttctacggcattgttgtaatcctcgacagccttagctcttagtttggaattaaacaaatcgaccttatcggcactatccttgacgtttttagcgattgagacggtaccctttgccatgctgtcagccgctttgcttacttcgccacttgcgacggccgcagactgtgccacgctccctgcaacagctgccgtcattttgcccgcatcgccggcaagcttacccgcatcgttgacgatcttacctgcccctttggcaacatctttcgtgatttttcccgctgtgccaccgatatttccggctattttaccggcttgtttggtgaaatcattaagacctttgcccaaattatcgaacatgttgcccatggttgttgctccccttttcacgcacctgccatgatgtccgtcatcgacggcaagtgcttcgttgcacttataggccaagtgtactcataattacgtagctgcggtacatgaccatacatgcacactgcgtagtttgacggattcgcgaagaagcccccatgaatgaccaaaacgtaacttgcttacacacaccgtgatttgacggatttggacgtaagaccttatggtgtgcacaccatgattcaacgtatcgcattcagcagcaacggcgtgaacgaacacgccaagcgtcagcagatgaacctgccggcgatgctcgaatgcgccttcaaacagggtttgcgcactgctcagttccagccaataaccggaaacaagcgcagcctgctcgctgccatacaaatctgatcagtacacctctcattggcgcatagctgaatcattgccggtgatatcgagccgactcgttcgcaccatgcctcataaacgcacctgcacgagcatgcgttcttggcatagtcgcaactcaatgcaccgcagcaaaacccattgcataccatcacatattcagaaagaacaacagatcatgaagtatttcactactgacacgcatttcgggcatccgctggtcagcgtgctgcgcggattcaccacgttcgaccctgggcacacgcagtatgacgctctcctctcctcgcagggacgcaaggccgccgaggattgggcgaagggcgtggtgcttgacgattcccggctcaatttccgcaaggccgcagacaccgatgcgcacgatgaagcaatcgtggccaatatcaatcggattgtcggcgaggacgacgagctgtggattttgggcgatatcggataccgaacatcggtccggcatctgaagagctgcctgcgtcagctgcgctgcaggcatctgcacgcggttatcggcaatcacgatgactggtggctggacgatgcacccgcgcgagatctgttcgaatcgattgagccgaacagcacggcggagctgaccggtctcggaattggccgcccgcaggcaacggagaccgtcaatctatcgcatttcccctaccgtgaggatcttgcctatggctggccggatgatgccgtacgtttccgcgatcaggcattgccgttcgacggacatcgtctgctgtatggtcacacgcaccagctgtctccggagggcgcacgccacgaagccctcaacgttggactggacgcatggaatctgcaaccggtaagcgaaacacagattgccgactggttccatgcacacgcgaccgattcaacgcacgtatcaccgctggatatgcccgactcccccgggccggcgcccattgactccgccgcacagcaggaaccaggcggctcggtttcggcagccgaatcataatacaagcaatattggggcgagcagaaccttatgccatcgctgacacctgtctcgccccacagcacaacgaaaggagcttggctatggcaaagctcattattctgcgaggactgcccgcttcgggcaagtccacgtgggcacgctcatggtgtgaggaccccgccaacacgtggccgcattgcgtgatttctctcgatgacattcggctcatgatcgccggctcggcacaggtccgaaaccgactgcaatccgagcacggcaagcgattcaatgacatggtggttgccatgggacggcacatgattgccgacgcattggatgcggggtgggatgtggtggcggatgcgcaacacgctaatccccggtatgcagccgaactggcgctactcgctcaacgtcatggcgcactgtgggaaacgagggattttgacgttcctctagacgaattgttgcgtcgcaatgcggcgcgtgataccgctgaccgtgttccggaagattacattcgttcgtcctggaagcattttcacaccgcgatgttccgcccgttggaaccgggcgatccgaatggaaacctgttggagcgtatgcgcgcggacccttacgttcgggttattccggtgcgcggcgaaacagacgtgtatgcgtgcaatttcactgcagaggcatttcgtgaacatcggtggacggatcgcaccatcaatgcgcgagggctttttgtcggcggcaacggtcaggtggtgcaacgcgggttcgagaagttctttgctgtggacgagacggaggagacatcgttcgcccaagtcgtcaatcacgctcaagaacatccagagtcgttgcccgtgcgcgttgagcgcaaggagaacggatttctcgggctcgtgggcgcggcgggaactcctggattgttccgcttctggtcgaagtcggggcaaacggattattccgcgcttatcgagcgcctgtttccttcagattcagcggtacgtgccgaattgtggcgtatgttgcatgagtggaatgtcacggcggcgtttgaagtcatcgatcgcgagtccgaccggcacatcgttggatacgaatcatccgggctgcgcttgctgcatttgattcgtaatgccgaatcgttctccatcgatgccgctcacgaggaaacgttcactcttgccggcggcttcgtgcggccggaaacggtggcgatctgccattcgccggaagaagtcgcccaggcaatcggcgacgccaaggcaagcccgcatgaaggcgtggtgctatattttgccgacggttggatggtgaaggtgaagtcagaccggtacaagttggtcaaggcgatgcgccctcttatgcaacgcgtgctgctgcgtggtcgttccttcaacaagtccggcgacattgccgatttggctcgccgtatcatcgattacgcacacgaacaccacatcgacctggcctacgagcggcaggcattcggcgagcgcgatatcgatatgaccaaggtcaatgacatcgtggaccacgtgcggtgactgctgagttctagcgcaatatcttctgaccaacgtatgtatcacgaaagcatgtgtcgtgaaagcatgtattgcgctagaaccaaatcattctcgtggaggccggataatgaatctctatgctttgaacatgacgcaccatatgccggcatttccttgcgcgaacaactgttcattacgaacattgtactgatgccgttacagaacagaagagggtgctgtcctagcgccaaccatccgacccggttctgccaggcaccgaaccgattcgacaaggacgccgtgaaagacatcatgttcggacgggatgacacgaagaaggactccaacggagtgaccgtcatcccctattccaaactagacgagcgtgcactcgtggaactcgccgcataatccatctcaatactgcatacttgaaaccgcctatagctgctcttcgtaaacactgaggcggtttatcgtgtctctttgcgtctcgtcacgatgtttatcgcggagcgggtatcgccgacatccgcgacatctatgacaaggtcgtgctcgacgaaatcgatgagagcgatcagccggacggcgacctgttccggaaaggcgatgtggaaatacaggggccgcagggctggtcgtacagaccggaaaacgtccgctgaaaatacaggtatcgaaatcattgaggaatgttctcgtcacaggagtcgacgagaacgcggaagcccaagaaaggtggacgcaaacacctcatctcaacgaggttcatagaggttcgtaacatgaagaaaggtccgggcaaccaacactgctcggacctttccgcaacactccccctcagtcgctttcagcgacagctcccctcagagaggggagccgaggaaaactacttggagacgttgaacttgaactccacaatatctccgtcggccatgacgtagtcgcggccttcctgacggagcttgccttcctccttgatcttggccatggagccgtcggcggccacgaaatcgtcgtaggagacgatgtcagccttgatgaagcccttttcgaagtcggtgtgaatcacgccggcggcctgcggggcggtccagcccttgtggatctgccaagcgcgcacttccttgacgcctgcagtcaggaaggtctgcagtccgaggatgtcgaagcccacgcgggccagctggtcgagaccggactcgctcaagccagcgtcggccagcatttcgcgggcgtccgcctcgtcgagctcggtcaggtctgcctcgaactgagcgttgaggaacacggccggagccggggccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgcccctcagatccttctccagcttgggcagcgcgttttcgatggtctgcaggtcggcgaggatcagctcggtgttgatggtgtcgatgtcgtcggccggatccaccttgccgttgacgtggacgatgtcatcgtcctcgaaggcgcgcacgacctcgcagatcgcgtccgcctcgcggatgttggccaggaacttgttgcccaggccttcgccttcggaggcgcccttgacgatgccggcgatgtccacgaaggtcaccgtggcgggcacgaccttttcggtgtggaccagcttggccagcacgggcaaacgcttgtccggcaatggtacgatgccggtgttcggctcgatggtggcgaacgggtagttttcggccagcacgttgttgcgggtcagtgcgttgaacatggtggacttgccgacgttgggcagtccgacgattccgatagtaagagacatggttccctagcttagtattaggcttcgatggcgtcgacggccttgatgaccgcaccgcggaacgcgctttcctccagcgaggtcacacccttgattgtggtgccgcccggcgagcagacggcgtccttcatgacgcccggatgggtttcgtttttgaggtatagcgcaccgacgccttccaccatcttcgcggctagacggtaggcggtggcacgttgcaggccgtatttcacgcccgcgtcgccgagcgcctcgatatacatgtcggtgaatgccggtgcgcagcctgcgatgcacatgccaatgcccatatgcgcggaatcaacgcgttcgatgaggctgatcgatgagaacagccgctcgaacacttcggcttgcgtgtcggtcagcgtgttgtcggcttcggtgacgagtacccccttgccgacggccatcggcgtgttcggaatggtgcattggatatgcgccgcgttgaaatcggcgccgaacaagtctcggtatttgtcaagatcccagcccgccgcgatggatacgacgaatttgtcttcgtcggcaatcgcgccgatgactggcttgatgacactttcgatttggtacggtttgatggcgatgacgaccatgtcggacgctgcgacgacttcggccgcgttgtgcaatggctttgcacccactttcatcgtggtcttttccagcttgtcgtaatgcgcggcgcaagccacgatgtcggcaccgtcgacggcgccggctgcgacgagtccttcggcgatggcctgcgccatattgccgtatccgatgaatccgatggttggattggacatggtgtcctccttgtcgtcttttctaatggacgtaattgttttggatgcgatggtttcggagaatttcgggaatgtcagaacagttcttccaggtctcccctgttcaacgcctcgtcgaacaggtgcttgaacaccacggaaccatgtacgccgtcgtgctcgaattcgttggtggtccaatagtgcgatcgtcccacacgggacagcgtatcgaattgcagaccggagtcgacgtacatgtcgtcaaaatagacggcagcctgcagcggaacctcattgcgcgccaactggtcggcatcgtagatcgtgccgaaatgcgtgtcttccataagcacgtccatggctggtttgaacggacgcaacgcacgttcctgctcgaacatccacgggaacatggcctcgccggtgaaattaagcggacgaatgtcacccgcgaattccggatgctcgccgcgcacgcgctgtgcggcccagcaaatcggcgcttccagctcaccgttggcgtagatgaactcctgcaacggccaatacaacgggcgagatgaagtcgcatccatcacggaagacaggaattcgtcagacagttccgccgaggtcgaggccgacccgtcgccgtcaaggaatgcctggtcaagaatccaatgcacgcgttcgaaactcggcttcatgccgaaatcggatcccaagcattggaagcgttccaccgtgagcggatcgccgttcggcaatgtgaccttgcgcgattgcagaatgtcggcgacggccgcggcacgttcgatatcgatcgggtaacgctcgtagaactgcttcgtctttgccgccatgcgcgggaatgtatgacggtacacgtcggtcgcatcggcgggaacatgaggaatgccgcccgtggtgaaactggcgataactccttgcgggaacagcgaaagatacgtcaacgtcaggaatccgccatagctttggccaagcgtgacccaacgtgcgcccccgaattcggtacgacgcagatgctcgaagtcacgaacgatcgaatcggcgaggaaacgcttcaaaaacgcggcaccggccttgccgtcgccatccatgccctcaatcacatgcgtatcgacacgagacgaacgcccagtaccacgttgatccggcaacaccacgcggaaatgcttgatagcctcctcaatccaaccatcggaacttggaccgagcggacgcggaccggaaccaccgggaccaccctgcaggaacacgagcagcggcagatcatcatgcacatgttcgggagcggtgaccacacggtagaacaggctgatcgattcgccatcgaacccatgaccgggctcgtgacccgtccaatccaacggcaccttgatggaacgatcctcaatatgcaatccgggcacgtagtattcgctcagcaacgtcatgcattcacctttcctttggcgtcatcggcatattcaatgcgagtagtgactttttgatggcttccatcccacccacatgcggagacaaccttacctcacaaaagcggctttaccttaccgctatttcattcctgcgcatgatggcgtcacagcatatctggcgctagggtggagcatatgtcgaatctcaagcagcgtctcttgtcatggatgcatggccatgttttcgcaggcgatctcatcatcacgcttgttataggtgttctgctgttcggcgtgaccggcggcatcacctataatccgggattgctgtttgaccttaagccttccacgcagatgacatgggaagcggcaatgcttattccgctgctaatccgtcgatggtggccacagaccggagcgttgctctgcgtggcattgaccttggcgcatctcatattcggcccttgcctgttgggtgccgatattctggcattgttcatgctgtattcagtgatcgtctacggcaatcccaaaaacacgaaagccttcattattctggcgttgaccatcggtcttctggcttcggcgctggcggcatggaccatgaccaatggaccactgctcaccggaggcaaagtgcatacatggagcagctggaatgactcaaatccaaatggcgttatggtcacggaagacactctcggttccatctacacaggaacatccatatcggaagtcgccgacatggtggcgcattccatgctggtgctgacgccgattttcgaagtatgtatcatttccaccgtcattgtagcgttctggcagcgtgcccgtctggcaaccattcgcatgatgcgggaacgcaatgaggcaatcgccgcgcgagaccaggatgaacgcgatatcgccgcgttggcggaacgcgcacgcatcgcacgtgacatgcacgatgtggtggcgcacaccctgtcaatcatcatcgtgcagtctgatggtggtcgctatgcaggcacgcatgatcccgcggtggccagaaacaccatggagacgattcgacacgaatcggaacgcgcactgcatgacatgcaacgtcttctgggagtattcgggggttcaccgcacgccgattataacgatatcggcaatcttgtggaacaagcgcaaaacgtctcccccgacattcgaatccgacggaatatcaccggcaccgccagcccggaacaactcggcgaacaagcctcgatagcttcctaccatgtagtgcaggaggcactgacgaatatccgcaagtatgcggggccgcacgtcgatgtgcacattaaagagtcatggaacaacggtttgctcactttgaccatcaccgacaatggtcatggcgcggcggccaatatcgacgggcatacgccaggttacggcctgctgggcatgaaagaacgcatcgaatcggccggaggctcgttgcaggctggccctaaactcggcggaggcttcgaagtcatggccaccctgccttacggcggtaaagaacaggtgacagaagaaaccggcgaacagtatgcctcggaacagtccgaatcgtgcaacacaactgccatatccagcaaagcgaaactatccgacgaagcaatcgcacctcacacagtcgtcaacatatcggcgcgaatcccagatcagccatcggagcaaacgaaggaaaccaaccaaccgaccggtcgcgatcatcgttcgaatgcccttcaacatttgcgcatcaccgcacccaatctgcatgatttgctcaaatcattgaaactgaaatccgtagaacttgcaaatacatccaattcgcgagggctgaattgggtggaacgtgtttccgcgtggacgcagcgccattatgcgctcatggattccgttggtgccgtggcattggtcatgctgctgaatcgcatgtcggttacgttcttttttgatagttcacctcatgcgcagctctcaaatgcgatcgccgcatgctgcttgctggcgctggctcttcgacgcaggttccccgagacttgcgcgcttattgtgttcgtattgtcagttgtgcaattggtgtttttgggatcgattgaggttggacatatcgtagcgtcgctgtgtgcgctgtattcagccgtattgtatgggcgtgaacacgcatggcgttggaccggtcttgccgccgctacctgttcggtgctgatgggcttgaaaatcgcggctgatcaacacggatacactaccttgttcggcgccatcgccgcttttgcaggcttgacgaaaccggtttcagtcacgtcaagtactacggcggcgttctttaccggcgttatgtatacggttgcagtgctgatgctgtgcgccggcattatggcgtgggcacgttgggctcgttccagtgattcaaacgcactggtgttgcaggcgcgagaggaagcgctggtggccgagcaggagaagcagcgtattctcgcggcgaatatggaacgtgaccgtatcagtgccagcattcaggctgaagtcaccgccacgttgaacagcgtgattagtcaagccgtcgatggtatccgcatgctggatagcgccgaagcacaaggcaaagagcctaccgccgacgagatttccacagcgttcaaagccattggcgaacaggggcgcgccgcgcttaaacgtatgcgcgaactgcttggcgtgcttcgtgagactggtttcagcgatgacgctcatgccggtagcgcgaacgaactgcagttgaggcccgcagcaccgttggaggagcagctgcagcgcgcatctcaatagccgattcaagttttcagggagatttaagggtttgtttcgcgctgtgagcggaacaatgccgataaggtggagagtatgagtgaagaacagaagattcgtgtggtcattgccgatgatcaggaattggtacgtgccggtttcgccatggtgatcgggtcccaacctgatatggcggttgcggcgcaggctcgcgatggtgcagaggctgtggcgttggcggaaacactgcatcctgacgtggtgttgatggatgtgcgtatgcccggcatggatggtattgaggcgactcggcagatcagttcgttgcagcatcgctttgctgccgatggaacgcaatcagaagtcgcccgtaccaaagtgatcattctgacgacattcgatttggatgaatatgttatggctgcgatcactgccggagcttccggttttctgctgaaagatacggaaccggaaacgttgttgaattcgattcgcacggtttttcaaggtaatgcgattatcgcaccgtccgccacgaaacgtcttatcgagaaaatgatggaaggcgatttcatggctgcgaatgttggcgcacatggaaattccactacttcttccacttctgattcgacgtacaccgatccggaattagatgaactgaccgatcgcgagcgcgaagtgcttattgagatcgcgcatggattgtcgaatcaggagattgccgacaagcttttcatcagcctgccgacggtgaaaacgcatgtggcgcacattctgtcgaaaatcaatgcgcgtgaccgcgtgcaggcggtggtgttcgcctatgaaaaccatttggtctgattgatttgttgttttgcgtatgcatgatacgcaaaaagggctcctaccatgtttgtggcaggagtccttttcgttgtgtttgctatgaagcttaggcttcggcgagcgcctcaacaggaggcgtgctcactgccctgcgtgcggggaatacgctggcgagcagtgctgccacggctgccacggcgagtacgatgccattaatgccccattcgaacgggaacaccactttgccgtacatactgaacaccacgtatgcgcccagccagccgaacagtgtgccaagtagtacgcccgagatgccggataccagcgagatgagcagggcttccaccgcgagggagcgtcgcagctggcctcgggtcatgccgatggcgcgcaatgtggcggattctcgggtgcgttcgatcactgacagcgacagcgtgttggccacgccgacaagtgcgatgagcacggccacggcgatcaatcccaccagaagcatcatcatggagtcgatcatgttcgcccatacgatgcgttcggcgatcggtccggtcactgtcgcatcagcgctcttctccaatgcggcctgcatgtcgttgtagatgccgtcaacggaaactcctgacttgtcagtatctgccttgaccagcaacacatgggtggcggcatcgaggtcaccattggtgaaatggctttcatccacgaatccgacagctccatactgtgcggatacgcgacggtagtcagcttggtttgcttgcaatgtcagcgaacgcgtagtgacgccgtcctgattccattcggtggagaaatcagccgtgccattggcgaactgcagttccttgccggtttgcgcattgtatgttggcatgagcacgctatcactgtcgatggaggcgttacccaagttggcacgcatgacctgcttgacctgatcgatgttcttcacaccgaccagcaatgcggacgtaggctgggttccatccgctttctccaaggtcacggaaaccgccggcgcatacaatgtgtcggacacgccgttgatgtcggctacatccttgaccatttgctggctgatgtcatcgcccatggccacgatgtcgacgctataacgggtggcgagcgcaccattcatagtctctttggcgctagcggcaccggttgcgatggtggagaccaaggtgacaccgatgagcagagcggcaccggttgctgcgatgcgtcgcggattcttctgaatgttggcgtgtgcaactgttgcggaaggacctgtcagcgaggccaacgctccaacgcccttcatgagggtcggcatccagaataccgcagtgaccaccatgccgaggaacaccagtgcggcaccggcgatggctatgagcagaatcatcgtgaattgatcgccgctcgcatcctcgccgccgttggtggcctgcacctgccagatggagaatatggccatggcgataccgaccaccaccatcagaataccgattatggctcgcgtaaggctggaacgatggttgtcggtcagttcaatcgggcgcaatgcctccaatggcgttaccgcggtggcggaacgtgcggatcccatggatgcgagcaccgtcaccacaataccgaagagaataggtacgacggcggcttgccaggagaagttgaaccgcataccctcttgcatgatgtcgctgacgcacatgccccacatgagcaggcttcccagcaccacgccaagcacggatgcgacgaagccgagcaccaccgcttcgaacagcacggaaccatacagttggcctttctttgcgccgatggtgcgtagcaaggcgagtgtgcggcggcgttgcgccacgagcacttggaacgtgttggcgatcaccagagccgccacgaacatggcaagcacgccgaagcacataaggaatgtggtgacgatgttggtttggttgccgcttaaggatttgatgctttcgtcactgatttgctgtcgtgacatcagatcgaaatgctttggcagcaacgctttcacaccgttgatggtttttgcggatacgctgtttccatccaaggcaaggtcgagatacaccattgttgttccggtggcgttgaaatcgtccactccctgcattgcggcaagcagattgttggatcctacgatcgcaccaccatagtatgagtaggcgccgttcggatcggatgtgagtcctaccacgcgcacgttgtccgccttggctttgccatcgtcgcctaccgcatatcgggaggtcaggcttacagtgtctccaacgccgacgttcaactgtttcgccatgtcttccggcagcgcgacttcgttggaatccttcggctggtccccttccgtgatattcacggggagcatgttcttctgtgccgcggtggagatgatctcgccgctgacggtgctgtctcccttggaaacgctgacgccggtttccaccgaggcgcggatgccgtcgactccttcgatgccggcgatctggtcgagatgaaagtcgccgacagtgctggaatacgcctcgttgagttccttatcgctcaggtcggagctgttgatgctcaccgcatagttggcgtttccgaacatggcggtcagctgccgtgtcagggagtcgttcatggcattgccgaacaggaaggtgctggcgatgaacgccgtgccgatcatgatggcgatgcctgcgggtatgagcatgcgcttggtttttcgcatgagtttcaaagtgatggaccacatggtggattctgttcccttcttcgaatgcttctacagtgcgtttagcgggaatgtctcgcggaagccacattcattgtggcggcctcacgttccttcatcagcagttcactcatctggtctgctgtcggcttgtttacgtccgccacgatctggccgtcggcgaacacgagcgcacggtcggcgtaagacgcggcgaccgcatcatgcgtgaccatgatgatggtttggccaagttcgttgacggaacgcttcaggaagccgagcacttcggcgctggagacggagtcgaggttgccggtcggctcgtcggcgaacaccagcttcggcttggtaatcagcgcgcgggcgatggccacgcgctgctgctggccaccggacagctcgttcggacgatggttgagccgttgcttgagtcccaaggtttctacgagcagatcgaaccaggcacggtcgggcttatcaccggccaaagtcagcggcatgaggatgttctgctctgcggtgaacatgggcaacaggttgaagctttggaagatgaagccgatcttgtggcgacgtagcaaggtgagctgcttgtcgtccatgcgggtcaggtcggcgccgccgaacaagatatggccggaagtggcggagtcgagaccggcgagcgtgtgcatcagcgtggatttgccggaaccggatgggcccatgatggcggtgaatttgccgcgttcgaaactcacgttcacgccgcgcagggcgtgaaccatattgctgccggtgccgtagttcttgaccaagtcgacggcctgaataacgatgccgcgcgatgcggacgggttctgcacgttcataatgcctctccatattgggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcgccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtaatcgatgaccttcagcgcgttctggacgtggcgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctgaatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcccgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtaggaggtggtctggtagatcggcaccgcgcgggagtcggtggccgggtcggcctgctcctggccgacgtgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcgcggcgcaagctgaacgttatcggacttgcctataagggcttataaagccttggaatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcatttttctgccgcccggttacatggtttacatgacgaacgactacagtcaaacatcgccaatgaattattccgccaacatggtgaagggattcgaacagacatgaccgatgtaactctgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacacgctatgcagtgttcacgttccatgacaccacggatattctctccggttacttggatgcctggcagaaggaagacgtggagctggatggcgtgtattcaggcttcctcggctcccccgatcaggtggcgatcattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtgttgatgccgaacctcaccgaagcgagcattctcaccaagcgtgactatcctggccaggatattgatgaggccacggttaacgagctgcttggtgctctgctggagttgggtgccaagaacgtggtgctgaagggcattgaccatggcgatggcaaaatcgtcaactatgtggccagcgcttccaccggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgtcacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgttttttcgtcacagggaagtcgactggtgagccttggtaaaccttctgaactaatggtggataaccgagttttcatccacacgttatccacaacacgccaaaccgcgtcatagtatccacatttgccggttgcgcttgtgctcttacataagtaacccgcacagtggaatcatgaacgctttaccacctactcagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgggtgccgcattcggcggtccgtttcgatgtcgtcaccatcgtgcttcgggtgggcaggccgctcgtgcatcacattgaaaatgccttctgaagcccccccaaaaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcagcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtggatggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcactgcaagtggcggcggcaggcgggcataatctcatcatgaccggcccgccaggcagcggcaaaaccatgttggcctcacgtatgcccggcatcatgtgcccgttgaacgaggcggaacagctggaggtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacacgcgcgcatcgaggcattctgtttctggacgaggcaccggaattcagcgcacgcgccctgcagacgttgcgcgaaccattggaatccgggtatgtggcgctttcccgttcaaaaggcagcacctactacccggcctcattccaactcatcatggcggccaacccctgtccgtgcggatactattacggcaccggcgaacgttgcgcttgccgggaaaaagaccgtatacgttatttctcgcgattgtccggaccgatactggatcgtgtggatattcagatggcggtgccaccagtctcgcgcattgccgcgcaaagcgagccaatcggcgagtccagtgccgggatacaagctcgtgtgattcgtgcccgtcaagtggccaaagaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccactgaacaggacgtccatcagggcatcgaaatgagaacgaggatgacatgagtaacgctactgatatccggcaatctggcggcaccgcaggaagtgtggatcacaccgatacgagtctcgccgtttcgcgcactattcccgtacctcccacggatacgttgtatcgtgccgcgctcacgttctgtcttgatggcgcggatgtgatgatgtacgccacgctcaaaggcgcggaaaacgccgaatccctctggcatgcgttggcgcaatcccatccaagccagccatctgaaatctgcggcccggcgctgtcacgtattgaccgcatgttcgtggacggcctcactcgatggggccgcaaggcgtcggcgaacgcgatgcgctccttccgcaatgcactggcctgctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcaaaaccgttgccgtattcgccggcgggctcaaccatatcggaccgatgcgtaaccgcacgctgttcgaacgcatcgaggcgcagggtggtgcactgatcagtgaactgtgccccgggacgattcccgaagcccgtcgttttctgcttcgcaaccgcattatcgcggccatgtcttccacattgattgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggcgtcacaggagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcattatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttgacacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgcctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgaccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgctgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcactggataacaagggcctgctgactgcggtcgattccaccgcccagggcatcgcgctgattcgcaaggcgttcgccgagctgcaggacgagaccgacaccacgttgcgtgcggtgaacgccccggccagcgtgtttctgccgcgcctcaacgccaatgattacgatctgatcgtggtggcgggcgacgccgagaactatgccgccacgttcgcccaggcctcccgtctgctgcgcgtgcacggcgtgatcgtgttcaccgatgtgctggcgttggaggacggtcagggcggcgtgattaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctccccccggagaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctggaccaaggtcaataattcgaacatctcatccagtgtgccgaagcctcccgggcatacgatcacgccggaggaatacttgatgaacatggtttttcgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttgtagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcgggtttcagcaggttggcggtggtgttgtccgagggaatcatctggccgcgtagaatcaccgggccgcgatgataggtatcgcccagcggcgaggcgtcctccagatcgaccgggttcaccggtgtggccgcagcctcagttgccgtctcagcctccaacaccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgtacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccgatctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttccgctccgggctgagtcgcgaagggcaaccttagcccaaccctgtgtggccgactcaaccgactcaaacgggccaatacaattggaaaagcctcggaagcatttcgctttcgaggcttactgtgcgccagacaggattcgaacctgcgacctgctgatccgtagtcagctgctctaatccgctgggctactggcgcataccactgttgtccccgtggttcgggagtgcgccagacaggattcgaacctgcgacctgctgatccgtagtcagctgctctaatccgctgggctactggcgcatgttgtctttcagacaactcgatatataatacacgccgttcagctgaatgcaactcggcgtgttgcggcgagtcgcaccatcccgaccactaccgcaacggcgtatttactggcctcacgcctcgtgtgtacggactcggtcaagcaaaaccgactgcgcaactttgagacgtccctgcggcacatccacggcttcgcgcaggagtttgggcgtgctggaaccctctacggacgccttgtccacaatcacctgcctcacatcatccaaactcggcaactggaacatcgtgtcctgcaacgtacgttcgataatcgaacgcaaaccgcgtgcgccggtcccctgcttgatagcgatatcagcaatcgcccgaatggcctgttctgtgaattgcagatcgacgccgtcgacggcgaacagtttacggtactgcttgatcagcgcgttggctggctgggtgagaatcgccgtcagatcgtctacggtaagttccttcagcacactggtgaccggcaaacgtccgatgaactcaggcaacagtccgaactcggccagatcatcggcattgacctgttcgagcaattcctcgtctttcatgtcggcgtcgtgccaattcgcgccgaagccggtctctcgacggcctaatcgcttgcgaacaatgtccgtcagccccacgaacgcaccgccgcagatgaataggatgccgcgtgtgtccatctgcgcaacgtcctgctccttatgcttgcgcgtgccttccaacggcacggaggcgatggttccttccaagatcttcagcaacgcctgctgaacgccctcaccggacacgtcacgggtgatggaggtgttctcaccggatttgcgggcgatcttatcgatttcgtcaatgtagatgatgccgtgctgggctcggcttacgtcgccatccgcagcttggaggagacgttggagcacggtttccacatcgtcgcctacatagccggcttcggtcagggtggtggcgtcggtgatgacgaacggcacgttcattacgcgggccaacgcctgcgcaagataggttttgcccacgccggtggggccgagcaacagaatgtttgacttggcgacctcgacgtcagccaaagggtcattgctgcggcgggcagcacgcgtctgggtgggaacggattgcttggcttgtttgccggtctggccactgtgcccgttattcccgtcaagctgctcagcggactcctgaagctccatgttgacgcgcttgtaatggttgtatacggctacggataatgcgcgcttggcgttctcctgaccgatgacgtagcggttgagataatcgaagatctgagcgggcttgggcaggctcagcgaattgacctcggcatctttgacacgctcctcggagatgatgtccacgcacagggcgatgcattcatcgcagatggaggcattgggaccggccaccagttttcgtacctgatgttcggttttgccgcagaacgtgcaacggggtacgtcctcgttgtagctcaccacacgtcccatgattctcctttgccgactgcgccgcaccgtcgaaccgccacgctgcgcattatcattgtcatccttgaaatacaatacccccggtcgttgccgaccgagggtattgcaatgtccggaagttttactggcggtgttccaacacctcgtccacgatgccgtattccttggcttcaggagcggtcaggaaagtgtccacttcgatgtcgcggcgaatcttctcgacgtcctggccggtgtgcttggcgagggtctcctccagccattcgcgcatacgcagcatttccttggcctgaatctcgatctccgtggccttgccgaagccttggtcgatggccggctggtggatgagcacacgggcgttcggcagcatcaggcgcttgcccttggtgccggaggccagcagaatggcggcggcggaggcggcctggccgaggcacacggtctgcacgtcgggcttgatgtactgcatggtgtcgtagatggcggtcatggccgtcatcgaaccgccgggtgagttgatgtacatcatcacgtcacggttcggatcttgggattcgaggaccagcagctgggccatcacgtcgtcggcggaggcgtcgtccacctgcacgccgaggaagatgatgcgatcctcgaacaggcgggagtaggcgtcctgggtcttcatgccatacggggtcttctccacgaactgcggcatgatgtaacggttggtcggcgcgggctgggctgcgcgggcggaggccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcgatagatttcctcgagggtgtggccggtctgctcagcggtcagctcgctcatggtcttcttcatgtccatgatgagctcggcgttgatgcgcacgtcagtggcggtgccgccgatgccgccggaaggctggtgcatgagcacacgggcgtgcgaggtcaggtaacgcttgcccttggtgccggagctcagcaggaactggcccatggaagcacacatgcccaggcccacggtcgccacgtcaggctcgatgagctgcatggtgtcgtagatggccatgccggcggtgatggagccgcccggcgagttgatgtacagccagatgtccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaaggcggcttttcgcgtgctttttggcgggcagcgtagggatttcggtttattcgagggtgtcgaggacgtcgtcaatgaggaggcgggtctgggaggcggcatcgtcgcccagacgcgggaagcgacgggcggcattggcggggctggcaccggcggctcgcgctacgttggacttgctggcaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcagcggcaagcaattcaagtgccgagcgaatttctgtattttctgacatagctttctttacctcggctcccctctctgaggggagctgtcgccataggcggctgaggggagtttcgaccggggcagctcccctcagagaggggagccagaatatatgtatttacttacgactcagcaaccactttgatatcaacgacgacgtggccacggccatgccgaccggcacaaagaaggtaatcggcgcttcagagagctccatcaccaagcacatggccataagcggtgcctgttgtgaggccgaaagcaacgaagccgcaccgatcaaggcacacgcggttaccgaatcggtcggaaacatcagtatccatacgagaccgagcatcgcacccagcgtggaacctaatgcgatgccgggctgcagcacaccgcccgacgcaccggagcgaatggtcatcagcgtcaccagcgctttggcaacaaaggtgagtgccaacacacccagcaacatccagatattggactgggacagcgggaaaccggcgttcatcacggatccagaagggccgctcccaccctgaagcatggcccagaacgatgccattccagagcccgctcccccgccagaggccgaatcggatacattaccgccgcccgtcagcaagttccatggagaggcggccgctgaagatgccgactgcatggcaccagcagtgccggcggtttcaggaatgaatgtgctgaatccaagttgcgctgcggcacggccgttgcccatcacctgcggcacaacaatcgccaccaaaccggtgatgagaccagccagcgtcatctgccacagaatagccttaccggttggcttgtgcgcttccgcccattgcgaaccttttcggaacaatgcgccgcccactccacatgccgcaccgcagatcagagcgaacagcattaacgttggcgtggattccggttgcatggcggtaatgtcgtagaacaggcaatgccctttgatcgcaaccgccacgaatgcggcaatggcagacatgcccagtccaaacgcaactttttcgattgtcacatctaccaacaggatttcgacggcgaagaacatgccggccagtggcgcgtcatagacgcctcctagaccggcaccggcagccactgccaccaccatgcgccggtcgatgccgtcaacgccctcgatatggaacaggtcgcagaaacgttgcgcgagcatggcgccgagttcgcgtggggcgacttctcggccgatcgaggcaccggagccgacgatgaaaatctgcaataccacatgcgcaatggtttgccagaaaggcattcgctttcccgccacggccttcttgactgagggcaccgcagtcgttttgtgtcgcagcagataccagataatgcctgcgatgctgagtcccacggtcaccgatatcgcacggcgtgcagcgggcacgccgaatggaccaggcaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactcccctcagtctcgccacgctcgacagctcccctcaaagaggggagccaaagaaacagtccttttgccagaataggaagagcccggaaccatgaaacacgattccgggctcaaacaatcacgctaacgcgatgaggctatgctcactcagcatccttggcgtcatccttggcggacagttcgtcggccacggcggcagcagcggaagcggcctcgacggactcggactcttcgtcctcagcggcctcgcccaggaaggcggagaggtccacaacctcgccatcagcggtgaacttgacggcgcgcatgccggcgagcaggcccttggaacggccgacttcctgcacagcggagccaagctggccattcttgatgatggcctggatgaagttgttcggatccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccgggtccggggtcatgcccttgagctgctcttcgaccatgttggccttgacgcccttcggcaccgggatctcgaggccttcctgcagcttggcgatgaaggcatcgcgagcctcggtggcctgacgaccttcggcgtcctgagcggcagccttgcggatgtcagccttgagctcgtccagagtgtcgaactcggaagcttcggaagcgaactcatcgttcagctccggcagttcctcagccttgacggagttgaccttgaccttcacggtggccttctggccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggcctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacttgccagttccttgcgccctgctcgatcaggaacgtctcgacgtccacttccaccgggtcttccacccagcacaggttgcgtaggatctgtggcttgatgatcatctcggccggcgtgcgggtgtcttcggcgatgcggttgatcacacgccgcacccgttgcagacggtcataacgctccggatggcgctgttgccacagccgcatggatcggggcgcgttcaccacaccgttttcgtcctgttcgggggcgggcatggtaggccattgggcgggcttcagggccatggctcgatcgatggcctgcttccagaccttcggtttgaccgcacgctgaatcggcgcgtaccgctcgaacattttgtcctgctcggtgccggtatggatgcgcacacgctcgttcagggatcggagcgcgcggaattgggcagcattgtgcggcttgttggtcgccgcctcgatgattgaggaatcggccaataacaggctgggcgcaatatcgtattgccgggcgagtcggtcgcgctcctcccatagggatttggcgatggccaagccccttggatcacgactcagctgggtgatgcgcgagatacgcagccaaggaatcggatgcggtttgcgcggggcaaggcccgcaaccaaagcgtgagaaaactcttcagcggcccactcgtccttgcctgcggctttcaggtcacgacgcatcatggtttcaagttcgataagcacctccacgtcgagcgccgcatagttgcgccagtcgcgcggcagcggacggtaggaccaatcggcggcggaatgctctttggctagcgtgatgccgaggtagtgttcggtgacggcggccagaccaaagcggtgcaggccgagcaatcgcgccgctatttccgtgtcgaacagggctttgggtttgagcccgatttcggcgaatccgggcaagtccatcagagaatcatgcagaatccacgtggcgtcgcccacggcgtcattgaattcattccaatcagctccggcccgggtcagggcgacgggatcaagcaaggcgatgcctgcaccctcacgtttgaactgaatcagccaatcctcgtgtccatagcggaagccggacgcccgttcggcgtcggcggccagcgagcccgtcgcctcggccagcgcatcgcagacacgatgatagccgtccagcgtcgaagtgacatcgggtactcccccgcgaggctctttcagcagtcggggttcggtgtcacggacgtcactcaactggcgtcatcctcctcaaaacggatggtggatctgatgaatgcggcccacgagcggacttgtgcgccggcgtccatagtaccgtccggcccggtcccgtcaagcggggtccatgagacgcgaatctcacacccggcgctggtggagccggccatcgagccaaaagccgtgttttgggtcacggtgactgtgccggataccgaatccggctcgatgccgtcgaaatagtcgcacatgtcatcccagtacatgccgggggtcagagaatcgttttcggcggtttccagcggcagtcgcgcgaacgccacgcaacgccagttggaatcccagtcaatgcgcagctcatgagcataaagcatcatgatccagcctgtggcgattcgtgattcggcatcgctgccaagaccggcggaaaaggcatcgccgagggcacgctctcccgcttcgaattccacgccgataccataatcggccaaggtggaaggcacgggaatctcccgatagcgcacgtcatggatgcgcttcatggtgctgacggattcgacggctgcccatacttcatccggcacaccctgagggcgcacggggcgtccgtcgttggactctcccgtaggaaatgcgtagatgtcggccatatctctagggtatgggcgaacgggccgaatcgtggtatttacgcgcggttcggccctgcaatttaatacacggtgaagccgtggtccttgaactggttggccacccgttcgcgggtggcggcgttgggtcccttctggttctccagcgggtatgggatgcgcagttcgtgccacttcgggcggccaagctggtggaatcccagcacgtcgatgtgttcgacggcatcgccgaaggactcgcagatcttcgccacgttttcgacgttctcttcggagtcggtcaggcccggcacgagcacaaatcgcacccagatcttcttgccggccttggccagtcgctggccaaaatcgatggtgggctgcaaggtgccgccggtgaccttgtgataggtctcctcgtcgccggatttgacgtcgagcagacacaggtcgatgtcctcgagcatctcgtcggtgtagctcgtgttgaggaagccggacgtgtcgaggcaggtgtgcacgcccatctccttggcggcatggaacacacgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcaacgggcagccggacatgaacacggtcatgcgggtgcccggtccatccacggaggtgttgatgtcccaagagtggacgaagccgatatcgccggatttcagggcggaaaggcggtcacgtcggtcgagtccgattggggattcaaagccggaaaggccacccatcaaagtctgcgaggcataggtcttcgattccttgagcatatgcctggtcgtggtgcggaacgtgggtgttgcgggcatcgttgtcctcctgttccaaatgatgcgaaagtctgtgggaaataaggaaggggtggagccgtgccccaccccttcagttagtcattgccgcggttcgcggggttggtcatcagtcgacgacggcaccctggtggaaggtacgggagatgacgtcgagctgctgctccttggtgagcttgacgaagttcaccgcgtagccggagacacgcacggtcaggtgcgggtacttttcggggtgctcgacggcgtcctccatggtctccttgcgcagaacgttgatgttcgcgtggtagaggccgtggccgttgccggcgtccaggatgccgaccaggttgccgatgcgctcgtcctcgtcgcggcccaggccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttggcgtggccggacgggaaggaaccggtgttcttgccgtactcgacgttggaggtgatcgtcaggatggactgggtcgggacggcgccgcggtagaccgggagcctcttgacctggcccatgaccgtggagacgacccacttggcgatgtcgtcggcgcggtcgtcgtcgttgccgtagaccgggaactcgccctcggtgcggtagccgacgatcaggtcgtcgtcggcgccctcaacgtactcgtactcgtggccttccagggtcttcgcgtccttgttgtagatcgggtagaccttggcgtacttgacggcggcgagggagtcggcggcgatggacagaccggacatgccgcagccgagggtgcggtacacttccttgtcgtgcagggccatctcgatggactcgtacgcgtacttatcgtgcatgtagtggatgatgttcagggccatgacgtaggtctcggacagccattcgagggccttctcgtagttgttcttgaccttctcgtaatcgagggtgccgtcggcctccggggtaatcggctcgatcacgcccttgtcgatgacctgcatgccggtcatctcgtcgcggccgccgttgatggcgtacagcagggccttggcggagttcacgcgggcggcgaagaactgcatctgcttgcccacgcgcatcggggagacgcagcatgcgatggcagcgtcgtcgccccagtggctacgaatttccttgtcggactcgtactggatggccgaggtgtcgatggagatcttggcgcagaagcgcttgtaggcctcaggcagcttcggatcccagaagatggtgatgttcggctcggggccaggtccgaggtgctcgagggtcagggtgttgagcagacggaacgaggtcttggtgaccatcgaacggccgtcatcgccgaagccggcgtcggaccaggtcgcccagtacgggtcgccggagaagatcgaatcgtagtccttggtacgcaggaagcgcacgatgcgcagcttcatgacgatgttgtcgatgagctcctgggcgtcggtctcggtgatcttgccggcctggaggtcgcgctcgatgtagcagtcgaggaaggcggagttgcggccgaaggacatggcggcgccgtcctgggacttgatggaggccaggtagcccatgtaggtccactgcacggcttcctgcgcggtctgggccgggcgggacaggtcgaggccgtactcgttgccgaggttgatgagcttcttcagagccttgatctgctcgtcgtgctcctcacggaagcggatccagtgctcgatctccggctcggtgaagtcgttgcggtacggcacggagtccttgtcgcgcttcttgaaggcgatgagcttgttcacgccgtacagggcgacgcggcggtagtcgccgatgatgcggccacggccgtaggcgtccggcagaccggtgaggatcttgttgtgtcgggcgaccttgatctgcttggtgtacacgccgaagacgccgtcgttgtgggtcttgcggtacttggtgaagatcttcttgatctccggatccggttccttgccggcttccttgatggcctgctcgaccatgcgccagccaccgttcggcatcatcgcgcgcttgcagggaacgtcggtctggaggccaacgaccacgttatcgacttccggggagtcgatgtagccggccgggaaggcgtcgacgtcggccggggtatgggtgtccacgtcgtagacgcgctgcttgcgctccacggccaggtagttgtcgtcgaggtacttccacaggtgcttggtcttctcggtggcaggagccaggaatgtctcgtcgccctcgtacggggtgtagttcttctggatgaagtcgcggacgtcaatatccttctgccagttgccctcggtgaagccggcccacgccttggcgtcgagctcctcctgggagacagctgcattttccactgcggtcatgtcactccttaaatggggttgtaggtttcgcatcttcacggaacccttggttcaacagtgtagttggcacttgcttgagaaaagctgaaattgggagtgagctatctcacattgtttctgtgaacgctaccattccaatggcttctagatattgatgggactattgcacgtctccagatatgggaaaccgctcatactgtgatgttcgtatgagcggttcggtcttgagattgacagcagaaccgtatccgtcagttttcgaccgtcaatcctcggggcgagcttgtgcgggtttcacgccgtagttcttccagcgccggttctcctcctcccatctggcattgcggtccaccacgatgtcccacgcatgttcggcgtcttccttggtcttgtacggacccatgcgctgttcgatcggtgagaccatgcccaactcggcctgcttcttgacggtgttgaaataccactgcttcttgttatcgtctgtcattggtacctcctcaacggtattacttgctcccgctggcgggagcaatatatgtttattccctgaatgcgttggtgacgggcagtcggcggtcgcggccgaacgcgagggccgtgaccttcggtcccagcgggtattggcggcgcttccattcggcgcggtccaccaatcgcatcacggtgtctacggtgacctggtcgaagccgtcggctaacaggtcggcgcggccgtgcgcgtgctcgatgtatgcggcgagcaccttgtcgagcagcgcgtattcgggcagggagtcggagtccttctgcccggggcgcaactcggccgagggtgccttctcgatggaggagaccggaatcatcacgccgtccttcaacgggatgccggtgttgccgtcctcgttgcccacgatcttgagaccgccgatgccgacgcctgcggccgcggccttgttacgccaacggctgatctcccagacacgggtcttgagcaggtccttgatgggtgcgtagccgcctaccgcatcgccgtagatggtcgagtagccgcaggcgagctctgacttgttgccggtggccacggcgagcagaccgcgcgaattggagctggccatcacgatcacaccgcggatgcgggcctgcaggttctcggcggagacgccatcaaggtcaagttgctgttggtaggcgttgaacaatggctcaatgggctggacctcgtaatgggcgccaatgttggagaccaaatcggcggcgtcgtctttggaaccgtcggaggagtacatggagggcatggagatgccccagacgttctcgccgccgcatgcgtcggccgccatggcggctaccagtgcggagtcgatgcctcctgagaggcccagcgtcacgccggtgaagtggttcttggccatgtagtccttgaggccgagcacgcaggcggtgtatacctcttcgtccgggtcgagttccggaacgatctcggccttggcctgatgttcggcggcggaatcgaagtcccagaacgtcaggttttccatgaacatcgggctgcgttcgataagcgtgccgtcggcgtcgaccacgaagctgccgccgtcgaagacgaggtcgtcttgaccgccgacctgattcaggtagatgaccggggcgttaacctcggcggcacgacgctgggcgagctcgaaacgggtgttggtcttgccttcctcatacggcgagccgttgatggtgagcagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcgtcgaacacgccgtagttgggcaggaagtgcttgtcgtagccagcccagaccacgccttggtgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgggaaaacaaccacttgggcgtttcctgcggcggctttacgggagtagtcgagcaccttggcggcgttggcgtcaagcgcgccgacgcaggtgtcgatctgggcgagtgcgaagcgaagctgtgtcatagattcttagtgtagccgcgtatgacgtcggattgcctgttcttccggcttggcgtcattcattaggtcgtttttgcgttcattaggtcactgcaatgcgatatcagtcgttgcaatggcgcgattccaacaaccagtatcgccgttcaccgacctaatggacgatgaatcgacctaatgaacgaatgccactcccctcagtcagcttcgctgatagctcgtcctgcacttatggacgggcgaggcccgcgcatatctggttcggctgtcgcctcaccttcggctacagacagcccactgggctgtctgcctaacgcctcagcctccggaggcgagccagaaaaggatttacttcagctcgttgagcacgcgcagagcggtgttgacgtagaagttgacgaaggtgggaatggattcgtcgagacccacgaaatgcgggctatgccagtcggcgcaaccttcctggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcgagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatggccgccgtgcacttcggtaacggacagcaccagcgggtggaagggcgtgacgttgcggctcacgatggtctgcaggctcagaataatactggcgagcgcttcgatgggcccggtgcccttgtacgggtaaccggcgtgggtgccttgggcgtggagggtcacgcggaatttcacgcagccggccatcatcggctcaacgccgatggccagctggccgggcgcatagttggggttgttgtgcgtgccgataatggcttcgacgtcatccacgagtccggcgtcgatcatggcgcgagcgccttggccggtctcctcactcggctggaacagaatcttgatcgagccggcgaacttgtcacggtgctcggcgagccagaaggcggcaccgagcagaccggtcatgtgcaggtcgtggccgcagccgtgcatcacgccttcattgacggagctgaactccagtccggagtcttccacgatgggcaggccgtcgatgtcagcgcgcagcccgatacgcggcccgggaccggcctcgccctgaatgagccccacaacaccagtctccagcgggttgtgcaggatctcgatgccgtgcgccttgagctggtcggtcagatagatgctggtgccgaattcacggaaactacgctccggatgggcgtgcaggtagtggcggatagtgatgagttcgtggtcgatgtcgatatgttcactcatggttcccgattctagtagcgcgaagaatatattgcggccctcgctccatattggcgagggccgcgatctatggggtcagtatgccttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccaatgaacaggaaggcgtaggccaggatcagcggtgccagggcttcggggatgagcacggtgcggatgatggtgagcttgccggcacccatcgaacgcgcggcctcgattactcccgggtcgaccggcacgagattctgttcgaccagacgcgaggtggcgaaggtgcacatcaccaccatcgggaagatggcggccacggtgccgatggacgtgccgaccacgacgatggtgagcggctgcatggctgccaggaagatgatgaacggaatcgggcgcacgatgttgacgatgatgtcaaggatgcggtagacgaccgcgttctcgaacaggttgccggggcgggtgccatagagcaccacgccgaggatcaggccgaggaatccgccgatgacgagggtgacgagcaccatggtcagggtctggccaatggattcgaacagtagtggacgcagcacgttccagtcgctacgcgggttggcgaggatgatcatgcgttggctccttcatgtgcggcggcggacgcggcgggcgcggtggcagtatcggccgccagtgggtcatgggcgcggtcttcggcgtaggaggcatgtccggcgactgcgtcggcgtaggccacaggctttgcggcggtgccgaagtcgatgacgtcgctattggcggcgagctcgcgcaggaattcgtccacatgccagccgggcccgttgaattcgtaggtgatggcaccgatggcggtccccttgaccgtgtcgatgccgccgtagagcaggctggattcgacgccgtatttggcgatgagttcggagatattctgtccggatgccttgagttcatggccttgggtgccggaaacgtccttttggcggataagcacggtgacaatgcggcccgaccattcgtgatgcaatcgctcgacccggtcttcctcgggcaggccagacaatgcggtggcaatgaatcgcttggtcaccggctgctggggtgcagcgaacacatcgtatacgtcgccggattcgaccacgcgtccggcgctcattacggccacgcggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctggcggatgggccgcagcttggtctcactcagagaggtgatatcagtaccaagcacggtcacagtgccggaggtgggtcgttcgagcgcgttgataagccggaccagtgtggatttgcctgcaccggaatagccgatgatgccgaagatgtcaccgcgatcgatggtcaggctgacgtcatccacggctcgtgcgatgttcgcgccgcgtccgcgtgttttgaattccttcacgacatggtcgaaggtgatgatggggtcgctcatagtgctccctgatgctggttgttggtgtccggtcacggaagcggagcgaatcccgattgttggctcgggtactcgctccgcttggtggtaatggctatggacaggctagtcgtgcgctcgtatcagccgcggctcactgctgggccttggcatccttctcaatgtcggacaggaagccttgcagctcgctggcgctgaacttgtcggcgaacaccgcggtaccgccggagttctcctgcagggcgtcgagcacatccttctgctggtagatggaaacgagcttcttgtaggtctcgttgttcacgtccgccttgcgggccacccacacgttgatgtaggggcgagcctcttcggattcggcgtcatcctggtagatggcgtccttcgggtcgagaccggcatcggccacgtagtcgttgttgatcacaccagcggcgatggtcgggtccttcagggtggtggccacctgttcggccttgagcggggtgaccttgaccttgctcttggcttcgtcgatgtaggccggggtggagaaggcggtccagtcgcccttgagcgtcacgagaccggcggccttgagcacgccgatagcgcgggcctggttggtttcgtcgttcggaatggtgacggtgtcgccctgcttcaggtccttgatgtccttgaccttggtggagtacacgccgagcgggtagatggcggtgccgccgatgggctgcaggtccttcttgttgctcacgttgtagttggccaagtagagcaggtgctggaattcgttgaggtccagctcgccggagtcaagggccgggttttcggaggtgtagtcctggaagtcgacgatgtcgacgtagatgccggccttctcggcgtcctgcttgaacttgacccattcggggttggtagcgccgaccacgccgatcttgaccgggttgcccttgctgcccttggcggacgactcgttggcaccggcaaacgcgcggtagccgaagaacgcggctacggcgataatcgccacgaccacgatggtgatgatgacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgacggaaaatggccgattgccatataggtgtcttttatggcgcgcatgcaatgtccgggattcgtgcgtttgataacccgctataggcgtgccgaacacgccggaaagcacgtcgagaggggctttgacaatggaagctatgactaccgatactgccaatgccgatatccgagccgtattcttcgatatcgatggcacgctcaccagtttcacgacccatacggtgccggattccacaatcgaggcgattcaccggctgcaggccgcaggcgtcaaggtgctgatttgcacgggccgcgcgccttcacagatgcacgtggtgctggataccatgccggtgacgttcgatggcgtggtggcgttcaatgggcagtattgttttgatgacaccggcttctttgcctcgcaggccttggatactgctgatattgaggtgattctcgactggctggaccgtcaccccgatgtggtgtgcaatttcggcgagaaggattacgtgtacttcaaccagtccaatgatctgcttcgcgccacgtggagcaaactgggcaaaaccgcaccgacccggtatttcgaggacccgcgcacccgcgcgctggatcatgagactttccagatcagtccctttgtcgggcccgagctggaggccgaactggtgggactgtgcagcaatgtgcgcggggtgcgttggcatccggatttcacggatctgattccggccgatggcggcaagccgcgcggcatccagcggttcatggcgcattacggcatcacgcgcgagcagaccatggccttcggcgatggcggcaatgacacggatatgctcgcctacgccggcatcggggtcgcgatgggcaatgcgaccgccgagcccaaggccgccgccgactacatcactgacgatgtggaccacgacggtgtgcgcaatgccctgctgcatttcagggtgctacgcgattaaaacatcacaacagttcgctttgttctgccccgccgtgacagggcttatgaataagcaaagggctcgggacgaatcccgagccctttggtgttagcgaactaacaacaccgtggaggtgttatcactcgttgtcgccagcggtagcggcggtagcggtgacggcacccttcttgtcggtgttcacgccggagtacacccagtcggtgtagtccgggtggtcgtagccgttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacggtcgtagatcaggccacgcacgtcgtgagcgtaggagtgatacgcgaacagcaccggcttgtcggcggtgaagatgtcggcgaactcctcgtcggtcagagcctcgtcgttctccttggcggactgcagggagagcaggtcggcaacgttcacaaccttgaacttgacgcccagttccttcagcttgtcggaagcagccatgatctcctgagtcgggacatcgccggcggcggcaagcacgacctcggcctcatcgttgttcttggcggtggaagcccaatcccaagcggcggcacccttctcgagctcggcacgagcctcgtccagggtcagccaggtggcagcaggctgcttaccagcgatgatggcgttgatcttgttggtggacttgtagcacttctcggcgatggccagcagcatgttcgcatcggtggcgaagtagatgccgatgacgtggtcgttgtggaagcacttgttcagcaggacggaggtgacacccggatcctggtgggagaagccgttgtggtcctgacgccaaacatgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacgaccggtcagcaggtaggcctcgaggaagccttccatctggtgctcggacagctgctcaacgacctggccggagacgtgcatgtgctcgtcgacctcgtcggagatgtagccggcatcccactgcttgttggtgacttcgtaggaagcctgcagacggttggaagcggtctcatccggtccgaagatgcggaagtcgcgcgggttgttcttgatgatgtcgcgagtgtaggcacccagggtacgggtggcctcgagctggccccagccgtggccgtactcagccacttccttgacctcgtagtcctcgaggttcggcagcttcaggtcgttgcggatcacaccaccgttggcgttcgggttggcaccgatacgcagctcgcccttcggcatgaaggcaaggacgtcgtccttgacagcaccgttggcgtcgaacagctcttccggcttgtaggactcgagccagttcttgagaacctcgaagtgggcctcggtgtcgcgggcggaagccagcggcacctggtgggaacgccaggagccctcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcgacggtggatggacatgtggtcctcatcatcgaagccagcgacgaactcgtagggctcgtaacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccagccggtagccagcgggccggtctcagcctcgccgtcgccgacgatggccgggacaaacaggctcgggttgtccatgatggcgccgtaagcgtgggacagagcgtaacccagctcaccaccctcgtggatggagcccggggtctccggagcgaagtgggacggaatgccgcccgggtaagagaactgacggaagaacttctgcagaccagcttcgtccttggtgatcttcgggaaggtctcggtgtaggtgccgtccaggtaggactgggaggtaccggccgggccaccgtggcccgggcccatgatgatcacggtgttctggccgtggtcagcaatgaaacggttgatgtggccgatgaggaagttcaggccaggggtagtgccccagtggcccaccagacggtgcttcacatcttcgcgggtgaagggctccttcatcagcgggttggaacgcagataaatctggccgatggaaaggtagttggcaacgcgccagtacttgtcaacgccttcgagggcttcctcggaaaccggagcgttgagcttcttccaaggggtgccaataacaggactcgtcatgtgtactcctgtactcctgcacgtgatcgtgcgattgattatttctgttcggtcacggtccctgacccttgcggtgccaaggttttccgttcccaatcaatcgtcatggtacgaggacaacgcgacttttgaacgatttcttgcgggtgtgttcgaaattgttgcggatatttcagtatttgtgcggttcgactgaccgtttgtcaacattagtttttttcaacatactttttcaaaacggcggaagcatgcggaaatccagcatttggctagaacagcgcacgttcgatttcccatgttcgaaatcggcgtgttgtccgtctacaggcatgtagtttgttcgatttgcgcacatagtctctgcgtgtcggccttgtcgccttgaccagtgataatcaggggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtacacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctaccccgacgtcgtcgaatccggcggcggcgacggcgcggccaacatcaagagccaccacaacgtcggcggcctgcccgaggacatcaagttccagctcatcgaaccgctgcgcactctgttcaaggatgaggtgcgcgccatcggcaccgagctcggtctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcgccgatcgtcctgcgcccggtcagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaagccgatagggctttgacctgctcttttgagtgccgtggtgtaccgctgagtttcgtttcgtacgagagtcatggcaaaaccgccagcgacggcagtgagtaaaaacgatttcctagcctccgttccctcgttggaacggaggctttttctttgccgttttactccctttcacctgcgatttcgccatttactccccgtgtttcaagacgacaaggcacggggaggtattcgagggaatgggagtaaggatttatcccaagtgagttgacgcgcggtttttgtccccgagggcgaaacggggccgtttcggggcccgtgaaactcaaatcgaactcaacgggcattttttgctgggcgttccaatgttcccgttccgtgggataccctgattctctctgtggtactgtttgtggtgtttcctctggctggcggtatgctgacccgttcggctgtcatcaagcggaaggggcagtgtactttgaggagactttcatccatatgtttgacagtgtaactaccattggcttattgctgacgctggtgatgattttctcgttccaaggcaataccattctggaaaaacctctgcacattgttttgattgcggtaccgctgattttacagaccttcctgatttttgcgattgcgtatatcgcttgccgggttttgaagctgccctacaagattgctgctcccgccggaatgatttgtgcttccaacttctttgaactggctgttgctgttgcaatcgccttgtttggaacgacttcccctgcggcactggcaacgactgtgggcgtgctgacagaagttcccgtgatgctgttccttgtaaaaaaacgcaaataaaacgaaagactggttcaaatatgagtaagaaaaaggtggcatttatctgcgtccataattcctgccgcagtcagattgccgaggccttgggaaagcacttggcttccgatgtgtttgaaagctattccgcaggaacggaaacaaaaccgcaaatcaatcaggatgctgtccgcattatgaaagaactgtacgggattgacatggagaaaacccagtattccaaactgatctcggatattcctgcccctgatattgcaatctccatggggtgcaatgtgggctgtcctttcattggtagagcatttgacgataactggggattagaagatccgaccggaagcgaagatcaagtctttgtcgagatcattcgagagattgaaaaacggattctacagttgaagcagtcccttatttgattgaaatagcactctgcttgtggtataatacagatgatccagaccattgcttttctgctgataacattgggcttgataattttttgataacaggagtccgacaacgccgtataagttggataattggtatcaaattgagcaactaagagtcaaatcccctaaacagtattgtttagaaccagttttactttggcgagtgggagtaaactggagcggattttgcgcaatcgaaattccgtccgtagagtgtcgcagtgtgccgccacgtacgaaaaagcgtaaagccacctgtgatttggggtgagtaaaaactattgagaccctctggaaacaacgttttcagggggtctctttatgccttttgacctgcagtttcagtcatttttactctaaaagcgcgtacaccacggacatggcgacacgcagcggacgaagagtaaaggattttttcgaagagtgaactgtcccagtagtttgtcccaccaccccaaaaacgcccctgaaactcaagtgaaactcaataggagcgcaagggcgtcatcgtgcgagcaccgcagcctgagccgccgataccaggctcgtttgcgacgccgtcgctgcttgcctggatcgtcaacggcaagtacgtcatgtcgctgccgctctaccgcatagagacagacctcaaggcgtgcggcgcgacgatatcgcgccaggacatggcgaactggatgatgaacgtgcacgcgcgctggctggcgaaggtccatgagagaatgaaggtcgagctgctgtcgcatgtcaggattcatgccgatgagaccacggttcaggtcctgaaagagccgaaccgcgaggcgaagaagaaatcgaggatgtggctgttctgctcggcgcgctgcgacgtgcccgtgtatgtattcgaataccacgagacccgcaggaagggcgttgcccaggagtttcttgcgggctggtccggcacgcttaccaccgacggctacaaaccctacttcaatctcggcaaccccaacatcgccaacacggcgtgcctcgtccacgtgcgccgctacttcgcccaaatcgtgaagatcgccggcggcggcgccaaggcggcgtctgcggccagcgttgcgctcgaggcaaggcgcaggatcgacgccatgtttcaaggtcgactccaagttcgacgacatggagccgggtgccaggaaggccgcccgcgacgcggagctccgcccgctcatggaggacttcggggggatgggtgtttgtgttcaattagttgttgcgggtttagtcacgatgatttttcgggtttagctaaacccgaaaaaaatacatgactaaacacgaaacaccgacttgacgaaatacaggatgggcgcgggccagcttcccctagcctcgccgaagctggcgctgcaccgtgcgctgcagtacgccgtggagttctggccctacgtcatgaacgtgctcgaagacgggcacctggagctctcgaacaacgtcgccgagcaggcccagcgaatcttcgtcgtagggcgcaagaactggctcttcagcgatgcgccacgcggcgcgcgggcgtctgcggcgatatacagcgtcaccaccacggccaaggccaacgggctcaatcccaggctttacgtcgagtggctgctgaccgagatgcccaacgccggcgagctcaccgatgaggttgtggactcgttcctgccatggtcggatagggtgcctgagtcctgcaagctcgacccagccgctgccgagaaggccaaagagatgcctgacgacttcataattaacatcgaccccgatgcgttcgacgacgagatggcgaacaacgccgaggagggcctgtagcgacatagcggcctaaggcataccgcaacgcaaagatggaaacgtccaggacttttccatccgtatgccggaatggccctggacgtttcctgctacgcggtcattttgacgcttacgctctaatgcctccaccgcttgtcgcgggcggggtagacgatccaggcggatgcgtagcttgcgataaggcagacaatgacgcagacgatgcttgtctggaacccgaatgagtcattgataacgccccagattacgcttgcgaagccaatgccgatgtcattggcgagcaggaacagggcgtttgcggcgccccagcgctctggcggggtgttctttaccgctacgctttgattaagtggcaggcttatgccagtggcgagaccatagaagattccggacgccaggaagacaggttccccgtacggtgcggcaagtagcataaggcagcagaggatgccgcacgcgacggctccggtcattgttttgattgcaggtacggtgtccatgaaatgctttgaaatcatgcgaatgataatcatgcttaccgcgctgatggtgtagaagagaccggcgtgggtatagccgagagtagtaccgtacagaccggcaaagaagacgccaaagccaaaagtggggcacatgatcatctgtgggatggcgccaggcaatgcgcgcggctcgaagatgttgaatgagtcacgcagggttctcttggacacctggtcgccttcaggacacttttcactgttaattgtttcggatgtagttactgtggtggagctgggtgcctgcccgtcttttgagtcgagttcgagccgggtttccattttgattcggtatgcgctggagcttggcagagtttgccatttactttcatagcgtgcgttgagggcgattacaagccctgcaaacccaaccagggcaaggccgacatagaggttcgttgagggatcggttcctactaggtaaagtgcgaaggctgggccgatgctcatggcgatagcctgtccgaggccgtggtatccaatgccttcgccgagccgttcttgcggtaagacgcttgctgcggcggtcgaggctgctgttgttgctgcgccaaagcccacgccttgcagcaaacggctgattgtgaagaggggatgccctgaacgacagcggacagtgctgttcctgctatgaggatagcgatgccggcgatgataacgagtgagcacttgccgttgtcgataacagggccgacgaacagtcgtgctaacgcggcggcaatggagaagacgagtgcaagtacgccggcaaggctcgcaccgtaaccttggcctgccaggaagacgctggttccactgttgagtccttggcccatgacgaagcaacagaaggtcagcgcgatgataagcacgaaaataagcgaccacagcttcggatggtcgtccttaccgatatttggcatgagaaccctcctatgattccaatacccgtattctacgtctgcaaaaagtgagatgtaagcgccaaaatgaccgcgtcttaacaacccgctgggcttgaggcagaatcatcgcatcgacttatcctagaaactgcctgacgaaggcgacaggatgcttgtcagcaaggcggcaaatcttaacgagagccaaatccaagagcttgcaaatcttcagcgaggcgttgcagcaatatatcagaacgaatggaccgaacctgtcctctgtcacatcgaaccgcatgaacgcggcctagagtactcgccaacacagagcaagcacagcgcgaaggacaaggtttcttctgaagagcttcgctatctcaactcttgtgtgcttaatccgttcaagctcgatgagccaagggaatacaacttctgcgactgtgtgcacaagatggacatacctgactccatgaaggcacgcttgattgagatggcagggactcctctgtcctcgaggaagccactgtttgaatggtgtgcttataggtatttcaatattggacgcatcctcgacgacgccagggatttatctgccgacagcctcaaagagaggctttgctcccatctgctttcaagctggaaattcgaagatgactcctcacccgaaagctggggaccaatccaatacctgttcattcagtcgatgtttaacgctcatctcaacgagctgagaaagaggggtaccggcatcgagacaacggaaaaggcctcagcactcgccgaagtatcagcggtcttatctcaaacaaggccggtgatctaaatggcgtttgaaaatatagagcaattaatgccggatacgaccgaaacgagattggccttcgaggaggcgcaacgcaccgttgctgattgtgcagatgccgcatggcgggatatttcttccggcgatatcctaaccgcgagcatttcaacagttcaagaagccgcagatgacgcctggaaagcatgcgagccaacactcaacgctgcaggcgaaactgtccgcgatggcgcaaggaacggagcttatcttggcggcaggttcgtacttggagttgccgacgttggagaaaacgcatatgtcggtgttcaatcgaatattgaactactggccgaagacgaagaagcagcggtgaaaaccgcgcaaacacacgctgttgacgatgcagccaacgcctggggcgacttcatggaagccgatgagcagatacgggaaatcggagactatgtcgaaactggaggcgaaatcgccactgaagttgcgcttggtgccgtagccgtcaccgcttctgcccctgcagcactcgctgctggggctgtactcgttcttgacgaaatgggaaagagcttggaagccggcgctgaagacggtgagatatctcaggaggatatcgtcggagaagtcgttgcgggaactgttacggcagcaacgcttcttgccggacgaggtctaaataactttcttgcctcaaaggcagcagaatcgggcgcaagctcacgaattctggatgatgccggaaaggcaatttacgaaggcgaccgactgcttcccaataacgagtttgcgatcgacggcgtgaagtgtgcaaccgacgatctcgggcagctttaccgcgttggcgacgacctcgttccgaacatgagctatgagatcaatgggtataaatacgttaccgatgcaatgggtagggtcgaatcggccgaaggcttcttacaactaaagacccacgaaggtcgtttgaccatcaaggacactatccagtcaatcggaaaagggtttgaagagctttttgatcaaagaggccatctgattgccgaccgattcaatggatcaaatggccttgagaatattgtcgccatgggcggcgaggttaaccaaaagcctatgcagcaatcgagcaaaaatgcgccgatgctttggctgatggcgctgaagtgtttttcaaggttgagccactttatgagggcgggtcattcaggcctagctcgtttgctatcacggacattattgacggcgaagagacggttacgtttcttcttaacactgcaaaggaaatgtaatgagtgaaaagaagatgctacaagggatagcttcaattcttgaggaaaccctccccgaagactggagcaaggtcgtgttttacgccgagtacgccgagggtgcgttctctattgagtattacgttgctggcagcggaaaagacgacttcgttaaatgctttgaccaaaaaggcgtttcgagggcatccttgatgaaaaactttatggctatcaacaagttcattgaacctgaaagggccgcgcttaagcccgaaaagagatggggatcgatgacgcttattctccattccaacggcaagttcaaagttgattacgactactccgacatgacagaaaacgcttacgcccgaaagaaggcctggaaaaagaaatatctcgcctagcaacgaacggtctgggaaatcaccgcaaagccacccgtgcatactcttcgagcgcacgcgtcgtcggcaacgtttcgaccagcgcgtttttgggagccatgcaaacccctgttcaacattcctcgggagtgattgctctctatgacgaatgggattccccatcggggaatcccattttttgttgccgacgacgtccggtataatttttccgtttacgacgtcgttcggaaagggatgccgacctctatgcgccagggattcgacaacgaaaaatacatcgagctgcaagccgccaacatcagaaagcgcatcgcgcaattcggcggcaaactctatctggaattcggaggcaagctcttcgacgactaccacgcctcgcgcgtgctgcccggctttgagccggacaccaagttccgcatgttggaaagtctggtggacgatgtggaaatcgtcatcgccatcaacgccaaccatatcgaaaaaggcaagacccgcggcgacctcggtatcccctacgacgaggacgtgctgcgactcatcgacgtgttccgttcccgcggcttcctcgtcggctccgtagtgctcacccaatacgccaatcagcccgccgccgacgcctaccgccaccgcctcgagcaactcggcgtcacctgccgcctgcactacccgatcgccggatacccgcacgacatcgaacgcatcgtttcagacgacggatacggcaagaacgagtacatcgagaccacccggccgctcgtcgtggtcaccgcgcccggccctggctccggcaaactcgccacgtgcctgagccagctctaccacgagcaccagcgcggcatcgacgccggctatgccaaatacgagacgttccccatctggaatcttccgctcaaccatccggtcaacatcgcgtacgaggctgccaccgtcgacctcgacgatgccaatatcatcgacccgttccatctggaggcgtacggcgagaccaccgtcaactacaaccgcgacgtcgaagcattccccgtgctcaaagccatgatggagcgcatcatgggcgaaagcccctatcagagccccaccgatatgggcgtcaacatggccggatacgccattgtggacgacgatgcctgccgcgatgccgcgcgtctggaaatcgtgcgccgctacttcgccgccgccgtgcacttgaagcgcaccggcactggcgaggaacaggtggagcggctgcgctccatcatgaaccgggccggcgtgacccccgatctttctcccgcccgcgccgtggcccttgagaaggaagccgccaccggtgccccggctggtgccatggtgctgcccgatggccatgtggtcaccggcaaaaccggcgacctgttgggcgcggccagcgcgctgctgatgcacgcgctcaaggccgtcaccggtgttgacgaaaccattccggtaatcgacgatgccgccatcgaacccatctgtcggctgaaaaccgagcatctcaacagcgtgaaccgacgcttgcactcggatgagacgctgattgcattgtcaatcaccagcgccaccagtcctgtggccgctcgcgtcatcgacgggctcaaacagttgcggggctgcgacgccttcttctccgttatcatctcatccacggacgaggcgctgtatcgcaaactcggcatcaacgtgtgctgcgaaccgaagtacgaacgggtgagtctgtatcaccggtaagcgccaccgataagcgcggtatgccgcgaatcgtcaagccggtaatcatgcagcatgcggcctgacgattcgctgctgtcgcattgtctctcccctcggccatgctgggcttgttttccgtttgttggagagaacggggaatgccatcagcactacggaaagagaaggattatccgtgaagcggttcgtgggtttagacggtattaaaggactagcgctgatagccattgtgctgtaccactgcatgcagcaacggctgccaggcggattctacggagtcgacgtgttcttcaccgtctctggattcctgattgccgtcagtttgattcgttctctggcgaaaaccggatcgctgaatctcgtgcgatatattcccaagcgtgcagtacgtctctatccggcgctgtttctgctgattccggtcatcgtctccgtcggctggctgttcgatcacgacattctagtttccatccgcgaccaagtcatcaccgtgctgctgggctgctacaactggtacgccattgccggaggccaaagctatttcgaccaaatgaacccgcaggtgtttcgccatctgtggttcattggcgtgctcatgcagttctacgtcatcgcgccgttcatcgtctggctgatgtggaagctccgccagacgaaactgtcttcactcatcccactgggactcgcggcgttcagcagtatcgccatgtgggtgatgtatgtgcccaaaggcgaccccacccgcgtctacttcggcaccgatacccacagcatgggcctgatgctgggtgtggctctcgcctggtgggtcaccgctcctcagttgggccacgctcgccagagggctgtgccgatgccccgcaccattagctcgagcgcttcggcagccgcacatcgggctccgttacctcagattcccgtggagcatcgcatctggaatgcggcggcaccggtattggcgttcctcagcctgattgccttggtcaccatggcggttatcggcaaacaggatgcattcgccttccgcggtggcatcatattgtccagcttgttgtccgtgctgctgattgccggtaccatctccgacgattcctggatgcaaagcctcatggtgttcaagccattggcctccctcggcaagtattcgtacggcatctacctgtggcactggccgttgtggattctttccagcgcccttgccccgaagatcttcaaggcagtagggccttggcctctcatcatgaccgcgttgctcaccgccattgcggtgatgatttcctggctgatggtggagaaaccggcggcaacgcactcggcggtatccgtcgtggtgccccttcgcacgaacaagaagaatcatgtggcccgggttattgccgttgacgttatcctggtgctgtcgttggccggctgcgtgcagggcattgctcatgcacctgcgaaaaccgccatgcagatccagctggagcaacaggccgcacaactggaacgtatgcagaaaaccgaacacgtgctgctgcgccatgccgtgccggcaccgcccaagcccaagcatgagatgcccaccggcgatcagattaccgccataggcgattcggtgatgctggcctcatcacagggcctttcggaagtcttccccggcattcagaccgacgcgagcgtttcccgctccatcatggtcgcccccgaactcatcggcaacgctctgtccgccggcagtctgcggcagtgggtgttgatcggccttggcaccaattcggcaatcacccctgatcagttggaccagattcgtaatatgatcggccccgaccgcgtgctggtactggtcaatgcccacggagaccgtacgtggattccacctaccaaccaggtgcttgccgactatgcggccgcacatccagacaatgtggtgctggtggattgggatgccacagccaacgcgaacgcgcaggtgctcggctccgacggcatccacccgagcatggatagcgatatctatgcaaaggcggtcaaacaggccatcgaacaatggatcgcaagcggcaggtgaacggcaggcaacgctgagttgtccaaccagtcgtgaagaacggctatgctgaagactgcatcaacgagaccacacgttgggagacatggtgagcgcaatccttgaagggaagcccgataagaatcttattctcgttacgggaaggattcatccgaagttggctgaggatgtcgccgagcagctcggcatcgacgtccttgaaaccaccgcatacgatttcgccaacggcgagatgtacgtgcgctacactgaatcggtgcgtggcgccgatgtgttcgtgctgcaaagccactacaagcccatcaacaaggcgatcatggagcagctcatcatgatcgacgcattgaagcgcgcctcggcccgttccattactgcggtctgcccgttgctcggctactcccgtcaggacaagaagcaccgcggccgcgagcccatctcctgccgtctggtgttcgacctgctgaagaccgccggtgccgaccgcatcatgtcggtcgatctgcatgccgcgcagtcccaaggcttcttcgacggcccggtcgatcatctggtggccatgccagtgctggtcgactacatccgtgatcgtttccagggccatctcgacaacgtcgccgtcgtctcccccgacgccggccgcattcgcgtggccgagcagtgggcgcagcgtctcggcggcggtccgctcgctttcgtgcacaagacgcgcgacatcacccgcccgaaccaggcggtcgccaaccgtgtggtcggcgacgtcgccggcaaggactgcgtgcttgtcgatgacctgatcgacaccgccggtaccatcgcgggcgcatgccacgtgctgcaggacgcgggagccaagtcggtgaccgtggtcgccacgcatggcgtgctctccggcccggccatcgagcgactcaagaactgcggtgcgcgcgaggtcgtgctgaccgacaccgtgccgattcccgaggaaaagcgctgggatggcttgaccgtcctgtcgatcgccccgctgctggccagcgccatccgcgccgtattcgaggacggctcggtcgccgaactgttcgacacctaccccgagcaccacggtcaaggcttcctgttcgcctgatcacgtgcgtgtttgttcgtggaaagcacacgatgcgagacgcgacatggcgtagcctttcggtaaataccgacagtatggtataaatgaacacttgtgggccgaaagcccacgactcccccatggtgtaatggcagcacacgggtctttggaaccctttgtcttggttcgagtccaggtgggggaacggctgacggccgctcgacatccgggcggccgtctattgttttgaggtgtttccaccctcaatagacattccgatcgaagggaatacgtcagttatggcattatccgcagccatcgtcctcgccgccggcgagggtacccgcatgcgttccaacaagccgaaggtgctgcatgcttttgcaggcaagaccttcctgaacagggtcatggattcggtggccgccctgaatcccgacacgttggccgtggtcgtgcacttccaggccgagcgcgtcgccgaagccgcccgctcctatgacgagcaggtcaccattgtgaaccaggacgacattcccggtaccggccgcgccgtgcagtgcgcaatggcgcagctcaccgaggctggcaaggtcgatggcccggtgctgatcgccgcctccgacatgccgctgctcgacagcgagacgctgcaccgtctggtcgaattccacaccgcctccggcaacggtgccactgtgctcaccaccatcctcgatgacccgaccggctacggccgcatcatccgcgatcgcgaaggcaacgtgctgcgcatcgttgaacagaaagacgccaaccgcagcgaactcgccgtgcaggaagtgaacacctcagtctacgtgttcgaggcttccgtgcttaccgaggcaatcgccggactgaagtcgaacaacgcgcagggtgagttctatctgaccgacgcgctggaaaccgccaaggccgctggcaaggtcggcgcgttcgccgctccggatccgctcaccgtcgaaggcgtgaacgaccgcgtgcagctggccgcgctgtccaagacctacaaccgccgcgtctgcgagcgctggatgcgcgacggcgtgaccattcttgacccggaaaccacttggatcgaggacgatgtccagatcggccgcgacgccaccatcctgcccggctccttcctgcaaggccacacggtggtcggcgaggacgccatcgtcggcccgtacaccaccctgatcgacgcgaccgtggacgaaggtgccgtggtcgagcgttcccgcgtacaggaatcgcacatcggcgcacgcacgaacatcggcccgtggacctacctgcgcccgggcaacgagttcggcgaggatgccaaggccggcgcgttcgtcgaaatgaagaaggcgcacatcggcaacggcaccaaggtgccgcacctgagctacgtgggcgacgcccagcttggcgaccacaccaacatcggcggcggcaccattaccgccaactatgacggcgtgcacaagaaccgcaccaccatcggctccggctgccacgtgggtgccggcaacctgttcgtggccccggttgaagtgggcgacaacgtgaccaccggcgccggttccgtggtgcgccacgccgtgccgagcgacacgatggtctactccgagaatacgcaacacaacgtcgagggctggaagcccgcctgggagcgctgaaccatgcccgcacttcaggattccatcaacgccgtccgcgtggccgccgaggccgcggaccgtatcaaagccaccgacatcgtggccttcgacgtagccgacctgctcggcatcaccgacatcatgatgatcgccggcgcctccaacgagcgtcaggtactggccgtggccgaggaaatcgaaaaggacctgttccttaagtgctccggccgtcagccgcgctctcgcgagggcctgaccgagggccagtgggtgctgcttgactacggtgatttcgtgattcatgtcatgcacgaggaatcgcgcgaattctacgggctcgaacgactctggcgcgactgcccggccatcgatcttgaactcgcacacccggaaacggcggagcatgcggaagatgctgccgtcaccaccgcgtaacgtgcgaatcacataacgctgatattcgcgtgtcgggctgcctgttgccaaacatcattgacggcatcaggcagccctcccctttttcctgtttcctcactggaaccgaaaggatcgtcactatgaccaatcatgttcgttccgttttccttatccgtcatggacgcacctcctacaacgccgctcacaagctccaaggccaggtcgacattccgctggacgccgtgggtgaatggcaggtcaagcagaccgccgcggccttgaaaaggctgtacgtcgatcgtcggcaggaaatcaaccaccggttcattgtctgctccgatttgaagcgtgcgcacgccaccgcgcaagctttcgccgacgtattgggtggaatcgagcccgtcgatgatcgtcgcgtccgtgaacgcagcttcggtgattgggatggccatgccgtggccgaactggccgaacgctaccccgaggacttccgttcctggatggaatctcggggcggcgagctgaagtatggtgccgagcccaaggaagctgtgggcaagcgcggcgtagaggctcttgaggactggtccacgcgtgccggagacgacacggacctgttcgtgttctcgcacggcgcatggattgcgcagacattgcagaccctgttgggcatttctgcaatcgatccgaccttttctacggtggtttcattgcgtaatgcgcactgggtgcgcttggtgccgatggacaatcccgatggcactgtgcgctggcgtctgctggactacaatcacggtccggccatcgccgacaccgacgagtgggaacgcgaacgctgatcgtgtcacggctccctgctgagccaacaggttcagtgtattcgaaaaaccgttcaagcagtaattgaataacccaatgcctgaataatggcggaaacaagccaaaaagtgtcgccaaatcccacttttgccatttggcgacacgccggcttttgccagaatcgacatctcgtcgtaatgtatacgaggtccaaacaacgggccaacaattgaaaacggggctatagcgcagctggtagcgcatctccatggcatggagagggtcgggggttcgaatccccctagctccacgacgaagccatcaaatcaggcgatatggtggtttctccgctggttcatggcgggtcttgcgactcccatgaatcggatagcttcactcggggctatagcgcagctggtagcgcatctccatggcatggagagggtcgggggttcgaatccccctagctccacaatcaaggccggtgcttcatgcaccggcctttctcgttttctggcctatcggccgacttttgcgcaacattccccggaaagcgtcgccaaggggacgctcttccgattggcgcgacaccggcgtgagcgataacagtaatcgccactacaatgaggtgtggtccctatcgtgttgattatcaaaggagacaaaaacatcgtgaccgtcacccgtgtatatatcgccagccctgaaggcgccaatggccgcaacgtcgtcgcttacggcatgctcaacgcattgacttccaagtacaagaccatggtgttccgccctgctgtgtccaaccatgacgaattcaccccgatcctgctcgccgcctccaatgccggactcggcgtggccctgtccaccggcctcgatgtgcacaaggtgcgcgaggataaggacaccgcccgtggcgatatcgtcggcgcgttcaacgatgccatggacgtttcccgcgcggacgccgccctgatcgtgggcaccgacaagtcccacgtcaacgatccgaccagctatgaattcgacgcgaatgtcgccgctgatctgaaggccggcgtgttcctagccgtgtgcaccatcgaccgttggccgcacgagctcgacgagaccgtcaagctgtccatcgagggcatggaggccgctggcaacaaggtgctcggcatcttcgtgaccggatgcgagccgcgccacgctttctccgttaaggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgttgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaacaccgtgcgcccggccctgcaggtcatcaagaccaagcccggccagaagctggtctccggcgcatttctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccggatctgccggtggtcggttccatccagttcgacgccgcctggtcccccaccgtggccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggtctcaacaagccggtaaacgacctgtcccgtggtgctctggtgcaggacatcatcaacaccatcgccctcaccgccatcgaagcgcagtgagcccggcttggctcccggtggctcccgccagcgggagccaccgtaatgcttattttgtagcaagcaacgagtaatctaatcaacggtaacccgtgtctcacgggaacattcaatcacaatggaggatgcccacaatggcgaaaaccgtccttgtcatcaattccggctccagctcgatcaagtaccagctggttgatctcgaatccggcgaaggcctcgcttccggcctcgtcgagaagatcggtgagccggtcgacggccactacaagcacgagtacaacggcgaaaagcacgagcttgaagagccgattcacgaccacgagcagggtctgaagcgcgtgctcggcttcttcgaggagtacggcccgaacctgtctgaggctggcattgtcgccgtcggccaccgtgtggtgcagggtggctccatcttcccgaagccggccctcgtgaccgacaagaccatcaaccaggtcaaggatctggctgtgctcgccccgctgcacaacggcccggaggccaagggcgccgaagtcatgcgctccctgctgccggacgttccgcagatcttcgtcttcgattcctccttcttcttccagctgccgaaggccgccagcacctacgcgctgaacaaggaaatcgccgatcagtaccacatccgccgctacggcgcccacggcacctcccacgagtacatctcctccgtggtgccggacgtcgtcggcaagccggctgaaggcctgaagcagatcgttttgcacatcggcaacggcgcttccgcttccgctgaggtctccggcaagccggttgagacctccatgggtctgaccccgcttgagggcctgatgatgggtggccgtaccggtgacatcgacccggctgtggtcttccacctgattcgcaacgcccacatgaacgtggacgagcttgacgccctgttcaacaagcgttccggcatgatgggcatgaccggctatggcgatttgcgtgaggttcaccgtctggtgtccgagggcaatgaggacgccaagctggctctggatgtctacgtgcaccgcatcgtcagctatatcggcaactacacctaccagatgggtggctgcgacgtgatcaccttcaccgctggcgtgggcgagaacgacgacgtggtccgcaagatggtgtgcgacaagctcgctccgttcggcgtcaagctggacgaggagaagaacgccacccgctccaaggaaccgcgcatcatctccactccggactcctccgtgatcatcgccgtgattccgacgaacgaagagctggccatcgcccgcaagtccgccgcaatcgccgaagccggcaccgacacctacggcaacaccttcgccaagtaagtaaccgccgttaggcatctcaccaatctctagttgcaacactatgggggctgattccgattggaatcagcccccattcgtatatggtcatgagaccactacccccgcgtcatactctcctcagtcgcctccggcggactgaggggggtccaccagaacacaggaccccttactgcctcagcatgccgctccacataccgacgaaatcaggcaaggtcttgcgcgtggtggccacgttgatgacctcgatatcgggaatacgcagccccagcatcgcggcgaacgtggccatacggtgatcagcataggtttccatcacggcaccgtgcaacgtctccgccggcaccggttcgatacgcaatccatcaggcaattcctcagccgctcccccaacacgacgaatctcgttgaccaatgcctccagacgattcgtttcgtggccgcgcaagtgaccaataccaaccatgtctgtcgacttatcagcaaacaccagaatcgccgccaacgagggcgcaatctccccggccgccgtcaaatcgaacgtacccagcccatgcacggtgccgtcaccggtcacctcgcaatagcgcacgccatcgattgtcgggaacgatactttggcacccatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcgcggttcaaccgtccatgtgcgggcggattcgtcggcctcaaccgcaccgccggcaccggtcacatcggccacggtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcgggcgtgcataagcctgttcgtcgccatcaaaattcactgggccatctgcaaacagggcaaggccgggcacgaaacgcatcaccgtgccggccagtccgcagaacacattgacgttgccatggaatcggccggatacaggaggagtaaccgttacggtggtgtcggttgcggaatccacgtcgcagcggacaccgagggcttcgagtgcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgcggcgagcggggcaggccagagattcgtgagtcgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgtggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatgtcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaaacgattatgtacgggcttcttagcctttgcgactatcgttaccgccttgccgagtaccgttgttcatgcagaaagaaagcagtattggacacaatcgaatgagcgtgtcggtatcgttgaaaaagtaatgaatgacggttctatcggttcaacctttaagggacgaaccagccgcggcaccatggcgctgatgcatgactatgccgagctcatcaatgaattacgtccgacagcagagcaattcaccgagatcgagcaatactgggtcaaacgaattcaggcgttcttcaccagcaaaccattcaagctggagtccgacaactcgctttccgttgatgcggccgtggaacatctgctgcggcaggcagcgcagcggcgaagggagaatccgggcaccatgtacgtcggcaccgtcctgcagcatctcgtcgcggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcatcggattgacgcacggtgtgcagaacgtcagaggtcacgccgctggcgggcgaccgcaggttggcttccggctgccggccatcctgcggctgcgcggcaagccagcctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcaggcggatgtcgtcatcccagatttcctccggccattggtcgggactatagtcgccaccgaaagcgatgccgcgtccgtccgcggtcagcagttttggccatgcgaagtcacgtcatgcacgcacggttatctcctttggcaggcggcgcagggccacggcccatatcggataccagctgatagacactcctggccgatagtcgacacgccgccggttccggccccactgccggaaccgacatgggtatgttcatgaccgccgaccgcaggaacgaacaggcccgtccgccacggaccgcatcttgcggttcaggcggacgggccttatgggagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgagaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcctgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgatgatcatggagaccatgccgccggtgaacaggtagcgacggggaatccagcggttgagaatcgggtacagcggcgccatgatgaatccggcgatcagcgggatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgatgaacagcacgatgaacagcgtggtgttcacgttgaccagtccgaacatgccggagaagatgagcacgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggcgagagccttgctgtagctgacgaacaggcagctggtgacgtacgtgacgaagtacgtgctcatcgcgttgtagaaggcagcctgccccaagttgccgcacgcgtaggcgatgcgctggcctaacccgcccttcctgcggacgtcaccgtccgcgacattttcgttgctcattaatcttctccttaagaacccagagcatggaatcactcattgattttgtaaagtatagcatacaagttttatcaccgtaagcatacaagttttatcaccgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttattcttttcggtaaaggaggccccgacctcctccataatatcattcacaacgaggtaatgacagaaagcaggagagcatgacagacgtcacacatgtcgatcgcgcatcgcaggcttggctgaccgacccgacggtgttcgaggtgaaccggactccggcccattccagccacaagtggtacgcccgcgacccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctgcagacggccggtctgatgaaccacaagtacgtgaacgtccagtatccgtgggacggccacgagaacccgttggaaccgaacatcccggaaaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggacggcttcacgcccaacgagttcgacatcaccgaactgctgcacgacggggagaacgtcgtggccgtcgcctgctacgaatactccagcgcctcctggcttgaggatcaggacttctggcgtctgcacggcctgttccgctccgtcgaactcgccgcccgcccgcacgtgcacatcgagaacacgcagatcgaagccgattgggatcccgaggccggcaccgcctccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcggaccgctgcagggcatcgccccttggagcgccgaaagcccgacgctgtacgagcttgacgtcgacgtcatcgaccaagcgggcgacgtcatcgaatgcacgtcccagaaggtcggtttccgccgcttccgcatcgaggacggcatcctgaccatcaacggcaagcgcatcgtgttcaagggtgccgaccgccacgagttcgacgccgaacgcggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgagaccaacctcgaagcccacggcagctggtccctgcccggagacgtcctcaccgaggacaccatcgtgccgggcagcaagcgcgaatgggaaggcgcctgcgtcgaccgcgtcaacagcatgatgcgtcgcgactacaaccacccgagcgtgctgatctggtcgctgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgcatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccgtcccccaaggcccaggaagtcaagcagctgtactcgaacgtccacatcgacgtgacgaaggactcggtgtccgtcaagaacgacaacctgttcaccgccaccggcgactacgtgttcgttctgagcgttctcgccgacggcaagccggtctggcagtccacccggcgtttcgacgtgccggccggtgagacccgcacgttcgatgtcgcatggccggtggcggcgtaccgcgccgacgcccgcgaactggtgctgcaggtttcgcagcgtctcgccaaggcgaccgattgggccgagagcggctacgagctcgccttcggacaggccgtggtgcccgcggacgcgaccgcgacgcccgacgcgaagccggccgatgggaccatcaccgtgggccgttggaacgccggcgtgcgaggcgccggacgcgaggtcctgctttcgcgcacccagggcggcatggtctcctacaccttcgccggcaacgagttcgtgctgcgccgtcccgcaatcaccaccttccgtccgctgaccgacaacgatcgcggtgccggtcacggtttcgagcgcgtccagtggctgggcgccggccgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtgacctgcccaccatcccggcgttcggcatcgaatggacgctgccggtgcagtacacgaacctgaggttcttcggcaccggcccggaggagacgtacctggaccgcaaacacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccattcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccaatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcactcataagctatcaagagaatccagaaccttttttgaattcatatgctcgacacgcaatgtatccagcgtcgtttataatgattcattgtgccttaatggcgcatcgggctatagcgcagtttggtagcgcgcctgctttgggagcaggatgttaccaaagcgttgcgcttgcaacacccgctgagacctactcccgcttgggttttaaggtctcagaaaaaactgaagaatgaccgccagtaacactcagtaacaatgaccgcagacctccgattttctcggcttatctgaacgtcaaaaatgaggcatctggaagcacaaaccgtcttgaggtatgtgtagactagaaaagttgtgccaaatggcataattaccgggccgtagcgcagtttggtagcgcgcttgctttgggagcaagatgtcgcgggttcaaatcccgccggcccgaccacgaaagccctactcccgcttgggaattaaggctttttcttttgcttgaaaggccgtttcggaggctgaaaaagttttactgggttttactgagtctaccgacgcaaatctttccaccttatacttgttaaacaagtgattcatgcgctttcgacgtcgaagcgtaaggatttaaggagtcgatatggaagacgagccgctgtaccgcctgataatgcctgacgggatgcatttggccaatcctcaagacgatcccagcgtctatctgggagccttcttcgatgatgaaaaccatttgaaaggacaagcacgttgggaacccgtcttcgacaataccgacgacggagacggcgcagaaatcggcaacgatgacggagacacacctgcagcggctatggctgccgccgcaattgcgattgccgcaatagtcggaaccgcatactatctagcgaacaatgagacattcagaagctggtgggataaaaccgtcgttcattggtgggaggattcagttaaacctacgatgggtaaactttggaacaaagtgactcgtcgttcaaaaaaaaatgatgtcgaaacgcctcagccgattgcattactgacttccgctcctgaaacgacaaacgcattctccaaggaagtcgatgacgcgattgaagcatgccagttgcacatggacagcgaggaggcacaaaatcgtttgcttatcatcatgtacaaggcaatggatctcgcaaaggatattcgtgaactttcctcggccaacattcaagaatccgctttcggtgaaaagacgaaactggagttgcgtcagaccatggaaaagctgacaacgcagaacgtgacagatcttatcgacaaggccttggaacggaacattccgcttcttgagaagcaggagaaattcgacgcttggtctgcgcttttagggaagatgaccagtgatggcaaatttgtgcccctacgcagcgatgccttacgaacggcattgagtctagaaccctaccgagcaatgctggaagccccgtcacataaaggcgaataagtaaatgcggtgagtgatactgcgcaagcaacattactcaccgcatgcctatgcccgtcgcctatcaagcaacggcactagttcacttaagccgagtttcccatcattgccataatgcaattgccctcttttcacccatgagcggatagtgttggccggcagacggatccccgctttcgcgcattcagcactcagttgcttggctgtacctcgtacttcgctgacgaccagtttggcaagcagacggtcggcgacggcacgacggttcaccttgttgccgcatccagcgcattcgccgtactgctcgtcgggatcgccccacaccacgcttccacaactggggcaagcgccgaacgctatacgcggcttggcggggttgaccgccgtgtggatccgtcgggcaagattggtgatgtcctgataccaggcgagcacgtccccgctcgacagcaagggaactggatccatgatcgcggcgttcgccagcgccttcacagtggcgcgcgggtccacggccttcgcgtagtcgaaacgcaaacccagttgtcgcagtagctgttccgtctcgcagtacagttcccacatgccgtcacgcaacggcgacggtgcctgcgccggcgtggaatgcctgttgccctgtatgctgacgctggcccgtttggcggcgaccaacagcagcggcatggcatcctcacctatcatggcgagggcttccatgagccgtcgctcgcactccttgcacagcagccttccagcaacagtgctggctccgtcattgttcacgcatggccctgtcatcgtcgttccctccgttcaagtgttgtcttaggtcttgcaggctgtcggtgtcatatccgcacgagcaccaccagcgcagtctgtggccggtagattcggtgatgaccagatgcggttcactcgtggttgtcatcgccgtgtctttcgttcatggcgcggatgtgttcctgcatggcggtgagcgacgggtagttgcggccgcacgagcagacgtagatccgcccgtgcttcgcggtgtccacgagcctgtgcctgatggtgggtgtggggtcgtcaaggaatgccagtgggttgctcatgatggtttctccgatcttgtgttccagatggttggcgaaccggttggggtcgcgtgtggcgtatccgcattggcagacgcgcatgtatccggcggcggtgccgaacccgaccgtgagggccggtgtgcgcagcgtggccagtaccgccggcacgagtttggcgagccgatgcgtgtggatgcttggtggttgtggttggtgtgtgatggtcatggtttattcctctaggctgtctcgaaagcgcttatctcccctttgctgggttgcggtccgttccatttggacgctgccgtgcgtttgggtggtttgaatggcttcacgctgatcggcgtgcggaagcactcgtgggctgcgaggtacatgccgtcaggtttgatgccccgcgtgccgcatggtgtgcgcagtccaatcagcgtggtgccggcgatgggctggatgcgcgtgaacctgcggcccaggatgatggccacggccagatccgttgcgtccagtacgccggggtcgtaaatctcttcgatcggccctccggtgtccaccgccacccattcacggcatgtgccgcagcgtctggctgtcaggtgcgcggggttcgcgcccgacgggcacaggagtttgagccacggtggtttccgtctcggcatcatcggtcgcctcccagctggcggcggatggactgccagatcgtctccaactcagattccttcagtccgctggtctgtccgcgctcgaacagatcacggcgaatggcctcggcattgtcggggtggttcagcagtcttccgtaggcccacgcgtgaaggtcgttgttccggcttccggccggtatcggcgtcatgtcgggtttcccgttcgctatggatccgaccgtgacgggccggcgcattagctcgctcaatgacgggatccgcgccgcatgctccggcttgggcgtggaagcttggccatcgggttcggtcacgtagccgtggtcgatcagccatcgcaccatcctgggcggcatcatcggcggctggccgtctggtaggtcaagcagcaggtagtcgccgccggatatatgactgcccgctccgaccacgtagcccttgccttcgcagcggatgtctaccggcatgcccttctcgtggacggcgttcttcagccggccttgcagttcgggcgggatcaggtagtaggcgtgtgcggagggcaagccgttcctgcggccggtgggtgtgcctacgaggtacgtcttcgggaagtcctcggagccgtattcgccgatttcgcggttgaagacgtcccagccggtcggagcgtctttgagcacttcgccggtggccggatccttggccacgtccagatcgatgaccgccatgcccgcaacgggaacgaccgcatacgcggccacgcccgtcggcggttgcttgccttccggcagcgtgcggtttttggcccagtcgtaggagcgtttcccctcgttgaccgtgccgaacgtgaccggatagccgcaatcgtccggcgtgaccacggtgcctccctcgatgggatccggcaacggtggcaccgtcttggctgcgtcttcttcctgcatggcttcggtcatgtccttggcggtgccgtcgcggtacacgctgaacacgcgttcgttcctgaccaccagcacgcgcacgacctcgccgttgatgcgcttgggcttcgatttcagaccgagcttcgtgacggtgttgcggtgcgccatgtcggtctcgtggtgcgggttgtcgcggctgacggcgtacccgttcgccacgatgcagtccacgatccactgctgcgcttcggtcaggtcgtcggcggatccgatgacgacatcgttccagggcttgtcgccacgcacctcccacaggcggcatgaggccatcagaaacggtgctatgccatgttcgtcgaggaatttcagcaggtcggcgaattcctcctcggctcggccgtccctcatgcgcacgaacacgcggcggcgttccaacgcctcggtcatgctcatgatgactggattgttcgatgcgatgatgaacgtggccttgttcttgaagctgaccgcgttctcctgcactcgacgggcgaccatcgtgtcgccggtgccgatcttcttcagcagggtagcctgttccagggtgatggtgtcggcatcctcgtcgtaggcccacagcgcgccgatcagcttcagagtctcctgatcggtggcgaagccgccgttgccgttgcgccctcccagcagggtcttcgacgtgaccgccgcagacagttcgggaaggctgcgatgcagtgtgtccagtaggatgcccttgccgttgccgccgccaccgtacagcacgtagaacagatgcttgtatggctccaacaaaggggctgcgaacatacgtcccagattctcggcgctgtggctgtcggcggtgacgaaatgcaggaatctgcctgcctgcgacaccagttcgtcggagtagtcaacgtccacgaacgcaccggcgtatggccgctggtctacgtgtccgccgcgttcattccccagatcccggccgatgtgcgtgccaactgcggtctgtgggtggctcagtacaccaacaacaatcccaccggctggcagtcccgaccgtggaactacggcaagtacggcgaggccatgcgccagtacaccagcaacgggcgcatcaacggctacaacggcccgttggatctgaactacttccgtggcacccgcgaacagtgggacaagtacgccaacccgggcaaatccttcaagccgactccgatgccggctccacagcccgcgccgagcgtggactacgaggcattggcgaccgcgacgatccgtggcgactacggcaacggcgaagcccgcagggccgcgttgggagcgaactacgggctggtcatgagcatcgtcaaccagaggctcaacggatccacggcatacacgcccgccgcttccatccggagcgtgagcgtgaccgtgcgcagcggcaacatcaacctgatctatcccggcaacatcgtcacctaccgaggcgcggcgaccgttgcttccagcggatctgttgccacgggtggacgtgtgcatgtcgtcaagagcggcgaaacgctcagcggcatctttggagcttccggttggcagcgcgtcgcccagttgaacaacctcgccaatcccaacctcatttaccccggccagcggctccgctactgaccacaaccatcgtggccttcggcaccgtgccggaggccaccttcatcatcaaactaaggagaaccatatggatatttccaccgcaaccaccctcgcatccgggctcgtggcgctaatcgtgcccgcgtttgtgcaggcgttcaagaagtacattcccagcggatacgtcggactcgtgtccctcgccgcttccatcctgttcggtaccatcgccatcgccgccaccggcggattcgatggcacctacacatggggcatcgtgcttgcaggcgtagtcggcgtggctcagaccgtgtatacgctcgtcaaccaagcgttcgacggtaagctgagcaaagactctgggactatttagatgaaagggttgccggacggcatgcgcgccatccggcaaccctttcatctcatatgccagattccaccgtctgatctatatacttcttccaagcgggagcttccatgagatctctctgcgcttcgcacacttcaatcagctctttgattttctcgtgtttggcactttcgttgctctggaacagtgcgatgaagcatttctggaattgtgcaagcgtcaaaggcagtatgtctagtcgttgcttgacatcgccttttgcataccatacgccgtggcggaaagtttcagcagtgttggtatcgatcttgactgcgatgaacagtccgtacactggaatgtcgtttttcccatacttcagcaccgcatcggatacgtgccgtcttacaggctcgccttccatggattcctggcgggatcctgtggacatagtaacttcggtcagaatggtgaatttatcgtattcgcagtacaggtctccttgtccgccgcccgctgccgatacaggaaggaagtccgagtccaatcggaaacctcgtatatcgctgggatggttgatgaggtttccgaaggcgagcgcggcacgccataatacccattcgagatatgccggagtttcatctttaggtacttcgatgccgttgtcctcatcggcgtcatcgatcttcttgcctccgcctttgatcaacagtgtcatgtagtcagagatctcctgccattgttctggttgtttggcggcgtagttgatttcgtcggttttctgccagagttcttcgagatggaggcgcgctgcattgatctcaggtaccgttgataccgggcgatttccaagatcgtaatatacatggttcttcttcagctgtgcttccatatcgagaagcaaagccttggcggtttcaagatcatccatgggcaaggacgcgccatggcagagctccttgtatacgtccataattgggcgacggctcaatgttgttgaggccagcttttccgctaggaagtgcttggccggaacgatgacaaggcctcgacctttcctttggacgattccactgatgcgaaggtagcgcatgttcatatcgctgtaatcagtgaaattatcgctcttcttgttgtaatcctgaccacgcttcttgatttcgtcggcgtcaaacctacgcttggctgttgctttcttgcgacgctctcgcagatcgatgatatggtttacgacatcgttgatgtcatagctgggattggtggtatgaccccacagtgaaaattcgattcgactgatttcactggtgcctgtacgcttttcaagttccagcatcaccgccaatatccaccttagcggggagaagaagccgagatctcctggaactttggtctgctcaagactcagcgaacgtaagaagcattcctgctgcgcaggataggtgtcggctttgaggaaggtctcgccgaatggtgtcaccagatcttgggggccgagatcttcctgtttgccgcccttctttttaacttgcggataaatgaacccaaaacgggcgaacattaaccgccattttcttgcatagctgctggtgtcttctgcttcgccggtcgaattaactaagccggcatgattaagcagtgtttggaatcgttcttcgttgcttcctcgcaggttcccattgaacggggactcggcgaacagcttcaggccctcccagatgcgcatcggattgcgtaatccagtgttgcccagttgccagatcgttatcggtttgcccatgacttcagtttacagtcaactcagcgtcatgggcattaacctgatgattaccagccaaggaagaagtactcttcgaccttgtttctgtttgccgcacctttatgctgggtgccaatggagtatcggtagtcaacgggaacgacttcgacgttcttcttatgccgaccaaggatcctcagcatctcttcttttgtcggctgactgttggaagagtaggagatgataagaatactatccttgaatcgctcgatcaatttgtcgaatgcgtccgcagctcctgtccgggaagaaaacggggtcgggtaggacttgaatttcttggtcttggtatgctcctgcatcgtaacaccctgccagtcgcatgcaagcccctcgacgaaatggtaacgccgtacatattcgttatccgacaatggcgagtagtacggaggatccatgtatacgaggtcaggatggtttgcctcaagcagcaacgcatcgccgcgaatggacttattcggctgacggttatcgaagacagcgttgttcaccgcttcaacagcttcgaggaactgctcggcaagtgtcttcttcaaatccttgcgtccatcgtcgtaccggtgtccggtgtaagtgaagataccacgcgggcgttttttcgtgcaggcgcgaatcaatgcggtcatagctatagcctgttgatagggatcttcgatgtctttgatacgcgtgcgaagaacgtcgatcagatgattttcttcgtccgtgtaatacagtcccccgaaggtgttcgacacgaaatcgtcggtcgggcaatcctccagcaatgcctttgcttcttgcaaaggcagagtcgtgttctggttttccaccatcgccttggtgaaggtggcgctcatggccatgtagtcgttgcttatgacttgtttgccttgcgctttgaacatgtagctgacgatgcccgatccggagaacaggtctacgaccgagttgaagttgaatctggctgccacgttccacagttcagtgagcagtttctgcttggaacccatgaaacgggttggcggatatagctcaacctgcttggatagatttttcttttccggcagagccgccgccagggtcttgggctctggttctgcaatgatcagtgtgtcttctcccgtgcggctgcttgccctgcaagctacggaacgttttgtaggaatgacctgaatctcgtattgcccatacagatcatggaccagcggatgattcgagttggtcaacagaagatggcatcccagcgaatgcagacgggagaattcaactgcaagccgtgaatggtctgagatctcgaactgttccttcgtatagcgcttgaaatccgagtattcggaaaccggaatgtacggcgggtcaagaaacacgaagtcacctggttcggcgtattcggcaagcacggcggcataatcgccgcagacaattgtggcattctggagcgctttggaagcttcacgcagggcctgagcgtcgcagatcttcggattcttgtattttccgaatggggtattgaactgccccttgcgattgactcgatataggccgttgaaacaggtcttgttcaggtaaatcgttcgcgccgcagcttctaccggtgacagattggtccaatccagagaacgaaccttgagaaactgctctcgctcgttcttgtatccaacaagaatggcgatcacttcttcgacatgatcccttacttgtgtatataggttcacaagttcgggattgctgtccgcgatcacggcgttctcaggacgaagcgcgaagaacagcgcaccgccaccgaagaatggttcgatgtatttgccatagtgcgccggaactttcggaagaagcacgtcaagcatctgggatttaccgccagcccacttcaggataggcttcactcggccattggacaccctagctgatgcttgagcgctatttgtttttgcacgtggacggccagccttcttaggagaaagcatgcgctccagcacgtcggagagaaacggattgccgttatcggaacgcaacgtgccgcgtcgaaccagggtagcgactgtggcattcttcacgcctagtatttttgcggcctctgccttggtgatggttttatcctccatcggcatgttttgagccgcgtaattcccaagcggggtgcgccaccatgaggggtccttctcgctttttttgatcaaaagagtgtagacctgctgccattccggttctttgcgcagttcaggaagggaggtgttgtttgatttgatctgaagaataaggtctcctgcgtccacgccgaacatcggcaagttgtcaaagagtcctttggattcttgaaggaactggagcgtggcttcctcaaccaaggtgttcatcattgtccctcaccatcccatggatctcttagtgcttaatgtctaaaacaagtttgacattttcattggacagatccattcattgctgaatgtctcaggcgtgtcgtacgctcgcgcaaacgagcgtacatgggatacttgggtaaagctgtaacttagcgactgtaagcctacccgaagttggagagcacaagatggcaaagaaagtacgcttctacgcaggtgttgaaattgacaaagatggaatcagacacacttggagtgctgatgcttggcaacagttcatggattcttgcaaaaaagaatcacaagcctttgaaattcgaggtcgcaagatagctgggcaatgtgaatcatgctattctcctgcagtcttctacatgcacttgacaaagagccgagagctatctgattggccggaggctggtgacgcttcaggatctgtttctaatcttgccacgcgcagagaccaaaccggcatcatttcaattttagagtatacgtatttgttgcctgtttcgggcacaccgtatatagcattattgcgttcatcgtcgggacccatgccatcagctattgcagattgggtgtccctcaaatcggatatgcccgcagccggaaagtcttttgaactccagccagttctccgaaatgatgcccgacaaaagttgaatgaatcacttggggtaaagagtcttgaggtcagatttgagggaaagccggatccaaactcaactagttcgattgaacgtgctgctgcagaggcggcatcaacgattgatgaaagcgactatgccaacgtaaaagttgatatgagcatcagcatggggcgcgcgacagtagtaagcaattcgactgaagctatgcgaaaacaagctttgtctatattaacgaacaataatattgccaagcaccctattaaagatatgctttctaaaggctgggtgacaaaattaaaggcgaaaacacttcaagcaaatccagaatccgataaacctatcattgaaccagtggatttcataaaggagcacctcacagaagacgcggactttggatccatgaaagatgatgagatgactccggagatcattctttccggcatgctggaagctattggtaaattccgcaaaagatcaaatgaatattaacaggaggcggaaacgccgtgaaagcaatcataggaaaactcaaagataaaccatcgcttgtcactttattaataatattattgattgtagttcaaattattcttattaagtgtggaattatcgttgattttttcagaaatgctacgcaagagcgataaagcaaatgatctttatttagctatgcttagcgtagcagcgcttcaagcaagttttgctggcgtcatagttgtatttggattgtcaacgcaaccgcaagcatttagaaatttgagaattgctgctggcgatgcacttgtagataattggatgtctattagctacagcggttttctaagtgctggttgtgcactgttcgcttctttgtctagtatgatggctgacacttggttagccccttggttttttgaagcttcgatattgttttgtatacatggagttgtgcgtttgctgtggttgcttaagcaactcattaaagttgtccgagacgtagattcaaaagaggccctaaaagccagcgaacgataacaggaagctcattcagaagattgtgacacgccgaccgtcgtcagctccacgatggtcaaattccagtaaaaaaccagtaacaatgaccgtcacggtgagccaatcccagtcggctcaacaaagacaaccaaaaatgagaaaccgccattttccaacgatattcggctcaacaaagaaacaccccgcgaaaacaggatgataccaaaccagcaaaactatgaccctcgctgaggcctactgccgcttaggttttggaacttcggtaaaaactgaaaaatggcatccgttaacaatggttaacaatgaccgcagacctccgagtttgcggatgtttcagggcttgatcccttgggtgcctgaaggtacagagtgtcccactcggtgcgtataattaaaaagttatgccttaaggcatgaaaacgggctgtggcgcagtttggtagcgcgcttgctttgggagcaagacgtcgcaggttcaaatcctgtcagcccgacaatgaaagccctactcccacttgggatgtagggcttcttcttttttgctctgggggcgtttgctaacacaattccagtgttaacggattggctgaatccgttaacattttctgttaacgcagcttggtgcctgtaatccttgtgattccaatggtttcggtatgatcgatggatcgtcgcaatccctcacacgctgtgagccaattcgtgagccaactgaccggaacgacattcatgtcacgataattccgatacctcccgatcacatctcactgccacgtcaaattgtcgagatccacaccgaatcttgtcgcgttggcttcaatcagtgcaagcagccactgggccaaacccggttccaaagcatcgtaatgctgtacgaaacgctcgtcggccacgtacatgcggccgaggcacacgtgcattgacggggtgacatcgaaccataccaaggaacgacggtgggcttccgccagctcattgccctcatcgctgccgggcttcacgccgtgacgcatggcatcggcgagccgctgctcgatggcttcgaattgcttcatgtcgcgctcctgcatatcagacgttctcctcacctggtattccgcaacctgcatccactgccggctcccgccccaacggctctgcgcttcttcggcccattctcgggattgctgcgtcgcatcattcatatcgattcctttctgtgcaacgttcataagccgatcgatatcggccaatgcctgattgatatgttccgccttgcgtgcaagttggccccgacgatccgccaactcgcgtattacctcactcggcttggcatcgagcagctgcttgatacgcggcacgggtatgccgagctccctgtacagcagcagcctgcgcagtcgtctgagatccgaatcggaatacagccggtatccattccagtcgcgttgcggagacaccagacccatttcgtcccaatgccgcagcatgcgaatactgatgttcgtcagccgcgacacatcccctacgttgagatgggaaatacgctccgccggagtgtccatgtcgtgtgattgccggtcattcatggttacaggctaaagtatgacatcatgtgagggtcaaatcagcatggcgacgcgaacacagacatcgatttcagttcacggtgtccacgactggagtaaaaatccgattatactgaatcgcacatcacactaacggctaaaaccaaccgtctccgacaatccatagggagaacacatggatgacatgaacccacgctgcggctggtgcaatctcagctgaacccacgctgcggctggtgcaatctcagcaatcccgtctatgttgcctatcacgatgccgaatgggcggttccgtcgcatgatgaccaccacctctttgagatgctggtgctcgagaccttccaagccggactgtcatgggagacgatactgaacaaacgcaagcgtttccgtcaggcgttcgatgggttcgacatcgaacggatccggcgctatgacgagaacaagatcgccgaactcatgaacgatccgggcatcatccgcgaccgtcgcaaaatcgtcgcgacggtcggtaatgccaacgcattccgggatatccagacgtcgtacggcagtttcgacgactatatttggcggttcaccggccgtcacgtcatctacgagaccggcatgactacatcccctctgtccgacgccatcgcagtggatctcaagacgtacggcatgcgattcatcggcaccaccatcgtctacgcctatctgcaatccatcggcgtcatcaatgcacatgagcctggatgcttcctgcacagggaaaggtgacccgcgcaaggatttataaggtcgctcgggcagaatctctccgagaggaacccgtgcttctagttattttgcttatcgagttcttggtagcgctctttgaccccggtaaggattccggcagattgttcacgctactgcgcggtgagcgcttcgagcagttcgccgaaagtcaacccaccttcactaccggatgacggatgatggttttgagattttccggtttggctcggcgtgggtcggataggtagatctcgtgatggcggcgggtgtcggagaagtcgagcccgtagccttgcgaacgcgcgtagccgtccagaatcgtcacggttgcgggctcgtcgtcgtacgggcctttgtgcatgacctgcgcgaccacgccttcatcgaagtcgaagagatatgcatgattgatgtcgacttcgggatgcttggcggcaaacgatgccttggcccacgcaaagacctcatcggtcacgaattccggcagacgaatcatcgaagtccaatggaagtcggctttgtgcgcgtaatcgacgccgggcacaccctcccccatgctccataagccctccagcggaggcacggtgtagtcgaagtacccgtcgatatgctcggccgggttctttgacttcttgctcattttgacggtgaacgaaatgccgtacagcagttgcatcgccttggcgtaatcgccgccttcttcgttcgggtcgcccacaccgtccaccgcgacgaaccgcatcgccggcaccgtgacgatggcgggcatcctcttcggctgatacaggtccttatattcctttttatagtcgaatgccatcgctcatttcccctccgccaccgcatcgatctcatcctggcgccgccaccgcttgaggtttggcaacagcgccgacatgcagtcctcggcctgttcgacgctgatatggcaggattccgccatcatcggcgcgcatgcggcgaccaattcatcgctattggcatagtcctgaagaaaaacgccgtcttcatagcagtagttgcaataatctccgtttcgcgttccatccggttcggtgccgtgatcttccgggcagtaaaacggcatggcacaactttgacaaaaaccattgtccggcatttccataagcctcgccatcggcacctcaaaacgggtgctgatcagccgaatcatgtcgatgctcggctctgccgttcccttctcccagcgggaaagcgcctgttgggtgacgaacagctcgtgcgcgaactgcgactgcgtaagacctcgctcctcgcgcacgactttgataacctgaccgattgacatgactacctcccgacatcggaaaacgattcgcgcgtctcgctgtgcgcttgctgattccagtctaagggcatgtcccgttcgccaagcgcgggtacaacaaaccgttgttcgcgcttgtatcccggaggaagaaacggctcggtcgaacctatttcctctccacccccttcaattctcccggttcctctgactcctttgcgagcgccgcggatgggatgagcacgcttacgtatggggttgcgccagacaggacgtcgtcgtagaagcgctgtttggcgtcgacgaagtcgatggaatcctggatttccgcgagctgctcgaccagccgcgcccgcttgccggcgagcatctacttgcgttcggggatgctcggctcgtggaggagcgtaaggggcgcgagtaggggttcgcggctttgctgcggtctctccctcacccggctacactgggagctccctcgtcagagggagcttaaattcggtctggttataggcccatgggcttcttgggctttttgtcgctcatgagcatgaggaagctgcgggactgggcggtgatcatgaagcccgcctcatagctcagttccggctcatccgggttgtgcgtatccacgaccagctgccatttgcggccgtatcgctcatccggcagggtgaacataatcggctcgtaatgcgcgttgaagatcaggatgaagtcattgtcgaccatccggttgccgtaccagtcgacctccggaatatccgaaccgttcagatagatcatcatggagaacgcatgcgtgttctgccagtcgtccatatccatgatcgagccggtgtggtcgaaccattcgacctgcggaatcatgttcgaatcgtcgccgggctcacggcctgtgaagaagcgacggcggtgcaacaccggatgatccaaacgcagatgaatgagtttggaaacgaaggcgagcagttccttgcgtcccttgtcaagatgccagttggtccaggagatctcgttgtcctgacagtaggcgttgttgttgccctgctgggtgcgggccacttcgtcgccaccgcaaatcatcgggataccctggctgaacagcaacgtggcgaacatgttgcgcatctgacgctgacgcaagtcgttgacgtccggaatattggtcgggccttcaacgccgcaattccaagagcgattgttgctctcgccgtcgcgattgccctcgccattggcttcgttgtgcttttcgttgtagctgaccaggtcgttcattgtgaaaccgtcatgcgcggtgatgaagttcacggacgccaccggtcgacggccgttgacctgatacagatcggagctgcccatgaggcgtgatgcgaattcgggcaacgtggagggctgtgagcgccagaagtcgcgcaccgtgtcgcggtagcggccattccattcggaccagctggacgggaagccgcccacctgatagccgccggagcccagatcccacggttcggcaatcagcttcacgcgcgagatgatcgggtcctgctccacgatgtcgaagaacgcggacagcttgtcgacctcctggaactggcgtgccagcgtggcggccagatcgaagcggaagccgtcgacgtgcatttcggtaacccagtagcgcagcgaatcggtaatcaactgcagcgcgtgcggcgagcgcataagcagcgagttgccggtaccggtggtgtcgaagtagtgctgctggtcgccttccaccagtcggtagtaggaggcgttgtcgatgcccttgaagctcagggtggggcccatatggttgccttcggcggtgtggttgtacaccacgtcgaggatgacctccatgccggcgtgatggtaggccttgaccatggacttgaattcgttgacctgctcgccgcgctctccggaggaggagtaggcgttgtgcggcgcgaagaagccgatggtgttgtagccccagtagttcgacaggcccttctcctgcaggaaggagtcgttgacgaactggtggatcggcatgagttcgatggcggtgacgccgagcttcttcaggtattcgatgacgctcgggtaggccaggccggcgtaggtgccgcggatgtccggcggcacgtccatgttgaggttggtcatgccgcgcacgtgcgcctcgtagatcaccgaatcgtggtacgagatgtaggggtgctggtcgttgccccagtcgaaatacggattgatgacggccgacttcatggtgtgggcggccgagtcaaggtcgttcatcgccgaggtgtcgtccgggcttttgaaccagtaggagaacaggctttcgtcgccgtcgatgttgccttcgatggccttggcatacgggtcgagcagcagtttgttggggttgcatctgaggccgtgcatcgggtcatagggaccgtagacgcggtagccgtagcgttggccgggctggaggccggggatatagttatgccatacgtatgagttccgttcggtcatttcgatgcgcgtttccgcatcgtgctcgtcgaacaggcatagctcgactttctgcgcaacctgtgagtacagcgcgaagttcacaccggcgccgtcatagctggcgcccagcggatacattgatccaggtctgatctgcatagttttcagtatcccactttcttgtgtcactgatgtgccggggagttgaacgtcaggagaacagcgacggcttatccttgtcggagttcctggcgatgagtctgcgtaacgcctcatgctggatggcgatcatcgaattggatgaggtgatgcgcgtggcggcaaggtcgctccacggaatccacgcggattccacgtgctcgtccgcgtcgaaatggcgctgctcccgcctgaacgggcccaaatgcaacaccatgatgtgggccagttcgtcggtcatgccttcggacgagtagaaatcgcccacgaagtcaacacccatggtgtcacggtccggcaccacgccggtttcctcggccagttccctcagggccgcgtccatgatgtcctcgccctcgtccatgagaccggcgggaagcccgtaggcgaacatgtccgatccggcacggtattcgcgttcgatgaggtaacggtcggtggacatgtcgtgcacgagcatgaccacacagggggcgtgacgcagcacctggcggccgatctcgtgttccttgccctgcttgtcggtcagagcgatgcgcatgtcgtccacgtggaagatgcgcccggtataaacggtttcgctactgatcactttggcgggcacgtccatgtcgatgccgtccgaggaggcgttcagcttatggtcgagccgatgctccagttgttcctgcttgcttccgccagacatgtcatctcctcggaaaaaacgtttttgccacgttactatagcgtcttaatctcgatgcgcggtaatggacagcgtccatggatcggtcgtgtcgtggaaccactcgacttcaggccttgctccggtcgcttgttcgatggcggctggcacgtcatcgatcgcgtagttgaaccacatggattcgatggcggcatgaggggtgttgatgaagcagggacgcacatggctctcccccgccattccatggccgagcatgatgccttgggacctcatacgggcttcataccgggcttgttcgatggcgtcggtcaccgggtggtgacgcaaatcgctggttacgtacacgtccgcaccggtggcacgtacctcgttgaacagggagtccccggagccaggcagaatggccacatactgaacaaaagtgtccgaatcgccgcatacctggatgccgagcgcgctggtcatgccatgatcggacacttcgtcgaatactcgctgagcgaaatccttcagggcaacaggcttcggcaaacgacccacacgccccaagccgaccggatgagaggcgtttgcatcgtcaatcggcacgagtggtttctggtcgatgagtccgaagtagtcggccgccgcctgtcccacgccgcgatacgcagcgtcggcattagtgtgccctacccacagcccgcagccgtgctggtagagtctgcggacgatgtcgccccggaaaccgagtccgctcgtctcgtgtacggaacggaagaacaacgggtgatgggtgatgagcaggtccgcgccagtagcgatagccttgtcaatgatggcggaggtcgggtcggcggcgaacacgatgcggtgcacgtcgtgactcagatcgccgacaatgaggcccggctcatcccattcctcggcgtagcgcaatgggtacagggtctcgagaacgtcgatgacttgcttgagattcggcatatgtcccattgtagtgggctattgctgcaagggactcattctgcaattgcggacaagccatgctcgtgctcttcattgctcgactatcggctcgccttcgcctacaaacaatccactggactgtttgctcaacggctcagccccctcacccgaggggagctagaaattgtcagtgtgcagcgagttgccagtcggaaccgatgccgcacgatacgtccagcggcacggcaaggtcgacggcgtgttccatggcgttgcgcaccagttcggtgacctggtcgccttctcccggcgcgatttccactaccagttcatcgtgaatctgcagaatgatacggctcttgacgtgagcctcggccaaggtctgctcggcgcgaatcatcgcaatcttcatgatgtcggcggcggatccctgaatcggtgcgttgagtgccgcacgttcagcggcctcacgcgcaacacgattggtcgaatgcagggccgggaagtagcgacgtcgtccgaaaatggtttccgtataccccttctctcgggcattggccaccagcgattcaaggtaatcgtgcaccttgccaaaggtatcgaaataccggtttttcaacgcttccgcttcacgtggcgcgatcttgagttgctgggcaagaccatacgtgctcagaccataggccaatccgtagctcatggcttttacgtggctgcgctggtcgccggtgatctggtcgaccggcagcttgtagaccatcgaggccacgtatttgtggaagtcggctccggagcggaacgcttcgatcagcgcctcatcatcggacagatcagccataatgcgcagctcgacctgtgagtaatcgcagctcatcagggcctcgtacccctcccccggcacgaacacgccacgaatctcacggccggcggcgttccgattggggatgttctgcaggttcggatccacggagctcaatcggccggtggcggcaacggtttgctcgaaagtggtgtggatgcgctcatctgatgtgttggtggcatcgatcagcgtttggacgatctgcttgagcttgttgatctcgcgatggcgcagcaacgctccgaggaaaccgttggcccgctcattgtccactgatttgacatacagatcctgcaatgcggccgcattcgtggtgtatgagccggacttggtgcgtttggtgggtttcaaacccatatcttcgaacagcaccttctgcagctgcttggggctttgcaggttgatttcggtgccggcatactcccaagccatttcctgcgcttggcgagcctcggcggcaaactggtcacgcatggagacgagtcgaacgctatcgactttggctcctgtgtgctccatgccgtgcagcacgcgggaaacaggaagttcaatcgcgcgcatcagccagcattgttcacgctcgtcgataatcggcccgagcgtgacggcgaggctgcggataatggccaaatcacgcagacgatgttcgttcggatcttcttcgacctgatcgtcgtcgaagtccaacgtgccttgcgaaggctgttcggtttcggtgaagtggatgtcgaggaagtgctcggccgcctgcttgaggctatcggcatggaaatccggttgggccagatacccggcaagcttggtgtcgaacatcggcaggtccatgtcaagatcgaccgcgcccaaaagatgcagcaattctttatacccatgcacgatggtgcgggagtgttcgcttttcaggaaccgcgcaagctgtgctcgcagggtatcggtgattggaaggggcactatggccgctgatgttgccgtggccacggcaatggcttgtgccgtggcacgccccggcctttcgtcgccccatgcggccacggtccaagcgtggccgaccgcgtcgccgcagatggcatgccgctgcgagccatcgccatagtcggaaaccgtgaaatcggcgatttcaccgggaaccttgacttcgacgcgatgggccttgacccattcgtcgaactgctccggagcagtgatgctcgtgggttccggcaggttcagatcgaggctgctatcctgctcgttctgctcattattcgtagactcgccagctccggatgtgttggatgccttggccccggtattgaaggttttcagtacacgactcttggtgcgaggtccgaattcaagctccttgaacagggcgtcgatctgtgccacgtccacggtgccgaatgtcagatcctcgatatcgacgcctagatcgacgtctcgtaccagtgcgttgactttgcgattgagtttgacctggtcgatattggcccgcagtgattcgccttttttgccgccgatttcatcggcgtgctcgcaaatgccgtcgagggaaccgaattggttgatccacttggccgcaaagccgtcgcctacgccgggcacaccgggaatattgtcggcggtttcgcctcggagtgccgccagatccggatattgtgcgggagtgactttgtatttgtcgatgatggactgcggcgtcatatgcttcaggtctttgaagtgatggcccgggtacaacacggtgacgttgtcatccaccagctggaaagcgtctcggtcaccggacaataccagtgtgtggtaaccggccttgtctcccatggtggcgagggtggcgatcacgtcgtcgccttcgaatcccggcttctcgatgtaggtgacgccgagggccgtgagcatgcgttgaatcaatggcagctgggtgagcagctcttcgggagccgcctcacgggtgcctttgtattgcggaagcatctcattgcggaatgtgccgcccttcacatcgaaggcgacgcccagatggtcgggcttctccgcatcgatcacctgcgcgagcatggtggcaaaaccccagacggcgttggtggcctggccgctggaggtgctgaagttgtcgaccggcagggcgaaaaatgcacggaaggccagcgagtggccgtccaccaccagcaatgtttcattggtgggtacggtcacgctggcctctcccatagtgtgtttgtgttgctttacgactcagtacggcgacgccgataatcagcgttcgcccgaatcagaaggcttcggatcgccgtacttggcgatgatggcctgagccaggcgcttcttggggatgcgctggtccatggaggtcttctgaatccaacggaaggcaccctgctcggagaagtccgccttgtccatcagcagacccttggcgcggtcgacgagcttgcgctcctcaagcgtgtcttcggccttcttgagcttctcttcggtttccttgagctgatcggtggtttccttgagcttacgttcgctgcgctccacgctgtccagcaaatcgttgatctcggcgaaacggcccatggccacctcgagggtcggcagcagcttggattcctcgtacggcttggtgacgtatgccatggcgccagcgccggtggccttcttcaccagatcggtctgggagaatgcggtgagcatgacgacgggggcgatgttttcatcgcagataatgccggcagcggtgatgccgtccatacgcggcatcttgacatccatgcacaccacatcagggcggtacttgcgggtcagttccacggcttcctcgccgttggcggcctgaccaacgacctcataaccgttgtcttccagcatggcgaccagatccatgcggttcacggcttcgtcctcggccacgacaacggtacgcggaccgtcctcgggcttggccttgcgctcagcaggttcgctttcattggccacggccttgagctcttcgtcggtcagcacctcatcgatgttgatactcggttcttcggacttcttccttgcagccatgccaacctctttcttgaattacccaacaatggggttcacaataatttcagcgaactcctaactaaagtgccctcggtgggactcgaacccaccaccttcgcataccctgccgagctgaggacaattccttgtcaggaatcgcttctgactcagtttaccctcctgtacatcctgttcgcggtttctctgcgagttttgcccgcacgctgaaccgttcccgttttgtacggcagtcaagagtagcggctgcggacgcggcctgtcaaatatcggcgtgtgggagaatggagtttccgttttcgcggagtgtccacatagatgcagggtttaccaaggtgaccgtgttctttagggtgtgcgctgcgcgaagacggttttttattggctgaaggaggccgaagatggttgaagagacaaagaggcccttgcgccgcaggcgttttgggtgcattctcgaacgcaagggttcgacaggggatgtcacgagcatcgaggctcgttatatctcgccgatcaatggtcagcgtgtgtcgaaacgtttcgcgccgggcaggcggggcgatgccgaggattggctcgagaccgagaggtcgatcgtcgatctgcaccgtcgtgggatgatgacgtggattcctccacgggaccgggatgggaacacgttgacaccgaagctgacgttcggcgtgttcgccgacgggtatgtgcgccggcatcgcaggaaggacggcgccgagatcgcgggctcgacgttgcgtaacctgcgcaatgacatcaagcatctcaaggaggcgttcggcgacgtgaaactggccgagttgaccgaggagctggtgaccgaatggtattacgggccgcatccgaacggggaatggcagttccgctcggaatgcatccggttgaagatgctgttgcgggaggcgtgtgcgccgggctccaagggcgctcctcccctgttggcggagaacccgttcacgctgccgattccgcccgagccggaggctgggtcgtcggatattccgccggtcacgcccgacgaactgtaccatatatataatgcgatgccgggctatacgcggttgtcggtgtatctcgcggcctgtgcgggcggcatgcgcatcggcgaggtctgcggtctgatggacacggacttcgacttggagaacaaggtgctgatgatccgtcgcagcgtcagccatggcgcggatgatctgggcccgtcccggatcggcaggctgaagacgaaggggtcccggcgtacggtgcctatcccggacatgctgattcctttgattcgcatgcatctcgaggatcgtccggaccagtcgaaccacatgttcttccaggccaagcgcggcgagatcctgtgtcagaacactctgcgcaaccacttcatgaaggcccgcaaggcggcgggccgtcccgacctgcagttccgcactctgcgcgtgacccatgccacccgtctcatgctcgatggcagcagtctcaaggagacgatggacgccctcggacatgtgagggaggagaccacgttgcggcattacctgcgtgccgtgccggagcatcagagggaggccgcggaacgcaccgccgcctatctgctgtccgcggacccgtcgctcgcgatcgcctcgctgcctcccgctcccgccgggctggacgcggacggcgatgcgggcgacatggccgcgctggcgttgctgcttggccaggtgtcgacgctgatggccggcatcgccgcccggaactcgcagccggccggctagcccggccgtgcgtgaccatacgggttcatgcgcttacggctggaccgtccatgcccgcatcctgcgcgggtccgggacggtccggcgtttccatgggcatcgcgccgggcagtgcggcggggtcggggaacatgttcgcggcgggccatagcccggtcggcccctcgtcgggtgcgggatcgtagccggggcccgtcgcctgcgcctggcggatgcattcgttcacgcttccgtcgaacgtgctcgtacgggtggcggcccggcggaccaggtcgaggccggcggcgtcgctgcgatccatgtcgacgatgagcatggtcggcatgcccgcgccgaggatcaggtgccggcccgtggtctccacgaggtcgtcgtgcggcgtgatgatcggatggtccgtgacctgcaacgggttggcggggtcgtcgggcagagcgaggtggatgtcctccggcttggtggcggggatgcggatgggttggacggcgagcggctgggcggggtcggggtttctggtggcgatttccccggtgatccaggcggcgttccagtcgtagacgccgaggggtgcgtgcaggtcaggctcggccatgacgcgggcctggagcgcgtgggcgcggatgacgcccctgttctcatgccagtgggagttgaggagtccgatggaggcgagcagctggtctcccaccatgcggcccttgtccttgtacctgttccattccgcggctccttgcggctggtccgccgggttgagcgcgtcgcgtgcgatctggatggcgccgagggcgtgcgcgaggtcgagcgcgatgtccttccatgggcggcgggtgtcgatcgcgatggcgtgttcgtcgagccggtagcccatgggttcggcggcggccttcgcctcgtgcctgacggccaggccctgccgcgtgagggtcttcgagagggcctgtgcgacccgtgcgaacaggtgggtctcctcggcctcgtcgagtgtgaagtcgggcaggatgccgcccttctcctggatgttttggatgtcctgttcggtgtagtcgccacggtccttgagatgcgggtcctgccaggctggcgtggtgttgcgggatatgtcggccatgatggtcctccttgatgggcggggccgtctttcggccccttcccatccggcacccgcacgccgcgagccgccggccgattgcattccgtccgtcaccggcatgtacttcacgacgtacaatcgggatatgggagaaatcacgatggaaccggcttaccacggtatcgaggaggagaccgtcacgcgtctgccgtccaaggtgttcgacgagtttctcaaggccctcgacaggccggtgccgcagaccgcccgggaccttatcggcatggagcccgattggctatgaggttcgcgtccccgcgtagggcctggtccggcgacgtgctcgacgggtccggctgcggccgtcgcgcccatctacgagcggctgccacttcgtgcgcgggacgccgagaaacacggacatcggccgtataacgtaagtcggaaaaacagcaggccctccgccgcgggacggagggcctgccttcgggcggagaatcagatctcggccagcgccttgtctaggagcgtgcgcaccgcattgctgcggctcatgtggtgtttgcgcatgtaccgttccagcttcgcgtcgcgttcgtcgtccagacggacgcggatcacgttggaggcaggggtgctgcccacggctaggggacggcctggggttctcttcagcgcctcggatagctgctcgtcggtgtagcccctctcggcctcctcggcatcggccttgagcatcgcggcctcgtcggccggcagttcgtcgtaggagaggatgtcgtagttcatgtccattgcctgcctccttccagcagtttcacgtattgggtcctcatgcgcatcgcatggatgagcgccggccccctcgatgtgtcggccaccaccacctccaggggaaggccatccggtgatatacccagatacaggaccttgagggggtcctcacgcagcacgaggtcgcgaagcggatgctccccacgtacatggcgtcatcaggttcgatgccgtgcttgagcgccgaggggaatatgttcacagtaatattgtgacacaaaataggcgacgggtcaaggacgcatggggcacggtccgtcacggccattgtgatccagtcgacgatcgagattctggtaggtggcgatctcatcctgttgggcttggtcctgcgtcaggtcgcgttgccgttggaggccgcctgctggtggcgttggaggctgtcgcgtatggacgccgaagccgccctgatcctcgcccgggcgttgtcttccttccgggattacgtctcggttagatgagccgccctgttttgtccgcatatcgatggcatgcgtcgcatggcttgagtgacaaccatgacaatgatcaggaggaggcgtgtgatgacgggttcggctcatggcggtccggccgatgacaatgatgtcggaggtgttttccgcgtatgcgtgggcgtggaagaatcggctcgtcccgccccgttgatgtggggtgttttcgatgaaccgttgacggatcatgatctgctggtattgtcgcgcgcgtttgatttttcggacgggctcagggagcattgcgtgccggccgcttgggaggcccttgattcgacgttggattccggtgtgcgcgagcttgtatcgcatccgccccggaccgaggccgagcttgcggcggccatcgcgggtttgggtcatgccgtcgcccggcgggcggtggatggcgcgctcgatcgtcttcagtccagatggctgtaacgctgcacttcgatgatgttgcggggcaatctgttctccgtttccccggatggcgcatgttccgtccatcgtgtggactggttggtccgccggcagtggtcggctatctcctttgatatgagccgcatggtctttcctgacggttcggacggtttcggtcagctggggcatgtacatggtcccattatccccaatatcccttctttggtccgatatcggcgggattcgggccggcggcggcgtggatggccggattgtgcgtcgcgcgtgttgggaggcttgcatggctggtggcgaggggaagcgggggtcgtcgggcaaggcgttcgtggtggccggcatggtggtcgcggccccgctgctcacggtcgtggtcgtgttgttgtgcctggtgatcctggtggtcgcgatactgcagtcggattacggtctggggacgcgttgcgtgacgggttcctcgtcgtgggtggattgggcggtgtcggtcgcgaaggacgataaacatgggtattcgcagccgaaccgcgggggcgacccggattacgactgttcgtcgttcgtgtgggcggcgttgcgccatgcgggcttcgacgtggggtcgagcccgttcaacactgacggcatggattcggtgttgaaggcggccggtttcgaacggtcggatttcagggatgtggcgtccctgcaggcgggcgacgtcgtgtgggcggacgggcatacggagatctacatgggtgatggcgagttcgtgggcgcgcattgggacgagaggcacggggtcgagggcaggacgcccggcgaccagaccggcgacgagatcggcgtgacgtccacgttgaacgcgcggtacacgcgcgtgtaccgtgcgccggcctcgcagggctcgcaggcggtgtcgggcggcacgtcggattccggttgggacgggatgggcgcggagcaggcgaaggccgcctggttcggcggcctggccggtccgggcaatacgtgcgtctcgtatccgcagggccagtgcacgtggggcgcgtgcctgcgcgcctaccgtctggggtggaagcatgtgggacagtattggggcgatggcggcatgtgggcctcgtccgcggccgcggagggttacagggtgacgcggacggccccggtgccgggcgcgatcgtgagtttcccgcccggcgtgcagggcgctgatccggcggccgggcatgtggccgtggtcgagtcggtggacgcgtcgaagggcacggtcacgatcagcgagatgaacgcgcatggcccggtgtacacgtcgcgcgagctgcccatcgcgggcggcgcgaacttcatccttcccaaggacccgatccacggggccggcggcggctcctcgtcgacggcgacgtgctcggcgggcgaccaggacggcgagaaggcgagcgtggaggaggcgaagaggatcgcgaagcgcaagatgaaggacatgggctgggatgacggttcccagttcgaatgcctggacacgatcttcaccgaggagtcgggctggcggtgggacgccaccaacccggacagcggcgcgtacggcatcccccagtcgctgccggcggagaagatggcctcggccggccaggattggcggacgaacgcggccacgcagatcgactggggcctgaaatacattcgtgacaggtacgggacgccgtgcgccgcgtacgcggaacgcagggccaagggctggtactgagattatcggcgtccgttcgggtggtttttccgggagcggtcgtctcatggcgttcccgggccggccggcgcatgatttttcttctcttttttcccgtgcgccggcgggccgctttccttcacggccccatgccccctccccgggcgtggggcctttcctttctttccggcccgttatcggccgtgggccgtgccggcgcgtggtggatgtgcgggcccgtgttgtcgggccgtggaggcttgtgatgagggaggctgtgatgtccgggatggtgttggccgatgattcgctgatcaacctgttccccgatcccgcgtgggatgtggcggggttcagggacctggcggggggcgtgatagcggtgtgcctgtacgcggcggtcgcgatggtgatcgtcggcgtgctgaccctgctgccgggcctgatcacgaacaacatgatggagcgcgcgttctcgtggaagcggctgctgtgcgcgttgatgatcccgttgacgatcggcgcggcgacgggcgggttcgcgtggggcgcgggcgcgttcggcgcggacgggctggcggtgaacgactcgtaccagtccgcgaacggtcatcccgactggaagggcgtgaagagcgacgaggcgaagaagtcggatgatctgggcggcgtggtccggcagttgggcgaggacatcgcgaaccgtgtgggcaaggccgcgggcgacgcgatcgacaaggccctgtcgacgggcaagaaggcgtggcagtggctgtccggcggcgacgggaagggcaacgtgttccagaaggccggccaggcggcgggcgacgccgcttcgggcgcctgggactggctgtcgggcggggacgggaagggcaacgtgttccagaaggccggggacgccgcgtccggggcctgggattgggcttcgggcggcgacgggaagggcaacgtgttcgagaagacgggccgggcggcgggcgacctgtggtcgtccctgttcggctgagccgtccgcccccgttatcggcacgagacgtccgccgcctttggtggcggtggggaaaggagggtgaatcatgaccattattcatccaatcgccgccaccgcgtccgatatcgtgctggcgttgaccgacaacgacctgtccgggttctccgtgtccccgaactggacgttcttcccgttcatgagcctggtgtcgaacatcgtgggcggcctgtgggctttgggcatcttcgtggcgacggccgcgtggatcatcgccgcgttctcctgggtcgtgtccaaggcgatccacaacagcacgatgcagcagtacagcggcatcgtgttcgtgtggatcgcgctgggcatgatgctgctcggctcggccatggcgatcgtcaagttcgcgtccacgcaggccctgttctgacctcggggcccgttccctttttcctccgggcccgtcccgccgtcggggcgggccctttccttttcttgtttttccgttgttgggaggctgtcgtgggcgatgtcgtcgaggcggtgctgcagaagctgttcccgtggatgctggatccgatgggcaaggcgttgcagggcatgatggtgggcgcgttctcgtcgaccgccgggtccgtgtcgtacgcggagtggaacgtggcgatcacggccgcgaacaggatcggctgggtgatgggtttcgtgaacatgctcatctgcgcggtgggcgcggtgcatgcggccgtgaaggccagcccggcggagtcggtcaagtcgttcgcgatggcggtgctcgcctggccgttgaccgcgatctgcgtgagcgtgatgatcacgtgcgaggggatcgtgagcctcctgtccgcgaggatcctcgcggtgggcgcggacacgaccaagggccggggcatggagtcgatggtgtcggccatgttcaagaagatcctggagcaggcgtccgtcctgcattcgctgacgatgctgctcgtctatctggtgttgttcgtgggcgtgttcctcctgtgctgcatgctcgcggcccgcaccctgtgcctggtgctgctggccgcggtcgcccccttgccggtgatgagcgccggctggaaggcgacccggccggcgatgcgccgctggctttcggccgtggtgggcgtgatgctggccaagccgttggccgcgctggtgatcacggtcgggtcggcgctgatgacctcgcagaccacgtcgggcgtgggcgagggcagtttctgggatctgctggtcggcgtcgccgcgatctacatggcctgctattcgccgaagatgatcatgccggtcgtgcagttcctgggcgacgaccggagcatgggcatgcagcaggccgcgagccaggcgggccggaacgcgctggtgaccgcggcccagctgacccggcaggtcgtgaccgcggccgccggggtggcgaccggcggggccgcggcggcgggcgtgcagttgcccggcatggcgcagggcgggctggccgccctgaccggccaatgggggcaggtcggcgaacaggccggaaaaatgctcgccggctccaagtccgacggcaaggacaaggatgatggcggcggggcccgggattccggcgcccatgccgccgatccgtcgaaggacgacgggtacgagccgccggtctccgctcccccgggcccggatggctcggccattccggcgcccgatggcgcgtcgcccgccggaaccgcgcccggcggcgagggaggggacggtggccggggcgtcgcgggccttgacggttcggacggctccgacgggatcggcggcgagggaggcctgggcggcgccggcggcgagggccggaccggatcgtccggcaccccggggtctccgggcgatccgggacctgccgggatgcccggaacggatgcgacgccggcgcccccggtctcgccgcagtcgccgtcgggcccggtcctggcctgacttatcgatgcgttgccgggtggcgtccccgtatgggcggggatcgcgcccggcccttttttcttgtttgatcggaggttgctgatggtggatgccgatggcagggacggcggggcgagggtgcccacggcggcgttcagccgcctgtcggccacgaacgtcttgttcgggtggacatggccgcagatcggcgtgggcctggccggcctggtcatggtcgtgggcggcgcggcggcgggcatggtgctgccgttgatgctcgctggcggcgtggtcatggcgtacgggctgatccgttacgaggggttgagcctgatggcgtggacgtacgtgtggctggcgtggcggcggcgtgtgcgcgacgggtcgacccgatggtcggcgagtccgctcgcctcgggccggccggcgggcgtgctgggcgtgtggggccaggtcgagtcccgggcccaggtggtcgaggggtccggcgtggaggtggtcggcaccccgttccatggggcctgctacctgttcgacccggaacgccggcgggcgaccgcggtgctcgcgttgaaggtcgaggagtggacgttgagcacggatgcgtcgaaatcgtcgcgtgcggccgccttgaacgatctgaccgcccgtctggcggacacgccgggagtggtcgagctcaaggagaccgcgctcctgctgccgggagccgcgcccgctccggacctgcccgacgatggcgggtcgccggagtggatgcgccgtgatatggcggaattgtgggccctgccggaggtcatgaccccgttggcgaacgtgagctacgtgtccgtgacctgcgacgtggaccggctcaagggcgtggaccacgcccggggccggctcacggaacgcgaacgggtcggggtcgcgttgggcgacctggtgaagatgaccgtcgccccggccctggtcgaatgcggggcgcgccccggttcggtgcgctggtgcggactggacgacctgcgcacgctgatccggtcggtttcggatccggccggcaacgcgtgtttgtgttcaattagttgttgcgggtttagtcacgatgatttttcgggtttagctaaacccgaaaaaaatacatgactaaacacgaaacaccgacttgacgaaatacaaccgtgggagcccgacgcccgggccccccggtccgccgcgcggacggctccccctcaaagaggggagccagaaacctcttgggccccgacgggatactcctgccggggcccagtacgttttgggcggcaacccgctgaatacccggtaagatggctgaggtatcaacaaacaggtcaggaggtgacgcgcatggtggcgtcaagccgtgatgaccgaagcgtagatgcattggtgaaatccaaggcagtacttgatgtattggcggaactggggccaagcaccgcaaaaaccataagcgaacgtactggtgaacccgtaagctcaacgtatcgtttgctggataatctcgccgcagtcggttgggcggaacgcggcatcaatcgtggcgagtatcggcttggcatcgattgcgtacgtatcggcggccaaatcgaaagcagactggacattcagcagatcgctcgccgtaccttccgcgcccatcgcggccagttcggcatctggggtctgttcgttcggaggcgattgcgcacggtgtgcatcgagacacgcacccgtgaggcattgcaaagctatgcacagctggtgggcaatagcttgcctctgagcatgagcgctccctctcatgtactgacggcctggcttcccccggctcgctacgagcagctgttggaacactatgcctataacaacgagctcggcggcacattctccacgatgcgtgccacagcaatgggacaggctcgtcatatacgcgaatgcggcttcacctatgacgtcggccagaccatggccggctccgtgactatcagcgtaccggtattcaatcacgccggagagattcaagcggcaatcgccctgagtagcctttcccgctccttggaacctgagctggcctgtctggtagatgggaaaccggcaacggcatcggctcaagacatggtgcaattggtgcagactgccggccgcgaggtgtcgcgaggccttggatacagtggtgattatcttggcctgaacagttgaatacgatgagtcagggataagtcagggggggaaggaacgtcggcgatggcggaagacaaacgtgaaccgacccgcgctttagacaaggcgagtcgtgtgatggacgcattggcggcggagaatggcctgtctccggcagatatcgccgacgcctgtgatatcccgcgatcctccgtataccgcgtgctggatggactggtcgatgtggggtgggccgtaacggatacggatggcaactactcattatcactggactggctgcgattggctgatgccgctcgcacgtctcgtaccgaatggcagcctgcgattgcggtcatgcatgccatcaccgcgcaaaccggcatgacctcattcctcagtgtggtctccggcactgaattggtatgcgtggaatgcgcgcaaggtcatgccatcgattcgctgatcctgcgcccgggccgcgtgctgcctctgcatgctggcgcggccggccgcgtggccttggcgtatttcgaggatgccgatgccgaacgctatcttgcaggagcgccgttcccggcatataacgagaacacgctggtcagtgtggaacagttgcgcgaggatattcgcttgactcgcgaacgtggatatgcactgtcggatgaggatgtgacgttgggtgtcggtgccgttggtgtaccgattgtggacaacgagtccggtcgcgtgatcgccagcctgtccgccggtggattcgtggacgaagtgttagccactcaagaatccttggccgcgttactgcacgatggcgtacacgagattcaggcagcctgattcggcccgctaggctgtcgggctggacggttatgcccggtcagctatggcctttgccggctacggttctgctggttatgcttctgcccgactacgctgcggtccgctgcgcttcggccacacgacccagcgcgatggcggtgatcagcacgtacgcctcgcgcgggtcggtggcatcccagccggtggattcggcggcgcgcttcaaacggtagcggatcgtattgggatgtacgttgagctccttggccgtggtctcgagcgaaccgccgaacttcaggaatgtggagacggtgagcagcgtcggatcatccgggcctgctgctgtcaggcttccgtagaccacgcggaccagttcgtcacgggcgtccgcgtcgccgatcaacgcacgttcgggcagggcgtcgtcggtgcgtaacgggcgcggcgatggctgcacggtggcggccagagccggcgcggcctgaagacagtaaagcgtggcctgaatcgaacgcatcgcgccatcggcaccggtacgctgcggacccaaggcgattggccgatcggcggcgaacgacgggtcgatggtattgcagatgatttccggcgtggccgcaccgaccggacgaatcaacgccactacggcggtgctgttgccgatcgggcgcttggcggtcagacacacaccgccgaaatcggctacgattttctcgatttccttggccgtacgtgcggcggaccgggcagggtatccggcgatggcgtaacaatcgaagtcatgctcgaagccgaggatggtgaacagggactccactcgttcgtcggccagatgattgaacaggcactcgaacagcacggtgcgtacgcggttggtcgcggcgatgccgggtgcggacgaatcggcaacgtcggcagcaagaagttcgagaaaatctgacatagtcactagtgtagcgtcgctgattggcgttgcctttcagccaaagactctcgccaatacgtcagcaccacgaatccgaatacaaacgcaaccggcaacatgtgccgctcgaaattattggccggcgcggtgatcatcacgcccatcagcagtagcagcggaatatgggtcatgagggtgagccaacgtcggcgaatcacctcggccgcgccgatcagcaatgtcatcaccacgtagaaattgccgtgcgtaggccagccgagtacgggaataccgccccatacgcgagtgaagccggcgatgtgctcacgccagtcatggttgtaatccttgatccatgtggagtttttctgcacgtaatcgctggtcacgtaataatccatcgatacgtacggctgatcgttcacattgaagtatccgaagcatttggccagcaacgcatccagcgcgatgattggattgtccttgacgatttcgaaccatgccttgttgaaattggtcatatcctcgggcgtcaccgtgcgccacttgtagctgaccttcttggcctgaatgccggaggatttcaccgggtcggcgtcctgctgggagtaagcgtcggccatctgatcgagattgaagacgggcgcgaggttctttttggcttcgtctgaaatgccgtccggattgcgctgggccacgcgggcgatcatttgcagctgtacgccgcggctttcgattgggtcgccgccgatgatcgcgccagaggagatggcgaaggagatgccgccgtgaatcagtacggtggggatgagcagcgccacgacgtaagtcgcccagcgcttgcggtcggcgatcagagccagcacgatttgtagggcgatgatgtaccacgcatatttcgcggaaatcagcattaccgacgtggccaggataaaggcgatgaaactgtgacgcggcaagtggacgggcgtggcgatggcagaggtctgaggatgtttgcgggtgccggcggggtgccaggtctggacgagttcataccagacgctgaaccaccagacgaacgagaacgcgaacagcggcgatttggtgatggagatagtggaaaacacggccagcgggcagaccataaagaacagcagaatcaggaatcgagccaatcctccggcctgtgggggagcggcggaatccgttgccgtttttcctatccaaggccggttcaggaatcgattggcggcggcagcgcagcagaacacggcgaacagcgtctgcagggcagccaacgtcacgataccggcatcgtttgagccggtcagatgcctcgcaaacgtgaccatcgcgccatagaacacagtgagtaccacattgtgctggtcggtcagatacgtgggatcggacggccacatgtagtgcgcagtggggtagatgtccatcggcacgaaggagaagaagccgatatagggctgtttcaggccggtccactggttccaggcccagctgaattcacggatctgtgagcggaggtccgcaccgaatgcggccagcagagtggtcggcacccagagccagccgacaaaaaacaccagcataagcttccagaaccggttcgtgccgcgtgtgatccagcggtccagaacagtgacggtggacgtgacgatagcgcgaacggtacgacgggtcttggctggttggctggcctgctgatcggcggcgggccgtgatgtttcgctattccgctgatgttgacgtagtcgctcgccgatagccctcggcagtatgcgctggcctgctgcgaatcgcaccatcagcgtgatgattccgagatatatcaggaatgacacgacgaatattgcggtattggcccagttccaatgggcgagggtgccgttctcctcgtcccagtacagcgggccgaccgccgtgcacagtgcaagccacaggccggccagcacggccagtgtccagcgcgcggcagcgcccgcgcgcgcaagatgcgggtgggactggcggctggatacggcggcaagcttcgcggtggctggtgacgtcatgacaatatatggtagccgcacaggtcaacggttgatattcgatgtctgccgggcatcgccattgttcgcaagccaatatgacggccgggtgcatgcgtggggtcggcgaatgcggaatttccgaagttgtgaacgttaacatgggctatgtgggtgaaaatagttgattttgcgcgcttttccatggaataacgcgggcatatcgcgccaaaatcgaggtaacgtagtgcccatgatgattgcgttgaaagctgcaacgccgcagctacccagaactacagccgtcgcagatcatgtggtcgccgtggacgaaaccgattcgaccaacgcgctggccgtacagatgattggcgacgggtcgttgacgttgcccgaccaccaggatggcgaactggcggtggccgtggtggccgccgaccggcagaccgccggccgtgggcgcaatggtcacaagtgggtcagtcagcccggccgttgctcgacgatgtcctatgccgtgcgcattccgcgcgcgatcgccaccgacgaatccgtcaatggctggctgcagatgatcgccggactggtcacgctggacgccctgaacggcatgatcgaggaatacggtgccgcgccgaaccagccggactgctcgctggaactcaaatggccgaacgacgtgttctgccacgggctcaagctgggcgggctgctctcggaactggtgattccgccgtcgtccggtaccggtactgatgctgatgccgatgacgacgtcgtcatcgtgttcggcgtcggcctgaacctggccttgggcgcctgtcggctgcccacgccgcaatcgacctcgctgcagctgcatgtctccgggctgccgtcgttcggcgagatgcgcgatgcggtggccgaacgtcaggtcgagggcttccgcgagcggttggtgaagttcatcgccgacccgaagggccaggccgagtcgttgcgcgaggaggtgaaggcggtgtgctgggcgcgcggccgtcaggtcgaggcgcacttcacggacggcaccacgctgaccggcgaagccatcggcctcaacgaagacgcctcactgatcctgagaacacaagacggcacggaccatacggtccgcaccgccgatgtgggagtgctgtaatagccggccagtagctagctagtagctcaggtcagcgaccgagcttggacaggccggcggcggccagagaggccaccacggccttgatggcgtcgccaactacgaagcccatggaggccagggccacggcggcgagcggcgcaccggtcagcgcggactggatgacgaagccgaaggcgtacaccaccacgacgccgccgaccagcgcggccagcaggtagcggcccgcggtgcgcgcggcggccgcgaaggacgaagtgtcggacttgccgcgcagcagggcgatggccaccacacccggcaggaagccgaagaggaagccggcgctcgggccgaccagggccagcgtggaggtgccgccggcaaacaccggcaggccgaccgcaccggccgccagataggtggcgacggcggcaccggcctgacgccacggcagcataagaccggcgagcatcaccacgaacgtttgcagcgtgatcggcaccggcgtgcccggaatcggaatctcgccggcggccgcggacagccacatcagcacggcgaacagcaccggcttccaggatgcggcgacgatacgacgggcgagcgatgtggtggccgcagcggatgcggtggtgtgtgaagtctgcatatcaatgacccctatgttgcgtgatatcgccgtgaacggcgggcggtatgcgatggatgaggggaggttccggcgggtcgtgcggtatccccgacagtccgaaccgtccatatggtggacggtcccaaatgaatccgaccctgtgcgggcgaatcgtgcggcgatggaccgatgccggtccggtcaccttccgttcgcccgcagatgagccttcccccgaacttacggttgccatcgtagaggtgttcgatttcgtgcggtttcgtaccaatttacaaaattgtcgatttcgatttgtcataagttgacgaacacaaccgtaacgtcaatttcttgagtcggcgcgcaaggatgtgcaatcggcggatttgcaacgtttttgatagccggcgccaacggttgcgttgccggaacctacgcgcgcgtttgttcgtagcctacaaaagggcgtgaaagcttttgtgtgaacgcggcttgccctctcctctatatagagagcacaatttgacactatggcttctatcgtcaaaaaactgctgattgcgaaccgaggcgagattgcgcttcgcgtggtgcgcacggccaaggagatgggtatctccaccgtggccgtctactccgaacaggaccgcaatagccgctatgtggacatggccgacgaggcatacctgctctccggcgacacctacaaggacacgtacctcaacgaagatctgctgattgacatcctgcacaagaccggtgcgaatgccgtgcaccccggctacggattcctttccgaagtgccgagcttcgcgcagaaggtcgaggatgccggtgccatctgggtgggcccgcaccacaccgcgctggtggatttgggcgacaagattaccgcccgccgcgtggccctacgcgccaaagtgccgccagtgcccggcctgtccgaaccggtgaccgacgtgcgcacgctgctcgacttcgcacacacccacggctacccgatcatgatgaagcgcactgatggcggtggcggccacggcatcaccgtggtgcatgacgacgaggagctgcgccgcttctacatgaaccacgacgcgctgcaaggcggcgatctgaaggaatacttcatcgagaagttcgtggacaaggcacgccacgtcgagacccagtccgggcgcgactcgcacggcaacttcaccgtgtactccacccgtgactgctcgctgcagcgccgcaaccagaaactcgtggaagaggcacccgcgcccttcctgtccgaggaaatcatcagcacgctcgaggaatactcccgccgcctgttcaccacggtcggctacgtgggcctgggcacctgcgaattcatggtgaccccgaacggcaaggtgtacttcctggaagtcaacccgcgcttgcaggtggagcacaccgtctccgaagaggtcagcggcctcgacctggtgcgcgaacagctcaatatcgccgccggtggcgagctcacccgcgcccccgaactgcgcggccacagcttcgaactgcgcatcaccagcgaagacccggccaccaacctgacccccggctccggcaccttggagaagatccagtggccggccggccccggcgtgcgcatcgataccggtgtggaacagggcgacaccatctccccgaagttcgattcgatgatgggcaaggtcatcgtcaccgcccagaaccgtctcgacgccgtggcccgtgtgcgccgcgtgctcgatgagcttgtgatcgaaggcgtgcccacgccgattccgctgttcaaggaaatcttccgcaacgacgacttcaccgccgagcatggccacccgttcgctgtgtccaccaagtggctggagcgcacgtacctgaaccgcacaccggcttccgccgcctccggccagccggcctccttggccgccgccccgggtgccgctgccccggccgcgcccgacaagtccaagtcggagacgttcgtcatcgagatgaacaaccgccgcgtcaagctcaccgtgccactcgacatcgtggagaacatcaccggctcggcccgcgcccgcggtgccaagcgacccacccagccgttgcgcggtgcgggactgcacaacgtggcctccagtgccgctgcggccaacgacggcgccaaatccggcgtcatcgcctccccgatgcaggccgtggtcacgcgcatcaacgtgtccgaaggccagcaagtggccaagggcgaccttctggtggtgctcgaatccatgaagatggagaactacgtgtacgcgccggccgccggcgaagtgaagaagattttcgttggcccggccgacggcgtggaggccggcgacacgctggtcacgctggacgtgaacgccggcaaggccaaggctgctgcggctgcgccgggatctctccctcaggcggctgcgtcgacagctccctcgtcagaaggagccgataaggccaccgacgccaagaaggagggtggcaatgactgacatcatggattcgcaggccgtgaaggccgcggcggcggcctcggccgccaacgccgcccagccttcggcccaccagccgctgcgcaccgctgtggtcaaggccgccgaactggcccgcgccgccgaagagcgcgcccgcgacaagcagcacgccaaaggcaagaaaaccgcgcgcgaacgcctcgacctgctcttcgacaccggcacgttcgaggagatcggccgcttccagggcggcaatatcgccggcggcaacgccggtgcggccgtcatcaccggcttcggccaggtctacggccgcaaagtggccgtctacgcccaggacttctccgtcaagggcggcaccctcggcaccgccgaaggcgagaagatctgccgactgatggacatggccatcgacctcaaagtgccgatcgtggccatcgtggactccggcggcgcccgcatccaggagggcgtggccgccctgacccagtacggtcgcatcttccgcaagacttgcgaggccagcggcttcgtgccccaactgagcctgattctcggcccctgcgccggcggtgccgtctactgcccggccctgacggacctcatcatcatgacccgtgagaactcgaacatgttcgtcaccggaccggacgtggtcaaggcctcgaccggcgagaccatctccatggccgacctcggcggcggcgaagtgcacaaccgggtgtccggcgtggcccactacctcggcgaggacgaatccgacgccatcgactatgcgcgcaccgtgctcgcctacctgccgtccaacagcgaaagcaagccgccggtctacgcatacgccgtcacccgcgccgaacgcgagaccgccaagcgacttgccaccatcgtgcccaccaacgaacgtcagccttacgacatgctcgaagtgattcgttgcatcgtcgattacggcgaattcgtgcaggtgcaggaactgttcggcgcctccgcgctcgtcggcttcgcctgcatcgacggcaagccggttggcatcgtggcgaaccagccgaacgtgctcgccggcatcctggacgtcgactcgtccgagaaagtcgcccgattcgtacgcctgtgcgacgcgttcaacctgcccgtggtcaccctcgtggatgtgcccggctacaagcccggctccgaccaggaacacgccggcatcatccgccgcggcgccaaggtgatctacgcctacgccaacgcacaggtaccgatggtgaccgtggtgttgcgcaaggcgttcggcggcgcgtacatcgtgatgggatccaaggccatcggcgcggacctgaacttcgcgtggccctcctcccagatcgcggtgctcggcgcggccggcgcggtgaacatcatccaccgccacgacctggccaaggccaaggcctccggacaggacgtcgatgcgctgcgggccaagtacatcaaggagtacgagaccagcaccgtcaatgcgaacctgtcactggaaatcgggcagatcgacggcatgatcgaccccgaacagacccgtgaggtgattgtcgaatcgctggccacgctcgccaccaagcggcgcgtcaagcgcaccaccaaacaccacggcaaccagcccctctgatttttgaagacgtcaaccaaacacaagtaaggaaagcaatgaccaccttcttcctcaatcgcctagccaccgagccccatgcgctcgccttcgccggccagtccaccccgtggccggtagccctggcagaccagaccaccgatcccagccttgacgaggccctgcgcggccacgtcgccgcagccggccgactgctcaccccggtcgccgccgacctgctggccaccaccggccgtccggtcgacctgttcggcttcgccccgaacccggcacgcctcggcgccgcagccgacgccaccgcgtccgtggaaggcgtggcgctgacccagctcggcgccctgctcgacctcgaacacctcggctacagcgtggcccaggccaagccgctcgccgtgctcggccactcccagggcgtgctcgccgtgcacatgacccgcgccatcgaggccgccggctccatcgaggccgccggcaagaccctcaacgagattctggccgtggccgccctgatcggcgccgccggaacccgccgcgtgcgcgaactgggcctgaaccccaagtatggcgaagccagcccgatgctctccgtcaagggcgccacccgcgaacaggttgaggctctggtggcccgcgtcaacaacgctcgcggcccgatctccatcgccgtcaccaactccgacaaccaccacgtgctgtccggctacccggaagacctggccgctttcgccctcgaagccgagcgcgaacaccagcatcaggccaagctgcgcgagcagaagctccacggcggcaccgtgttcaacccgaccctcgaataccttgaggtcaccctgcccttccactcgccgctcatggccgacgccgtcgaacagaccgtggcctgggccggcgcctgcggcttcgaccagaagcgcacccgtgcactcgccgaggaagtgctcctgaaccacgtggactggaacgcccgcgtcaaggcgctgttcgacgacgccgacccgtccaagctgtggatcgtggacctcggccccggcaacacgctcggcaagctgatcggcaacgtggtgcagggcaccggcatcggcgtggtcgaagccaccacgctggccgagcgctccacgctctccatgctggaaagcgagcctgagcgcacccagaactggaaggcgttcgccccgcgcgtcatcaacaccccggccggcgccaagctggtcaccaagttctccaagctcaccggcaagccgccggtgctgctgcccggcatgacccccaccaccgtggaaccggaaatcgtggccgcagcggccaacgccggctactgggccgagctcgccggcggcggccaggtgaccgccgaagtattcgaccgccacatcgctgccctcgaagacgagctggaggaaggccgcacggtcgaattcaacgcgatgttcatggaccgttacctgtggaacctgcagttcggctcctcccgcatcgtgcccaagaagcgcacatccggcgcgccgatcgacggcgtggtcgtctccgccggcatccctgagctggacgaagccgtggagctcatcaagaacctgcaggctgacggcctgccgtacgtgagcttcaagcccggcaccgttgaccagattcgccaggttgtgcgcatcgccaaggccgtggcccccaccaccatcatggttcaggtcgagggcggtgaagccggcggccaccacagctgggaagcgctggatgacctgcttgccgccacctacgccgaagtgcgcgcctgcgacaacctcgtgctggtcgccggcggcggcatcggcacccccgaacgcgcggccgactacatttccggccagtgggcccacgcctacggcctgcccgacatgccggtcgacggtgtgcttatcggtaccgccgcgatgaccgccaaggaggctcacaccagccccgaagtcaagcagctgctcgtcaagacgcccggcattccggccgacgccaagtccgacgacgtgttcgccccgcaggccgcccactgggtgccgtccggcaagtccgtcggcggcatgtcctccggcctgagccacctgcacgccgacatttacgagctcgagaacgactccgccgaatgcggccgtctgctcgtgcgcgtcatgaagcaccccgaagagctcgactcccgccgcaaggaaatcatcgaagccctgaacaagaccgccaagccttacttcggagacctggcctccatgacctaccttgagtgggcgcggcgcttcgccgaactcgccttcccgtgggccgacccgacttacgccgaccgcttccagcacctgctgcagcgcatcgaagcccgtgtgaacgacacggactccggcgaattcacctccaagctgttcgccgctgatggcgtttctgctgaagaggcagctgccgctgacctgctgacccacgacgacattctcgccgatccggcccccgcactcgaaaagctcgcactggcctacccgcagaccgccgaacttaaggtggttccggccgacgtggcttggttcccggtgctcgtgcgcgaataccccaagcccatgccgttcgtgcccgtcatcgacaacgacctgctgcgttggtggggtcaggaccagctctggcagtccgaagaccagcgctactccgccgattccgtgcgtgccatccccggcccgatctccgtggccggcatcaccaccatcgacgagccgatcgccgacatcctcggccgcttcgaaaccgccgccatcaagcgcgtgcaggacgaacagcaggccgccgatgccgctgagaacgacgatttcgccgcactcggcgaggccaccagcgccgaggacttcatccgcaagtccccgaacatctcctgggtcggccacatcaccgacaaccccgcctacggcaccgccctgggcgaccagtactacgagatccgcgcgtttgacgccgcggccggcaagtacgatctggacatccacctcgacacctactgggacaacgacccggacggcggcacctccaagcacgccgtgcgcgatatcgtcatcccgctcatcgtggaaggcgccgagcccggccgtgtgccggtcgtggaccgcgaacgcctgattccggacgtctacgcgatgctcgccgccaccgcaggcatcggcaacaccgccatcaccggcgacaagctcaccgagatgccgcagcttgacggcaagacctctgacgagcgtccgtttgctaccgccaccgccgcctacaccctctccgccaacctcggcttcgaccacgaagcggccaccggcgccgctctgccgacgaccctgcagcccagccgcatcgctcccgatgcgctggtcggcccggcctggccggcgatttacacggcgctcggctccgtgtacgtcaagggctacccggtgattgaaggcctgctcaacgccgttcacctcgaccacctcatcgaacttgaggtgaacgaggaggacctgcttaagcacaccggtgaaaccatcaccctgaagtcttgggctgaggattacttcgagtccgcctccggccgcgtggtcaccatccacgtgacccacaccgctgccgacggcacgctgcttgcccgcgaaaccgagcgtttcgcgattcgcggccgcgtctactccgatgctttgccggcagacgcccccgagttcggcgacgccgagcacgaggagatcgcgcccacgccgcgccgtctgctgcgccgcgtgaaggtcgtcgccccacacgacatgaccgccttcgcccgcacttccggcgacttcaacccgatccacacctccactcgtggcgctcgcatctccggtttggccgctccgcttgtgcacggcatgtggctgtccgccaccgcccagcacgccgtgcaggcgctggacgagaagggtgcccactacgagattgccggctggacctacaacatgtacggcatggttcagcttgacgacaccgtcgaaatctccgtcgagcgcgtcggcaaggtgcgccacggcggcatgaccctcgaagtcacctgccgtatcgacggccagctcgtctcccgcggcaccgcactggtccgcgcgccgcgcgccgccttcgtctaccccggccagggcatccagaagcagggcatggttctggacgagcgtgccaagtccgccgccgcccgcgacgtgtggaagcgcgccgacaagctcacccgctccaagctcggcttctcgatcctgggcctcgtgcgcgataacccgaaggagctcaccgccaacggcgtgacctatcgccaccccgaaggcctgctcaacctgacgcagttcacgcaggtggcgctcgccaccgtggccttcgcccagaccgctcgtctgcgcgaagccggcgccgacatctggcccgcctacttcgccggccactcgctcggcgaatacaacgcgctgtccgcgttcgccgacgtgattccgctggaaaccgtgctggagctcgtgttccaccgtggttccaccatgcaccacctcatcgagcgtgacgcacagggtcgctccaactaccgcatgggtgcccttcgtccgaaccagttcggtgtggacgacgcgcacgtcaaggaatacgtggaatccgtggccaaggcgtccggcgaattcctggagatcgtgaactacaacctcgccggccagcagtacgccatcgccggtacgatcgccggactcaaggctctgaaggccgattccgcccgccgcgtggccgcattcggtggcaagcccgcgttcatgctggtgcccggcatcgatgtgccgttccactccacactgctgcgcaagggcgtgccggaattccgcgacaagctcgacgcgctgcttcccgcttacatcgactaccgtggccgtctggtggaccgctacatcccgaacctggtggccaccccgttcgagatgaccaaggaattcgccgccaagatcctcgaagtcgtgccgtccgagcgtatcaaggccgcgctcgacgacccggccgtgtgggattcctacgccgatgacgaccagaagctcggccgtctgctcttgaccgaactgctctcctggcagttcgcctccccggtgcgttggattgaaacccaggcgctgctcttcggtcagcgcgaacagggcggcctcggcgtggaagaatacgtcgaagtcggcctcggcaacgccccgaccctggccaacctcggtgccaagaccctgcatctgcccgagttcgccggcaacgatacggtcgtctacaacgtcggccgcgatgaaggccgcgtctacatgaccgacaccgattcgctggttcccgacgatgagccggaagaggctgcggcctcggccccggtcgaaaccgctcctgccggtggttccgccgttgccgagctcggttccggtgccgctccggcaaatgccgtgactgaggctgctcagacaacggatggctccgtcgccggacagtccactggactgtccgactcctcgcgcggcctgcaatcagggcaggccgcggccggcgcgccgtccggtgccgccgtcgccgacctgcccttcaaggcttccgatgccatcggcgtgctcatggcctactccgccaaggtgcgcatcgaccagatcggcagcaacgacaccaccgacaccctgactaacggtgtctcttctcgccgcaaccagctgctcatggacatcagttccgagctgggagtcgccagcgtggacggtgctgctgaagcgacgctcgacaagctcgcccaaatcgtcaacaaggccgccccgaactacaagccgttcggtgccgtgctatccgaggcgctgcgcgaccgcctgcgctcgctgttcggtgccgccggcgtcaagcagcagtacatccgcgaccgcgtgaccaacgtatggcagctcggtgaaggttgggtggccagcgtgctcgccacactgctgctcgacactcgcgagggtgccagctcccgtggcggcgacctggccaagctgcccaccgccgccgtgcagaacaagccggaagccgacaagctgattgatgcggccgttgaggtcgtcgcccagctcaagggtgttgccgtggccctgccgtccgccggtggtgccgctggtggcgctgtggtcgattccgccgcgctcgacgccttcgccgagaaggtcaccggttccaacggcgtgctcgccgccaccgcccgcttcgtgctgaacgagctcggcgtggccgctccggctccggaagaatccgaggacgagaacgccgccgtcgtggccgcggttgaagccgaacttggctccgactggcccaagcaggtcgctccgcgcttcgacgccaacaaggccatcctcttcgatgatcggtgggcctccgcccgtgaagacctcgcccgcgcctactacgacaacgatcccgccgccttgaacggcagcttcatcggccttggcaagaccatcgccgccgaagcccagtggttcgccaacgagtcggagagcgaagaactcaaggccgccttccagaaggccggctccgaggccctcgaacaggttgcgtccaacaagaacgcctcccgttacgcgaatgatatcgccatcgtcaccggcgtgagcccgaactcgattgccgctcaggtggtcgaaggcctgctcgcaggcggtgccactgtggtggccacctcgcacagcttcaagccgtccattaaggcttgggctaagcaggcctaccgcgagcacgctaccggcaacgccaagctgtggctggttccggccaacctctccagctaccgcgacgtcgacgcactggtcgactgggtgggccacgagcagaagaagacctccggtgttaccaccacgattctgaagcccgcgtgggagccgactctgttcttcccgttcgccgctccgccggtccatggcacgctcgccgactccggcgacctgttcgaatcgcaggcccgactgatgctgtggggcgtggaacgcgccatcgccggcttcagccacatcggtgccgacaccaacgtgcagcacaagctccacgtggtgctgcccggttccccgaaccgcggcgtattcggcggcgacggtgcctacggcgaagtcaagagcgcctttgacgccatcgtcaaccgtgcccgcgctgaaaaggtgtggtcgagccgcgtcaccttcgctcacccgaagatcggctgggtgcgtggcaccggcctgatggtcggtaacgacccgctggtcgccgtcgttgagcgtcacggcatccgcacctactccaccgcacagattgcggccaagctgctcgacctgtgcactgccgaatcgcgcgagcaggccctcaaggccccgctcgatgtggacctgaccggtggcctcggctccgagcccatcgacatcaaggccctgcgtgcggaggccatggccgacgccgagaaggaagctgctgcggcctcgtctcaggaaacggatggctccgtcgccggaaagtccactggactgtccgactcctcgcgtgggcagcaaatcaaggcgctgcccacaccgatcgtcaccaagcaggctccggtcgacttgaacgattggaccaacgtcactgccaagccggaagacgaaatcgtcatcgtttccgtcggtgagctgggcccgtggggctccggtcgtacgcgcgcccaggccgagctcggcatccactcggacggcaccgtcgacctcagcgccggcgcagtgctcgaactcgcgtggaacatgggcctgctgacttgggccgacagcccgaagcccggctggtacgacaccgacggcaacctcgtgcccgaagaggacatcgccgagcgctaccacgacgaggtcgtggcccgctccggcatccgcccgttcgaggaaggcatgggcaacgactacaaggacggtgctgacgaagaggaagccgaggtcttcctcgaccacgacgtcaccttctctgtgcccacccgcgaagtcgccgccgaatacgtcaagttggacgaggctcacaccaccatcgccccggatgaggaatccggcgaatggaacgtgacccgccacgccggctcgatgatccgcgtgccgcgccgcgccaccatgacccgcacagtcggcggccagttcccgaagggcttcgacccgacccgatggggcattcccgcctcgatggtcggcgacgtcgacaagatcgccctgtggaacatcgtcaccactgtggacgcctacctgggcgccggcttcaccccggccgaaatcctcgagtccatccacccctcgctggtggcttcgacccagggcaccggcttcggtggcatgatgtcgatgcgcaagctgtacctcgaccgcttcctcaaccacgagatcccgaccgacatcctgcaggaagccctgccgaacgtggtcgcggctcacgtgatgcagtcctacatcggcggctacggcaacatgattcagccggtctccgcctgcgccaccgcggccgtctcccttgaagagggcgtcgacaagatcgcccttggcaaggccgacttcgtggtcaccggtgcgatcgacgacatcggcgtggaatccgtgatcggtttcggcaacatgaacgccaccgccaactcggaggaaatgtatggcaagggtatcgacgcgcgcttcttcagccgcgcgaacgatcgtcgccgtggcggcttcctggaatcccagggcggcggcacgatcctcgtgacccgcggtgacatcgccgaaaagctcggcctgccggttgcggccgtggtcggcttcatccactcctacgcggatggtgctcacacctcgatcccggctccgggcctcggtgccctggctgccggcctcggtggcaaggactccaagctcgtgcacgacctggctaagctcggcgtctcagccgacgacatcgccgtggtctccaagcacgacacgtccaccaacgccaacgacccgaacgaatccgagctgcacaacacgctggcccacgccatcggccgcaccgacggcaacccgctgttcgtgatctcgcagaagacgcttaccggccacgccaagggtggtgcctgcatcttccaggtcaacggtctgacgcagctgttcaagtccggcgtgattccggcgaacgcggcgctcgactgcgtggatccgaagctccagcgcgacgaccacatggtctgggttaggaagcccctgcgcatcggcggtggtgaggacgagttcggtcgcgagaccgctggtcgcccggtcaaggccggtctggccacctcgctcggcttcggacatgtttccggcttcgtggctctggtccatccgggtgccttcgaggcggccgtggccaaggccgatggtgaggccgcactggaagcttggcgtgagcgtgccaacgcccgcctggccgccggccagcgtcaccttgaggaaggcatgatgggtcgcgccgcgctctacgagccgatcgacaaccgtcgcttccgcgaggatcaccgtggctacgaccaccacgaggtcgaaaaggcgatgctcctcaacccggacgcccgcctcggtgccgacggctactacgaggcctgattcctctggctcccctcggttgatgggagccagtagcgcaccggatctcggctccctctctttgaggggagctcccgcgaagcgggtgaggggagtttcccctggagctttctcgctggcacaaactcagtgagagaaatatgcagaacatacgaaagcccctccctcggagtgggctttctgcgtttcaaggggctgatttggcattcgccggaggtctacttccgtttcaaggggctgttacccaagtagacaaggcgtaaaaacggcggaatggcgttggcgttatgctgcggatactcgtggtatggaggatgaccagccccttgaaacggaagtagacctccggaacggtcaaaatccgcccctcgaaacggagatagaccttcggggcggggcgcggatgtttttttggacggctaggcagccagcccaagatgtttgcggtattgcgcgaggtcatccagcatagtgaatcttttccccctgaaatggaaatcaggccccaattctgatgaggtgtagagattacgcgcgaagcggtacacaataggaagcatgaatacttgtggtttggggcatgacgtggtggatgtggccgcattcgccgaacagttggcggagccggggtctcgcatgcgtgcgctgttctccgtgcgtgaggtgcggcaggcatccgaccgcgcgcgccagaagaatgacggggaggccgtccatctggccgccaaatgggcgggcaaggaggcgttcctcaaagcctggtgcgattatcttggcgatgccccctatccgttcacgcttgataatttcccgtggcctgaaatcgagatcttggacgattcccgtggtgtgccgcatgtgtctctgggtaagggggcggcgtcagtcttccaaactgattacgcgaattcggctgccggcgctcgctattcctctgcttattcctctgcttccgataacgggccttatgcagtgatgcaggagcggcggaatgcgcgttcggcgcagcgctcgactatcggtgcggggtcgatgccgcatatccatatttccctgagccacgatggttcgattgcctccgcggtggtgacgatttctgtggaatagcgcccgaggcccccgagtgctacatgctgtacaacgtctccatcatggttaacctgtggggcgcgctcaccagccgcgacgtgcgcctgctcaagaaccagatcgacaagctcgactcgctgcccgaaaactgctggttcgtgattctgaatgcgatgggcgccgacctccaaccatacgagtcccagctcatccatttgtgatttcgacggtttccagctcccctctttgaggggagctgtcgccgtaggcgactgaggggagtcctcggcaaagccgcaatccatcaactagattggctggtcctgctgcagccacacgcgtttgccatccccgaagaaatatgtataataactcaagtcgccaaaagcgacgcttaacgcggatgtagctcaatggtagagcctcagtcttccaaactgattacgcgggttcgattcccgtcatccgctccactgacaaaagccgcaaacccaagcaattccaagggtttgcggcctttcgcatattcgggtgtcgaatcatcgtgattgcaagatttgggccaaacgtgcctgattgtgacctcgatagcatgacctatagcatgacctccagctgatacatagcatgaccaaggaagaggcatgatgcccgcacagaaccaaacaacgacgtccaaaacacctccacgcaggccgcggggaagcggcagcgaatggcaggatcaacgaggaacctggcacgcgcgcaaagaaatcgcaccaaacccgcgcaccggcaaacgccgcatggtcgaggcgcaggcccccaccaagaccgccgcgcggcaacggctccaagaaaaaatcaaaagactgcagcgcgagggcgatatgcccctggccggaaccccaacgctcgacgaatggatggagcgatggctcaataccatcgcgcccaacgtcaaaccccgcaccctcgaaacctatcgatccgactgcaacaccatccgcagcgtcatcggcggaatgcgactcgacagaataacccccgccaccatcgacggaatgtgcgccaaactcgccaaggaacaccgaagcaaaaccgtccacaaccactatctcagactcaggcaggtgctcgacgcagcggtccgcgaacgcctcatcccatcgaacccggcgctcgccgcaacgccgccgcgctacgagtcgcaggccacccaaatcctcgaacccggacagccggcccaggcggcgcaggccgcactcgaccccaagcgtcgcaaatacagccacctggcagataccgacgacgaccgcgaaatgtggagcctcatgtggaacatcatgttcgagaccggcatgagagaggccgaaagattcgccatcctgcccgaagagctcgccaccgtcgacggtgtgcacggaatccagatcatgtgggagctccaacgcttcagatccgatgcagaagtgcccaactggctccgctcccgccattacgagggatgcttctggctcgtcgaaccgaaaagcaagcagggcaaccggttcgtgcccgtcagcaaccagacgtggctcggactctgggcgctcgtcggacgcaggcaatgccagcccggccagctcatattcacgcgcgagggacacccgctcaccaacaccgtggaacgccgccgctggaaacgctctctcgaagacgccggattgccctacgtcaccatccgaagcgcccgccacttcttctccacgcacctcgccgaagccggagccccggaagacgcgagaaaagcgatgatgggccacgcaaaaatcagcacgacggccggatacacccactggtccgccgcaagccttgcggcgctcgccgacaaggctcgtcaggcggtgggggaatcggcctgattgcgattcttgcgcggccttccgccgcccgcaccacgaccggggcgggcggcgttccacgcatcgattgtctccggaagccagccgcgagtcgtgccgatcagtgcgtccggttccggcagatgataccccctcgcggccggattgctcgtgccgatgcgctcgccgacctccttgaggctgagatatcttgcggtgctcatttccggcctcccgacagatagccgaacaccccggcggccatgccgaaggttccggccgcgatggcctgaccgccgatggcgagaatgaggcacatcgcgccacatatcagcgagacgagcctgtatgcgtttgttgtgttcatgatgttccatggattagtctggggatagggagccgcagctccggatactaggactattcggaatctgcggctcttgtactaccggcgaggccttcgccgtatgtgcggcggcttgggctttggtgcgggtggtggctcgttgcctttggatttcaccgccgcgatgactgcggcgattccgacaagcagggagccgatggcttctatcgctttccagacctcatccatgtctcacctccttccactgttctgttttcgttgacataataattatagctcaattaagtaagttatgcaagctgaaacgacggaaaatgatgtgctgcaatgaattggccaaggagatgccgggcgtgatgtgcctttggagcatgtctgcttgagagcggaattatgcacatttgtccacattttctaggaaaatagcaggagtgtctaggtggattacggtggtttcagtggctgccgcgcgtgcatgatgggaggtgacccgtatattggccgcaacggataatatgactgaagccactccctctgtgcgcccgatcatcgagaacaccggagccaccgccaccgctgccgcggagacgctgatgaagaccatcgccatggacggcaaccggatcaacatacccatcgacgtgcgccaagtggcggaacgcttggggttggaagtgcagtacctgttacttgatagcggcacggacggcatgatcgtcaaagaagcgggccgcccatgcaaagtcgtggtcgacgcgctcgcccatacacaccgccgacgcttcacccttgcccatgaaatcggccattatgtgcagaaataccaaaaatacgcattgggcgacgagggcggtgagatcgactaccgagacgagcgttcatcgaagggaacggaacccgacgagcgttgggcgaacggattcgccgcggcgctcctcatgccggcctccgcggtccggcaattctgggcacagggcatgaccccggaacaactggccgaagcgttcaacgtctcgcagcgatccatggacctgcgcatcgcgaaactcggactccgctaaggaacccagcccgtgacaaacaagcaaaacgctgacgcctcggaatcattccgccagctgatggccgcctacagcaaggcgttctcctccactcccgattccgtcaaggaagaagagaacgccgacgacaccgcgacaaccaccgaaaacgggacaattccgagtcctcgaaccgcctccatattggacgccgacgacgaaaccaccgaaacggccctcgaattcaacctcgaacgagcaaaactcctgaatcgacaaaaagaacaggagctcgaggaacaagcccagaaaatcaaaagacttaaggcgcggaacgcaagacgatggctatccatcatcctgcgaggaatactcgcggtgactgcaatcgtattcgtcggcatccagctctggaactgcaacgccatcgtctccgaatacgtcgcatacatgatccacaccgacaaagaatccccggtcgtcatcatctcctggatggcaacaagcctcggagaagtcgtcggcatcctatgggtcatcgcacgcaacctcttccccttccacgacaaacaccgtgaccgtgaagccgaaaaacaaaacccaaaacaaacccaactggaaaaagacaccatgacatacatcgccaaagcattggcggacaaagataactgaaaaccgccccggcgctcgcagagagaggccggggcgattccgtatatgcggcggtagaatctaatcaagccgcatcgagttggctgaacgaacaacgaggttggaggcatgatgccgacagggaatagaagacttgcatcgcagatgatgaaccctatggagataagccttgccgatgaggtaaggaagacgctgcaggcggaatgctatggcgccgccctagctcttgcgctcacaattccggatgcctacgggcagattgcctttccggaagagaaaaaagtcgggaaaagatacatggactggtaccggcaatactgtggatatgcccttagctcaagaatgggtaaggacccgatgccggcctttgatgcccttgcatgttacaagctgcgctgcgaactgcttcacaacggcgatgccaatatggagaccaaatacctgtacgagttggatgaccaagggaagctgatgcggaatgacgtcaatcttgaacacgtctcgttctcattgcgcattggactgagttcgaaactcggcaagacgtgggaacatgacgacgaggaaaacgcggagtacagcctcgtcgtatccgtcgaggaactgtgtcttgcgctatgtgatgccgccgaccgattcgaccggaatacagaaacgcaatgccgacctgaactgcgaccgcggatagtcatagatgatttaaggaacgtgacagcgtatcgatggcggtcgaaacccctgtcggcagatgaagtggcggaatgatgccaaaagacggcggtagaatctaaacatagccgcatcgagtcggccgaacgaacaaagaggttggaggcatgatgcccggaaaacgtcaggccaagcgaaaggcgtcgatgcccagaaccatcggtatggtcatattccggattctggcaatcggagtatggatattcgccctgctgattttcgttggcggattgagcaccgatttcctgacatgcaccataatcgcgctaatcatcgcattcgtcggatggatgctgtgggtcgtcggcgacatgatccacgaccccgagaagattcgagccgaacaacgcgccgccagggccgcaaaagaccccagcatcgtgctggacgaggataacgaacacgagcgaaaacgagcagccaatggtcactgggacggacgcgcaaaccacggacatgcacagcccaatgatgaaacatcgcctgcgctcgccggcgtcgaggtagaggatggtgaagcgttagtgtcggctcgtcgagaaacgggacaaagttctgcgttgtcaaggacgatatcgccgtcgccgatcatcatcccgccaaaaactctgtcagtgtcggtgactcgggaaaccgaaaccgtctccggttcataccctgccacaatctacgtctacgacccacgccccatactcaagctcaaagaggggcgtgccgaaaaaatcagcgttgttacccgtccgataacgctgaaaagtcgacttaacggaagacaatggcgcagcggcgtggatgatgggtatgcggtcgaatacaaagggaaaccgttcggcgttctcttcaaccacatcgcggtaatccacattcgtgcaatccttgaatctggcgcgaaaaatgtggaactcgtggccatgcgccaaggatggtaccaaacaggcgttcccgaaatctacgtcatggtgccaacgctggaagaggcgaaggaaagcgaaactggtaacgcctcgctcaaggaatacgaacagcgacaagcatatggagcggatgtggtcgccgcaacggcaatattccgcgtctcggagaacaactggaatggtcctagaattcccgacgaagggttcatcgctttcgaggccactgtcgaacagctaccggtgccggaaggatcgcaggcaaaaccgcactttgcactcaaaagcggaggtgtcttgctctcggaaatcacggcgcggtcgacggccgcatactttgcatctgagccacttgttggcaagcgattgaaaatactcgttagccgctactacaccagcctcaccatagaggcctacgagatatgacaaaataccccggcgctcataacgagcgaccggggcgttttgtttattcggcgactgtggactactaattattgtgtatggaatcttcggccttgatccggtcggcccatgcgtcgatgtcgatgttctcatggtcactcgaagtttctcggttatcggtagcttggtaatcttcgatgacccctgcgtcttttgtaaggtgctcggcgtcggcgatgatggaagagagcggcatgcgcaatgcttccgcaatcttcctgagttgttcatagtcggcgactgtattgagctcaaggatgcgtcggagggtgccataaggcactcccgattcgatagccagtgatcgtgtcttgaaatcacgtacggccatagctctcttgattgcgattgaaagcgcctttgattcaatcgtcgcggtcttctttcctgttggcatgtgagacattttacttacatatgaagcattcttgttttatatgagacacgccgtgttttgaagagcgcaatcttggttttatcatgtctcatatgaaacaatatttgcttgaaaacaggcatttagggattgcaataaagcaggtcctcaatgagtcaggaatgacacaagttatgctcgctgatcgggcagaaattcctcggaacacgttaaaccgcaaaatcaatgtcggtgtttttaactttgacgagctgcgccgcattgcgggcgtgacgcatcgtcctctgtcctcaatcattgccatggctgagaagctcgacaccgccgaaaacaccattccagcgctcgccgaaagcgagatggcgtgatgtcattcagattcactgtcagcctctttgaagctgatcgggacgccgggagtccagatgcagcagacatcacggccatcctcaggaagagtgaacgcgagcccgtggtgctttccctctctgacgatggacatgagagtgtccgccatcttcttgaacttcgcatcggagaccggcccgagccgatgtccgttgaagtgaacgtaccacgatggcgtatgacgttccccgtccctgaccgtttcactgctcgaacgttcttccaatggctccatttcattcttcccttcgttgggctggttgcttggttggcgctttccaatctagcccggcgaagggataccccagaccacaagaagatgtgatggtcgagaagtacatcgaaacattgccgttcacggcatccgtgttcgtcgtggccttgacaatcgttgccgtattagtggctgtcttccttctgttcatgcgcctcttggatgatcaccccgtcgtgttcgtcatcgtgatggtcgtgatcacgttcctcgtattcaatttcctgctctcattgggaggagtggcatgatgtccagcaaggattcaatggcgttggccgtcggtcaggcgatgcttgatcgtattgctgcgtctgctcccgagctcagtggtgtaggcgacatggacggtgacgtcatacccgccgaccccgatgtagacgaacccggcactggagttgagcctgtcgatggaacgctggtcttcgactaccttctgcgtgaacagctcgtccttgagcgggatctcgccgaacgcgggtactttatcgacgatcctgtccatgatggtctggtcttcgtgacggacgaacacgtgaacgtcagatgcttcgtgggggcagtcgttgagcaggaagacggtcgacgattcgccatcgaattcaccccgccatttgtagaccgtctgatccgcggtaacgctcaacgccctctggctgatcgcattcgcgtctgcgcttatctcgttcgccttgccggcaagacggttggcctcctcggcgacccccttcgcgtcagcggcgatcctgttggcttcctgcgcaatacggttcgccttcttcgcgagcagattcgacttgcccgtctggaacaaggcgaagacgccgcaaccgccgccaagcagaccgacaaatccacccaaaccaccgatacccgaccaaacccactgcaagaaggaaaccagaccacccataggcacgattctacggtgacagcatccaaggaggtggcgtgatgagtggccaacctatcatcttcgacttcaccgtaagcatcgggggcatgaccgcgccgatcgcgcgagtcaccctcgacggtgccggagaacagggcagcagccttctgagccttcaactggccgaagacatacctgacttcgtccgaagcatgagcagcgccgccgccgaccagatcggcaaagcgctcctgatggacgccaaaacggacgcgggattcctgccatccatcacactcgccgactatctgcccaagggggtgaccatcgatgcgaacccgaaagcaaaagcatgacggtgaaaccatcacgctcgccatcatcatgctgctcgccctcgcatggctgctcacccacgacggctgcgcccacccgatcggcaacaccatcgcgctcgccgtctacgtcgccagtggcgtactgctcgcactcccgtgggcgatggaaaaacttgaaccatacctcaccgaaagcgaggaccagcaatgaacgaaaccaagatactcgaacacgtggccctcatgaccagactcaacgagcagggagtgcgtgccgaaaccacgaaacagactcgcaaggcgctcgccgaccaatacggcgtgaggatccccgtcaaccagacaccgctcaacgaacgtgaatcctggacgctgaactcggccgcgaaggtgtggaacatcgactatcacgcactgctcatcgccgcgaacaacggcactctcaccacattccgtccgccaagccgacggggaaccagaagctggcgacgtgtcacccgcaaggcgatggaggaattcatcgcccaattcgaggaataggcatgcgcgacagaatcatccgcgtcacgggcctgatcctcgcgctcaccggtctggttctcctgctggtcggggcccacgagggcaggggagagccgatgctcggcggcatgtactgcttcaccgtcggcgtgctgctgccatccaccacataccaggaagatccagaccaagaagaccaggaagaaccgaagggagactgatttggccaaagacccaagcatctcgatcatcaggggccgattggccgctgacccggaataccggaccacgggcaacgggataccggtcgtgaacctgcgcatcctgtccagcggctgggagaaggacacggccggcaatccggtcgatgtcacgcccaccagctggcagtgcgaggcatggcgcgaactcgccgagcacatcgtggcatcgctcggcaagggagaccagatcatggccacggtacgcccacagaccagcaagtacgagaaacgcgacggcggcaccggctggtccacacgctgggtcatcgaagacatcggaccaagcctgcaacgcgccaccaccgccatcacccgcatccagcgaggccaacacgcgacgccgcagccgccgcagtccggcgaatacggcgaatatacggcaccagccaatgacccatggaccaattaaggagcatcatgaccacgaaatacacgaccgaggaagtcaagcagctctacagcatcgccgtcgaccaagggtgggacgcgctggaattcaacgaaaagatagcggtcggccgatactgccgcaaacacggcatcaaccgtcccggcctcgagccccagacggcgccatcgccactgcccgaacaggccaccgagacgccggcaccacaaccagccgaggaaacgcaaagcacgcaaacccagaccgagaccggcgccgaaccgatcacaggcgaacagtatttcaagcatctcggactgggcccggcggagtccgtggaaacggagatcagcaagctcgaaacaccccaaacaggcgacgccaccgcatccgacaccgatctggaactgctgcgcagcgtccggttcatcgaacgctggcccgacgacatcgtgaccacccctgcgcgaaccgccagcaaatggaagcggatcgcgcaggcattgcgccgattccccgaccgtccggccatcgtcgccgaaggcaaaagccgtcgccgcgccctcgaactgcgccgcagcctgcgcaacgcgaaattcgtcggcttccagcccaagggctcataccgggtggaaatcgcgcccgaccgccgccacaaggactgctacgtcgtcatcgcacaatatcggggagccgaacaatgaacggcaacgacaacaacggccaaccgctcgacatcatcgtgcagggcacgcccatcaccaaaggcagcgtccaaccatggcgaaccaaacacggcaaagcggtcagcgtcgacgcaagactgcaatcctgggaagccgcgatccgcggcacggccgtcagcatgatgaccgccagcggactcaaaccctacgactgcccaatctccatcaccggcgaaatccgagtgccccgaaccgacaagctccacgacctgcccgcatggcagaccgcgaaaacctcaggaggaggcgacctcgacaaactccaacgcgccatcggcgacgcgctccaaaccaccaacagccgataccccggccgaaaccgcgagggagtgatctccaacgacagccgcatcatccactggcagatcagcaaacgctacgccgacgaaacccgccccgaaggcgtctacctgaccatccgacccatcagcacgccggaactgcccgactggcaacccgcaaccccagccgggcgaaccatccacgacaacctgcaacgccgaagccaacgcctcgccgacatgctccgccaacacccccacgaccgaaaggacaccaccaagtgagcaaacacaagcaccgccgccaaaccatcgaacaccaacgacagaaagcccgccgcaagcgccgaccccacaccatcaaccaggaaccacaaaactacgagaaccgcgagaaccaatgagcaccatcatcaacaccacaggacacaccaccggcatcactttgaccgacgccgactggaacaccacccacatcgaaaacggagacagcagaataaccatcctcgcccacaccgacgaatacccccaactcgtcgccgacctcgcactccacctcaccaccatcaccccaaaccccggcatccgacaaaccgcccaagcactcgccgaagccatcaaccaaggagcgtgacccgcacgaaatgacccccaccatcaccctcatcgacaccacccgactcaagccgaaccccaacaacccccgcaagaacatcggagacatcaccgcgctcgccgacagcatccgcgcgcacggcatccagcaggagctcgtggtcaccccgatcgccgattcaaccgattacagggtggtcatcggccacaggaggctcgccgcctcccaacaggccggactcgcacaggtaccatgccggatcatggaactctcgcccaaggacgaacgcgagctcatggtcatcgagaacacgcaacgccacgacctgacacccatcgaggaagccgacgcctaccagggactgctcgacctgggcagcagcatcgagaacatggccgaaaagaccggccgcagcatcgacttcgtgcgccgccgcctcaaaatcgcgggcatcccacgcctcacccgagccctcgccaaggacttcaaccaactgtcactatccgacctggacgtgctcgccgaattccaaggagacgaaaccacccagcaggaactcgcacgccaggccggaaccaacaactgggactggacggtacgcaaagcccgcgaggaacgcaagggaaccgtgtggatgaacaaggcgctcgactacctgcaccgcgccggactcaaaacctgccaagcaccctcgaactggtggaatgacgcgccggaaggctaccaatactcaacctgcatcaccaacatccaaaacaccagcttcgaaaaacaatggcagaagctcatcggcaacaagccgaacatcgacgccatcatcggccttgacgaaaccgcccacaggaccatcgtctacgaacgcatcccccaagaccaaatcgacaacgccaaccgggcgaaacaagccgaaaaacaacgccgagcctacgcgcgcgaacagacgaagaaggcacgggaactgcacgatgccagccaagccctgcgagccgaatggatccataaaacccagaacacatggaagaaacccatgatgcaacaggccctcctgcacctggtagacggcgaaatcctcggcaacgacgaataccggttccccgcaggctccggcgacatcaactggtcagacaagaccatcgccgcatacaaccgcatgaccacgccactgcccatcaccggcaaagaccccgacaacggcatctggcacataaccacaggcaaaaacctcgacgaactacgccgacgagcccgcacagacaacacacgccaactccaactcatcctcatcctgctcgcacgccgcgaagctgacatcaaccccggagcatggaccaacaaaaaccagctggacagcctgcaacgcatcaacgactactaccaagccctcgaactgctcggatacaagcccagcgacgcggaaacacaggcgctcgccggcagtctcatcgaggtcatgaaggaaggagacgaccatgacgacgataacgatgccgagtagacgccagacggcacgccaacgctgcaaatgggcggccgcgtgcggcgaactcgacgccatgggaatgctgatcgaccagctggccaccagcgcgggccggctgcgcgaccaaggcgctcccgaagacgtgctcgaagacctgaccatcacgctcgcccgattgcgtgaaacccgcaaggcggtgtcatcggccagccgacgactgtgggtccgagtggaggacatgccatgagacgccaacgactctcgccgaccatggtcgaaacactgatcgccatgctcaaccgcaacgcctaccccgcatacgaaaacaattcgcgcaccttcgccagcctggaggaacgcggactcatacaacccgacatcgagggcaactggagcctgaccgacaccggccaccagaccgccctcaaactactcaagaggtgacatcatgagctcactgctgtacgggcgggcgaaaagaatcaaggtcggcgaccgctccgccaaactcttcctgttgatcctgtgcgactacgcggacgagaacaaccgcgcatggccaagcatcgaccggctcatggccgaaggcgaagccagcgcaagcaccgtgcaacgagccctgcgctacctcgaagaccacgggctcatcacccgggacgaagactacggcacccgctaccgcgcagaccgaagcccctacgtctaccacatcaccctcgacggccacaaccacgtcgaatacaaaaaccgtaagaacaagcaaaccacgaaaaaacggggtagcaccagtgacaccccgtcagattcacggggtagcacccatgacaccccgcaacccaaccacggggtgtcacccatgaccacacggggtgtcacccatgaccatcacggggtgtcacccatgacgccacggggtgtcacccatgacacccaatctcttaaagaaccatcattagaaccaccaagagagagtacgcgcgcgcaaaaaaaaacaaccatcgaacaaacgttcgactcccgcaaacaggcgctcgccctctaccagccgacaccagacctcaccgcgctcgccgccggctacggactcgaccccgactgggagctcgaaaaattcaaggacacatgccgcgccaacggaaaaatcccctacgacctcgacgccgcatggcgcaactgggtcaaacgcggccgcgaactcaacatcggcaccccgaccgaaaccacgaccacacccaccgaccaagccacggaactcgaacgccgagcccgcaaactcctcgacaccagcacaccactcaaaaaccgccaacccgacgacggcgagcgcctgcgttggctgccacacgtcacccgcctgctcgcccaaggcaccgacgcggcccgcatcgtggaactcctgtgccaggccatcgaccggggcgaactggacgaggccgcatgatgggcagcatgcaagccaccatcgactggcgaaccgccacgccggaagagctcgacggccaccggtgcatcatcaccaccgtggacggcacgatcatcgacggatacctcaaagccatcccgcccttcacccccgaataccagctcacccggttcgtgctccacgaccgagacctctgcctcggacaactgcgcatcctgtccctcaaccccaaacacggcactgcaatcctccaaccacacatccgcagcctgaccgtcacccgacaaaccaaacaaccaaccaacgaaaggaatccgcaatgaacaacgcggacatcaccagcctcatccaccaggcactcgccgccgactgccagatcaccatcaccctcacacccaagaactacatcaccgacgatcaggcggaaacggaggataagcagtgaaccagcgaattacattagccaaacgcattctcgcactggccgccatcatgttttgcatcaccgcgctcgcaggctgcgagggcactcccctcgactcgtcggccgacaagcacactgaagcggtcacgcagagcgaatgctccacctacaacgcccagtgggaaacctgcacgatcaccatgccggacagccgacgcgtgacctgcatcgcacacaacagcaacgccggcatctcctgcgactgggcccacgcggacggagccgacaaaggatggacggaatgagcgtcaagcagtccatcgaaatcgaaaccaaaaaccacaccacgctcatgatgggggtcacgccagcaggacaattcaaagtccgcttcgaccactcgatagaacatgaaatcgattggcatgacgtacaggaactcaacaagttcctcacacaagtcctcgaccgagacataccggaggaaccccaatggcaatcctgaaacacacatacaaagtcgccatcacccgcaccaacatcggatacgacatcgtcatcaacgaattcgccaccgacggcacccaccgcgaatacgaacgacgacaccacgcatgggccctaaccagccacggagccgaccgcgcagcccaacgactcatcagccgcatcaaacgacaaaaccagcgagacgaacacccacgcgaatacaccatcgaataggacactgatgaaccacaagccaaaccgattcaacgacatcctcaccaacatcgtcaccggcgtcaccatcaccgcatggggaacagccgtcatcctcctgctcatcaaactcgccatatgggtattccaataacccgcaagacgacaccaagcatgagacaatggacacgggcctgatgccaaccacacgcaaccaacacaccaccaagaccagaggggcatcatggcatcaaccaccaccgccaaacgattccaccacgacctgcgctcgctggcggacggttacggggtgctgtgcctgatcgccgaacgcaaggccagcgtgatggcccgccactccggccacggcacgaggagcgtggcgccgatcccgttgaatctgggcgcatggcaactcagacaggacatcgaccggctcgtcgaatcactggccacggctatcggcctgcgctaccggcacatggacacggtctcactgctcaagggcatcatgcgctacgagccacgactcctgaaccggcccgacatgcccgccatcgtggaactgacccgacaggccgccatcaggctcgaccgcacactcaaaccgccaccggaaaccaaaatgatcggctggtgcccagcctgcgggttcgaactgcgctgcgacgaactcgaacttaaatccgggtacaaggcatgcgacagatgctccggagaataccgcatcaaagacatccaacgcgccagcatgctcagactcgcagtcggagaatcacgaggaacagcagccgaaatcagccgcctactacaaccatggggcatcgatatcaagagcaacacaatctcacattggggcgctcgcgggcttatccagccggtgggaatggacggcgagcgcccggtgttcctggtgtgggatgtgtggcaagcgcatgtgcgcaaggatgggtgatcggtgaatctgttcacgggatttgacaaatgcgaactgtccacgtatacatgtctatagttggtcatttccatgagatcatggaggtggcctttcgtatatctcctcgaaattcttcagggtcggcgcatgagttccaaccgtacgcataaccgtgctttcgagaaagccaagcaggcgttcttcgaggaaggcaagcgcctggactccgagggaagccccgccgccgattgctggatctgccacaagcgcatcgactacagcgtgccgcccggcaccacggacgcgagccatgagctcgaccattattacccggtgcgcgactatccagacctgcaggacgatcccgcaggcttccgccactcacaccgcaaatgcaaccgcgagcgcggcgccggccagcctcggctcgatctgggcgacgtcatccccgcctggtggtgatgagctacatacgaaaggacttgcgtcatggacaacgaccacagcatctgccaacgattggccatgatgctcgacgaggatccgtcatgcacgatactgatcatcggccgatacatggcaccggtgcgcgccgaatacaacagcgtccggcatctcgtgcgcaaggccaagctccgtccaacgatcgccaacaacggccacctgcgatcggtgaccgcgcagcaaggcaggcttgaagctttcgcgcccatcggtccggcccgtggccgtcgcgccagcgccgtgctgcatgtcggcgagcgcaatgagcacatcgacatggtgcttgactcgttccgcatgtccggagcgatcgtttacacgtcgttgggtgtgtgattgcctcgccggtggggtaggggagtgcggatttgcagaccgatgtcggtaggcccaccctcccgcgcgcacttttcctctctctccgacttggccaccctatcgcgcgcgagggctcggaatcggctttattccgccgtttctgaggggcgtatttttactggtcttttccggttgttttccggtggctcggtttgtttggttggtaattgggttgtttttgccgccagttcggctgattgggggttgattatgagtgcttccaaggatcagcgggctcttgacatgttcatgggcgccgaaccgttgcagaagattcgtgacgagcttggtttcaagaccgtcacgtcggccgaggcggcgatacgccgtgccttggccgagaagcgcaagggcaaggactacgacaccgaacgccagctcgagctggaacgcatcgacgccatgttcaggatcgaataccccttggccaagcagggtgattccgcggccatgagcacgtgcctgtccctgagcgagaaacgcatgcgcctattggacaagcctggcgatcatgagggcatcaccgccagctatgaggcgacgctcaaggcgctggccatcaccgacgcggattccgctttggtagcgaccggacgggcggtggcccggcagatcgactacgcgctgcgccacggtcaggggcaggaggtcaccaaggccctgtatctggtgcctcacctgatgaacgtgctgcgagagctcggcgcgacgcccgcggcgaggaaacagctcaaggagtacgccggcaccgcagcggccgaatcggacggcgagccggtggacgagctcacggcgttccgtcgccgcaagttcggcatctagacctgggaggatcggagcagccatgtcgaagcattacggccgcaccgaaccgaggctgtggacgaagccgctgcgcgagctcaccccggacacatccttgggcttcgaggtcatcgactacgctcgccagatcctgcacatcgaactctacccatggcagcaatggctgctcatccacgcgttggagctgttggaggacgggatcacctaccgataccggagaatcatcgtgctcgtcggccgacagaacggcaagaccttggtggccagcgtgctcgcctcatggtggctccacgtggacagccaacgccaccccgaccgcgtgccgcctctcagattcaaaatcgtcggcaccgcacagaacctcgacatcgcccgagaaccatggaacagcgtcaaactctggtgcgaccccgaacccgaaaccatcgaggaacaggccgccgcgatccccaccctgcaggccgcgaccgccaaagtgagcgacacgaacggcaaggaatacatcaaaagccgtgcgctcgccgtctacgagatccgcgccgcgaagaacgcgcgaggcaagccggcagcccgagtcatcatggacgaattgcgcgaacagaaggactgggccgcatggaacgcgctgagcccgaccatgaagagcttctggaacggccaactctggggcatcagcaacgccggcgacagcaccagcgtggtcctcatccaacagcgtgacgcggccatcgaattcatcgacgcctggcaccgcaccgtcgaatcaggactcatggacgccgccgaatacgcaggccgccacgactgctccctcgccctgttcgaatggagcgccgagcccgactgtccaaaggacgacgtggaggcgatactccaatccaacccgtccatcggctacggatcccagacagtggaaggcgtgctcgccgacatccccggcatgaccgacgccggataccggaccgaagacctctgccaatgggtcaccgcgaaggtcgaaggctacatcgacgtcaacgattggacgaacaccttggccaaaccattcgacatccgaatccccaccggtgcacgcaccgtgtggggaatcgacgtgagcgtggaccgctcgcacagctggatcgccgcagcggtgttcgacgccaacggcaacccggtggtcagcctgcgcgaacgacgcaaaggcctgatgtgggtgcccgaatacatgcagcatctggccgaggaatccggcatgtgggaggtggcaatccaatccaaaggttgcccagccatggaattcatcgaaccactgaagcagctcggcttcaccgtccatgagatcgacggcagccacatcggtctcgcgaccggacgcctgcgagaccgggtgcgcgaacaccggctcatccacgcgccacagccgctcgtggaccaggccatcgaaggcggcgtgaccaaggtcatcgccgaaaacgaggcatgggaccggcgcagatcgatcgtggacatcagcggcgtcgcggcgatcaccgtggccctctacgggctcgaaacctgtgagccgcctgaacccgaacacagcgcatacgaaacctacgacctcctcaccttctgacgaaaggaaccggcatgttcgaacgacacccactgcgccgatgcatcggcaaacgcatcgtcgcccgcatcgacaacgtcacctggcacggcacactcgccgcctactcctgcgaatggctggaactcaaaaacgcgagcgtcgtggacaacatcaccggcgaaaccagcgccgacggcctgatcctcctgcccgaggaacgcatcgacttcatccagattacggaggctgactgatggccggcctgtatttcgcccacaacggcctgctcaacgactgggccgcatccaacggcatcgaagtcgttgacgcgggccagcccctgctctcctacgacgccaccccggacggcgaaggcgtgaaaagccacccattgcgcgaagtcaccgatttcatcgcacgcatgatcagcagcctgcccctcaaggtctacaaacgcgagacggacggcagccgaatccgggtgcgcgaggggccattggccacgctcgtcgccaacccgagcggaaaccccgcaatcccacccagcgcattctggtacgcgctcatccaggacggactgctggacgaccggtacctggccatcatcgaccagacggacaatggcctgcgattgaaacgcatccccgcacgccgatggcgacccaccgtcgatgatttcgacgagcccaccggcgcgaaggtgtggatcgaccccgccaaccccacgaaattcgacatccacacggacggcatcatcatgaacgtgggctacgccttcgccagcggcaaaggagaacccaaacgccgccgactccgggaaatcctcgatgaatacgatgccagcctgaagtaccgcgctgaggtcaaccgtcacggcatccgaagccccatcgtcatcgaacgcgacaagccatggcccgactccaccacccgcgaacgcttccaacgcggcatgaagcaattcaccagcggcggcagcggagccggaggcggaatgctcctggacgacggcatgaaggccaccacgctcaacggcttcaaacccatcgacgtggacgacctcaacgcccgagacaaggtgaagatcgacgtggccaacgcctacggcatcccacccgagatcatcggcatcagggaaggcaacttcagcaacctcagcgccttcaagcaaatgttgtacggcacctacctggacccgtacatcgtgcaattcgaacagacgctgaacctgtgcctgcgcgacagactgcagacctacgacaagggcctctacctcgaattcgaccgcgacgcccaactacgcggcgaccccgaagcccaatacaaggcactcgtcaccgccacaggcagacccatcttcaccaccaacgaagcccgcgaactcctcaacagacgaaaactcaaggaaggaagcgggctcgtcaccccgctcaacgtgctcatcggagggcaaaccagccccaacgacgggcagaccgaaagcaggggagacgcccaactgccagccaacgaacccgagaaaggacaaccatgatgctgaccaagaccatccgcacgccggtcaaggccctgaccaacgaggacggcgaaccaaccggattcaccggatacgccgccgtgttcgacaacatcgacctcggcggcgacaagatcatcaaaggcgcgttctcccaaaccctcgccagccgataccccgaatccggcgcgggaatccccgtctactggaaccacgacaccgacgacccgttcaagaacctcggcctgaccaccagcgccatcgaggacgaacacggcctcaaggtcgaaggcgacatcgacgtcagtacggatatcggcaagcaggtcgccaaactcctcaaggagaaccgcgtcagccagatgagcttcgcgtacaacgtcgaagcaggcgcatgggtggacgggcagaaaaacgacgacggcaccttcacgcccggctactacgagctgcgtcaacttgatctcttcgaggtctccatctgcccgatcggcatgaaccaggcaaccgaagtcagcgccaagaaggcactgctcggcctcgaccccgaccagcagccccacgacgagccttccaccccatctaccccgcgcctggccgacggcatccgccgcctccgcctcctcgacatccaataaccaaccaacctcgaaaggaaccctgatgcaactcaagcaggaaatcgcaaaaatgaaagccgccgcaaaggccatcatcgacaaggccaagaacgaaggccgagacctcaccgccgacgaacagaaggacttcgacgactgctgcaccaaggccgaagccctccagcagattctggacaacgcggaatccaacaccaagcgcctcgacggcatcctcgccggcgacaccacgggcctcggcgaagccgaaaagaacgaggacaatctcgaaggccgtgacctcggccagcgattcgtcagcggcctcgcctacaaggcctggcacaagaccgccgacacgctcggcaccggcggcgccatccgcatcgacaagacccgcatcggcaccatggacgactacttccaggccaaggccggcaacgccatcggcacgcccatcgcccacctgcagcccacgcgcatgccagcggtcgacctggtcaaccgtcccgccatcaccctgctcgacctcatcagccgaggcagcaccaaaggcgacttcgaatacctgcagatcctgagcgtcacccgcaacaccggcatcatccccgaaaacaccggtgacgaggccaccgacacgcagaagccccagtccacgttctccaccgcgctcgccgacgcgaaggtctacggctacgcggacggctacaccgtcaccaaccagctgctcgaagacgactccgccatggccagcttcctgcagaacgaattcgactacagcttccagctcaagctcgccgacatgctcctcaacggcaccggcaccaacggccagcccaagggcctgctcaacaccaccggcgtgcaggcggggaactggaccaaggccgacgacgaggcgcgcaacctcgtggtcgccatccgccaatccctgaccaagctgcgcaaggtcggcgccaccgcatccgcgatcctcgtcaaccccgaagacgccgagaagatcgacctcatgaccgacgtcaacaagcgattcatgggcaacggccccttcggcaccggacccaccaccgtatggggacgcccgctcgtcgaatgcgaccagatcgaagccggcaaggccatcgtcggagacttccgacagatggcgttgctcgaccgcagcggcctgaccgtcgaagcattcaaccagcacaaggactacgccagccgcaacctcacctacgtgcgcgccgaactgcgcgccgcacaggtcatctggcgacccgccaacttcgtcgtactggaggccaagtgatgagcgcccagcagatcgcgatgcaagtcatcaacggcattcgctaccgccccgaagacgcgccacgccacgcaacccccgaacccaccatcggagacccagcggcagtctcgaaccccgagcccgaaaccccgaccatcgaaccggtggccggcgtactcaccgcagacgaggccaaggccaacgccaaagccacgaaggccaccaaaaaggaggcctgaatgacagcggcacaattccgcaccgtccaacagccgctcgacccgaccaccgcagtcggcgaaatcgccctgttcgacgcggacggcaaccccctcgacctctcaggcggaggccagaaaatcaccagcgtcaaagccaccgcgctcgccgccggcacggctcccaccgcgacactcgccaatggggtgttgaccatcggcattccggcaggagccaaaggcgctccaggtacggccggagtcggcgtgaaatccatcagcctgaccaaggacaccgacggcaacatcactggcggcaccgtgaccaagaccgacaactccaccacggccatcaccgtgaccacggcctgattcggaaggagcgtccaccatgccaatcccagacatcgtagtggacaacccgacagtcgatgcccaatggtggatcaaggccgcgcaaggctccatccgtcgctactgcggctggcacgtcacccccgaaatcgatgacacgctcaaagtcgatgcctatggcggcagcatcctcacgctgcccaccaaacacgtcaactccatcacgagcgtcctcgtggacgggcgcgagctctccgatcagattgattggagcgtggccggtacgatccagctgaggtcgggctcgtggccagaccgcccaggtagcgtcaccgtgaagctcaaccacgggtatccgcgcgacgaggtgccggaaatcgccgaactgctgcgcaccctcgccaagagggcgcgcagccagccgggcatctccagccaatcagtcaacggggcatccgtcagctatctcacctacgggggcaccacgctcggcgtgcagctcctgcaaatcgagaaggacatgctcgaaccctaccgactgaactgggggccacgatgaatttcgaagacagcgtgctcggcatggagaccggtctcggcatgagcagcctcactccgatgattcgacaacgtgccaaaccggtcatcggcgacggcaacctcgtctacgacgaggactggtcggatcccgaaatcctccgattcgagggatatctgtacagccggtccagcgtagactccgcagccagcgagccacgtgaccagggcactgtcagtgacaagcagctcatcgtgccgaatcatgccatcgacatcaaggtccatgaccgcatcatcatcaacggcgacacctggcgggtgaccggaatgccggccgccgaccagaacccgttcaccggttggcggccgacactggtcgccgacctcgaacaagtgacaggaggcggctgatggccaagatgggcgacatcgacatgcacttcaaccaggcgtacttcgacacgatcctcaaggagcccggagtcgacgggctctgcgaggaaaaggcgaaacaggctttgcaaatcgcctccgccacggcgcccgtggtcaccggaaactaccgtgacagtctctacgtggaacatgtcgaattcaagcatcgcaacgcctggcaggtggtcagtagcgaagaggactatgcgatggccgtcgaagccaaacaccatacattggccaacgcgatgaggcgggtgaaatgacagccatcgtactgccggccgacctcaaacggtgggccgtgaagcatctgcgcgaacagctcggaaaaatgggtcacgacgtgtcgatcgacaccaagacgccgaaaaccatgtcctacccgcttaccaagccgctcatcacggtcggcgagctcactcccacgaaatacgaccacgtgcaatgggatcaggaactcgccatcaacatccgcgccggaacccgccaaaacgataaagtctgcgacgacctctcacgcctgatcgctggcatcctcacggatccgacgatcagtaaggccgaagacagtcccataaccagcatcgaagcgtgcaacggcccatatccgatagacgattccgccgacgtggcccactcgtatctcaccgtcgaataccactgcgtcggcgaaatacgccaataatcaaccttccaactcagaaaggaaaacatcatgacagcagatgccgaaggcaacgacctcgaaaaggtctttatcccggtaaccggcttcctcgcggtccagctcaccggcgaacccacatgggtggaccccacggaaggctccgccacaccgctcgtgctccccgaaggctacgtcaaggtcggcctgttcaagcaggacggcggcccgcaggacggcggcgacaaggaagacgacctcgaattcttccaggaaggctacaaactcggaggatccaagagccgcaccctgcaggtcacgctcgccgaattcaacgacatcgtccgccagctcaccaccggcaagacccccgacaccaacggcatgatcgtcgtcgacggcgacaacgacgcgacgttccccatgttcgaggtgctgaagggcaagaacggcatgagcctgcgccgcaacggcctcggccgaatccagaccgtcgaacccgaccagagcacacgaggcgaaacaagcggcaacgccgtcaccttcgactggatccgcaacgacgaatggggcggattctaccgcgaatggctcgtggccccgaacaccccaaaaggctgacgtcggtggcggtcacctctgaaactggaggaacgctgccgacgaacctcaaagccggtgccacgctcaaactcggagccaaagccacctacacggacggcaccaacggcatggtcaccacccaggcgacattcacatcactggacaagaccatcgccacggtcagcggcagcacgctcaccctcatcaaggcgggcacagccaaagtcaccgcgaccgtcaacaaggtgaccagcgccacagcatccatcaccgtggcagcagccgcttagcaatcgtcgcccgcaacgcagtcgggtcgctgcgggcgacccccaccaaacccgacaccccatcaaccacaaccgaaaggcacccgacatgacatccaagaccgaaaccaccagcatccccgaaatcgacttcgacagctggacgcccgaacaggaagaagccgcgctcaagcagatcgcccaagccgcgaaatgcaagtacgccatcggcgacaaccacttctacggccgtttccccgacggcaccatcatcaacctgccactgagcatcagcctcgaagacgtcaacgaaatcagcgaaggcgacgtcgccagcgtcgaccagttcacccgcctcatcgaaaaaatcgcaggaaaggaagacgccgagaaattcctcgcacagccaaccccctcgatgatcgacatggccaacaaatacttcgaaatcttccaaaaactcaaccagctcgtgctggaaaaataatcgccctcgcccggctccaccacgagcaccgccaaccgttcgcggcaaccctccgcgaacggtacggcatcagcgccaaccaaatcggcaaaaccatcacctacggcgaagcctgggacctcgtctaccaactcctggacgaccccagcaaccccctatgcgcggaaatcgcccaatggtcataccccgcacgcctcatcgacctcctccagctcgccgcaaccatcggcgacggcaaagcggccgaaaaaatcatgccatggaccatggcacgacgccaaaaacaaatcgacgccgcgaaagccacaccagaggaaatcgacaaggcgctcgccgagctggacgaggaaatcatcatcaccaacgtcgaaacaacataggagagggagtcaccatggcgagaatcgtcggaaccggcgccgtccgcgtgttcccggtcatgactggattcaaaaaatccgtcagccaggaaatgtcgggctcaggcagccaaggagccaagaaattcacggactccctcaaaggcatgggcagcaaagccggcaaacagctcggcaaggaattcggcaccaccgccaaagacgccatgaaaaacgtcggcggcgacgaaatgaaacaactctccaaggacgtggccagcgcagcggcggcggtctccaaagcccgaatcaaacaacagaccgccaccgcgtccgcgatccaggccgaaaacacctacaacgccgcagtcaaaaaatacggagccgacagcacacaagccgcagcggcggaacaacgcctcgccgccgcacgagaacgagtcaaactcgccgacatcgaactcaccgccgcaacaggcaacctcaaatcagcccaagaagcactcactacagcacaaaaatccgccgaaacacaagcgaaagcgctcgccgaaagcaacaagagcatcttcgccaaattcaaagccggattctcggacatcgacgccggcaaggcctccaccgcatcactgtccaccgcgctcggctccctcgcaggagccatcgccggtccggccgtcaacgcgatcaacaaattccgcgccggctggaccaacgccaacatggccatgctcgacggcgcgggatggctcggcaaagtcggcggagccgcccgaacagtcgcagatggcatcggcaagataaccgccccattcaaaaccgcaggcgcggtcgtcaaacagttcggcagcgacatcgcctacggcctcggccaacgattcaacagcgtcaaggccacggtatccgacctcgcggcgaaaatccccgcaccattccgcaacgccgcatccaccgtggtcaaaggattcagcagcgtcggcaattatctcggcggcatcggctccgccgccaaagccgtgttcggcaaactcgcgcccatcgcccaaggagccgccaaaggcgtaggcaacgcattcctcacagccttccaaggcatcgccagcaaagcatcaagcgccatgggagcggtcggcaacgcgctcaaaggcgtcggcaacgcagtcaaaggcatcgccaccggagccgtcacagtcggcatcgccggcatcggcaccgcgctcacagcaggattcagccgactcaacgccatagacaccgcctcggccaaactccgaggcctcggcaacgacgcgaaaagcgtcgacgctatcatggccaacgcgaccgccagcgtcaaaggcaccagcttcggactcggcgaggcggcgacagtcgccgcatcggccgtggccgcaggcatcaaacccggcgaacaactcgaaacgatgctcaaaggcgtcgccaacgtagccgccgccaccggcggaaccatggaagaaaccggctcggtcttcaacaaagtcgccgccaccggcaaagcctacaccgacaacatcaaccagctctccgatcgaggactgccaatctggcaggcgctcgccgacaagctcggcgtcaccaccgacgaagtgcgcgagatggcgtcgaaaggcaaaatcgacttccagaccttcagcgatgccgcagcgtccgcagcgggcaccgtggccaccgaaatgggcaccacagtgccaggcgcgttcgccaacctcaaggccagcatcggccgtatcggcgcgaacctgctcgatggcgtgttcggcaagctcggccctctcatccaagcggccaccaaggcgctcggacccatggaagacatggccaagggcctaggctccgccataggcgacgtgctcggccccgccatagaccgagtcacaggctggctcaccaagctcggagaaggggccggaggaatcaccggcaaactctccggcatgagcggcgtcatcgctccggtcgccgccgccttcggagcccttggcctgggaggtgtcggaccgctcctgaccaagatcccgatcctgggcgaggcattcggcggtctggcaaattccctgggactgatcggtggacccgtgggagtggccgtggccgccctcggcggtctcatcgccaccaccccgcgactcaagtccgctttcggagcacagctctccgcgctcttccagaatctgaagaacacgctctccggcatggggccagcattcgagacgttcaagaagaccctgagcttggcgttcaaggatgtcggcccttcactcatcgggtcgttggaatccgtcatcaactcggtcggcgcgatcttccagcaactgataggtgtcatcccgcaaatcgtcgaaccactgctgaccggattcggccagatggcgccggccatcggccagacactgaccgcgatagcgtccgcaatcagcgaggtgatggcactgctggtcccactggtgccgcagatcatcacaccgctgatgcaggtgttctcgtcgctgatgccggtcatcaccaacatcgtcaatgtggtattgggcgcgattcagtccctgttgccgcccatcaccacactgatcgccaacctgctgccggccgtgtcgtccatcatctccgcaatggcaccggtcatcacggtgattggcgaagccataggccaggtcgtgacggtcatcgtcaacctcgtgtccacggtgctgccgccagtgctgaatctcatccagtcgctgatcccgcccatcaccacgctgataacgagcctgctgcccccgctggcatccatcatccaagctctcatgccggtcatcacgaccgtgatgaacgtcatcgggcaagtggcatcgatcatcgtcaacctcgtgtccacggtgctgccgccgctgctggatgtggtcaacgcgctgatccaaccgattctcagcatgatcaccaccctgcttccgccactgaacgcggtgatacaggcgctcataccgatcatcatgcagatcgtggccgccctggccgaaatcatcgcaccgatcgggcaaatcgtcgcccaaatcgccggtgcggtgatgcccatcatccagcaactcggctccatcgtgcaaagcgtcgcgaacctcgtggcatgggccatcaactcgctgctgctgcccgcattcagcgcaatggcaccggccgtcacctcggcggttggcaccgtcaaggccgtgttcagcacaatctccggcatcatctccggcatcgtgaacgtcgtctccggcatcatctccggtaactggggccaagtctggaacgggttcaagcagatcgtcagcagcgcggtcaagggactcggctcaatcgtcggcggcatcagggacaccgtgctcaacgcgctgtccggtgccggccaatggctggtccaatcaggcaaagccatcatcgacggcctgatctccggcatcaaaggcgcgatatcgggagccaaggatgccgtcagcggtgcgctgcagtccatccgagacctgttcccgttctcgccagccaaggagggcccgttctcgggcagaggatgggtgctctactcaggccgcagcatcaccgccgcattcgcccaaggcgtcaccgacaacgccggcaaagccgaaaaagcggtgcatgacgccatgcaacgcgcacaatccgccgccaacggcgtcgaactcgcctaccggtccaccatcggacgtaccgacaccgccactgccggatacggcggagaccaacgaaccaatgtaaccaatatcacgcagaacatcaccaccgtccaggacgatccccgcaagcaggcgctcgcatggggccgttacgcaggcaaggcgttcgcgggaacaggaggagtctgatgagcgcatacgatctgacgctcggcaccggacagtcggccatccggttcgacggcggtgccggcatcgtcggcgcacggcacggctggggcctgcagaacctcaccgattggatgagtctgagcgacgccaaaaacgatgtcaatgaacgcgccctgcagcacggcgcgttcgaccccggccagaccacgcgccaatcggcgctcatcaccgcgactgtcgcctacgtgggcagcaccgtcgcggagctcgaacaggcgatatacgcgctcaacggcctgaccgcagaaccggcagcgcccctaagggccaccttcaggggcgctgccggcgaaacccaccgagacatgaccaacatcgagatcacggtgccatcgcatcgaggacgaagccggctctccgacatcacaatcgacatgaccgccatagacccacgcgcctacggcgccgaatccaccaacagcacaggcatggcggcgcacggcggaggcctgcgatttcccctgacattccccgtcaacttcggcacccccggaaccgacggacgagtcaggttcaccaacacgggcaccgccaccacctaccttacgctcgtcgtgacaggcggcatgagccaaggattctccctcaaacgagtcgaaaccggccaaaccatcaccatcagccggcccatcaacatggacgatacggtcaccctcgaaacgtattacggcaccgtgctgctcaacaaccagtcaagcctgagcggattcctcacggagtacgactggttccaatgcccgccaggcgaaacctgcaccgtccaattcaccccactcggcaccgtcaccggaacaccgacactcaccatgaccgcaagccccgcatggtggtaaacaaaaaggagaatcgatgagagtcagaatatgcgacctacgcaccggccgacgcatcctcgacctgccctacctcaaagccgactggaccggcgaattcaacggagccgaaaccgtcaccgccaccgtcagcgtcaacgaccgacgaatccaaaaactcgacctctacaacgcctccatacccggtcgcaccgcgctcatcatcgaagaccaaggagtcaccaacggcggccccatctggacccgccattacgaccgcgacgccggcaccgtcgaactctcaggcaaaggcctctggtcgtacttcgaccaccgcaccctcctgccactgatgaaagacacggacaagctcaccaacagcgacggcaccgccaacaccggattcgacaccaacatcaaaaacaccagctaccagaccatcgccaaacgatggatccaacaatcactcacctggaccggcggcaacctgcccatcaccttcgaagacgacatggccggcacctacgaacgcaacatcaaaggagcagagctcaaactcataggcgacctgctcattaacctcaccgaagtccaaaacgggcccgacatccgattccaaccccgcctcaccacagacggcctcggctacgaatggctcctcaaaaccggcaagccccgactcaccggcaacaccaccaccatctgggacaccagcctgccaggcaacaccgtcagcgacctcacaatcagccaagacgccaacgacctcgccaacatcgtctgggaaacaggcggagcagccagcgaccaagcaatcatcgaacgcgcaacagaccacagcttcactggcctcggattccccctactggaaaaggtcgaaagcctgtccagcagcgtcaccgaccccaaaaccgcgctcgcacacgccgtcgaaaccatccgcaccagcacacgccccctcaacacatggcaattcagcgtccaacgagaccagcggctcggcgaatacgacgtcggccacgactgcgggctcatcatccgaaacgaccagttcggcataccggacggcctgcacaagctccgcatcatgacccttcgcggctcaagcgacagcgacaaaatcgaaatcaccacaggagccttcaatgagtgatccaaaaacctacaccgatgatttcgccaaattcgccgaccgcatcaaccgcatcgaagcgtcaatccgcaacctgcgagtacccacggacggacaattcacccaaaccgtgaaaaagatcctcgcactgttcgacagcctcgaccagcaagtggccgacagcatcagcaaaaacagctatgacaaagccaccatcgacagcaagctccaagactggaactggggcacactcacgccaggccgaggcggcaccggcacaacaaacggctacaacaacctcttcaccaaaggccaatggagagccggatggatcctcacggacggcaccatcggcaccgcgcaatcaagccgcaaagtcaagaccgatatcaccgatgcagaccaattcatccctatcgaggccctgcgcaaagtcaaatggcagatcttccgctacatcgcggatctcaacgccaacaacgacagcgccatgccacgaatcggcatgatcgccgaagacctcgactccaacggcctcggcatgttctgcacctacgacgcaaacgacgaaccagacggcatcgactaccagacactcagcgtcgccgccctccgcctcgcccaggatgcggaaacccgaatcgacgatttggcacaacgcctcacacaactagagaaaaggaaccaacaatgacgctccgtaacggatttcccgcagtcagcgacgcggcagaccaattcgacatccgcgctgcactccgcgccaccaccgcccaggacgccaacggcaacatcaaaaccggcgtcagcatcaccgccaaaagcctcaccggactcgtcacggcagggaacggcatgaacagcgacatcgccgccttcgatgccgtcaccaaccgatatggcccagtctggctcagtaacgacggcaccatcagcgtcaaacacgccgccgcccccagcgccaacagccgcatcgacctcatctgcatcaaacaaaacgaaaccgcctcaccagccagcgaccccacagacggcccagaagccatcatcgtcaccggcaccccagcagtggatcccgttacgccagcaacaccagaaggagcactggccctcgcccgagtcaccatcccatcgacggcgacctccatgacctccaccggagtcatctacgaacagatgtaccccttcactgcctcagccggtgccgatctgctcttccgcagcgaaaccgaaaaagacgcatggacgccatgggaagggcaaaaatgccgactactcgacggcaacgaataccaggcaaaatcaggcgtctgggtttccctaacccacaccgatgtcacgaccctcatcagtggcaattacggcaccgtaactgttagaattacaggaccaacaagggtgttgcacttctaaatagacatcgggagtcactacgaatgcgtcagcaagaggagattactcgccaaattcctcggcgcagatctcagctaccgcatccacgcacgcctcggcaatcagacggccgcgttcggcgctcgagccggccggattggcgagtccgccgtgagcgggaacgtcaccttggcgcacagggtagcggacataggatttcgccgtggcaccggcttcctcgaccatacggtccatgtgcaccagttccggcgcatagtggagcatcaacgaagtttcggtgacggccgcatgctccaacgcccagccggggaacaccaatccatcgaacaccttgtcgataaccgactgcggaaccgggtcccaccaattggtttccacgatggtggccactcccccggtttcgcgggtgaccaggtcgatggcctcgacgatgaacgcctcgttttcaaaatgcgcgttcatgacgacgatcttggtgaagccatcggcgatgagttcgctcagcacgtcgtgcatttggttgatcactgtcacgccgttcatgtcgatagtgcccgggaacagcggcccgccaccggagagcggcttggacttgtatccgtagctcagggtgggcagcacagtgccgtcgatgcgttccgccagatcttcggcgacccgcgtggcgagtaccgcgtcggtgccgatgggcagatgctggccgtgctgttcggtcgaaccgatcggcacgatgacgggacgagtcttcgcctccttgaattccggccaggtcatgtggtccatacgacggttgctacccattgcagtactcctttaggttggtggtggattggatggtcgatgaatacgcccggctccctcggggaaggagccggagctgaggagatcagatgtgattcagatccttgtcggtgttttcgtgggagaggatcatcgcgaccaaggcgatggccgcaacgcccaccatgtaccaggccggggcgatggacgaaccggtcagggcaatcaggccagtggcgatgaacgaggccgtaccaccgaagatggcgttggccagattgaagctgaacgcgaatccggtgaagcgcacggaggtggggaacgtctcggtcaggtagctggacagggtaccgtcgttggcggtcagggtggcgcacattgccagctcaaccagcagcacgggccagaactgggaggtgttgaggatgaggaaggcaggaacggtgagaacgatgaacgccacgcaagcgccgatgagcaccttcttgcggccgaatttgtcggagacgtggcccatgccgaacaccatgaacacgtaggcgaccaggcagatggtggtgatagtgccggactggggggcgtccatgccgacggtgtcagacagataggtcggcaggtaggtgagcacggtgtagaagccgaccgcgttcagcacgcaggctccgaagctgatgatcagagccttgagatggttgtggaacaactcggcgagcggggcgaacatgccgctcttggcagcgatttgaccgtcggcggaggcggcgcccttggactcaagcgcatcgttcatcgactggtagacgggggaatcagcgagcttggcgcggatgtacagcacaatcagaccgagcgggccggccagcaggaacggcacacgccatccccaaccgaccatcgcgctagagttcatgttggcggtcatcagcgtggccagagtagaaccggcgagcagaccgatagcggtggaagccggaatcagcgagcagtagatgccgcgctttgaagtgggcgcatattcgccgaggaacgtggccgcaccggcatattcaccggaggcggagaagccctgcaccatgcgcagcagtagaagcagaatcggcgcgccaacgccaatcaccgagtaagacggcaggcagccaatcaggaagctcgcaccggacatgaacataatcgagtgggccaatgcggctttacggcctttcttatctccatagctaccccagaacagtgcgccgattggacgcaggatgaaggatagcgcgaacacgccgaaggtctgcagcatggcgacggtgtgattgtcggttgggaagaacaccagggcgatagtggtggcgaagtacgaataggaggcgtagtcgaaccactcgatgaagttgccgaggaaggaggataccgcgactttcctgaccatggcctgttcttcagtttgcggggtggaattcatcagtcgtgcagatgtagtaatcattgcggaactcatgatgtcaccgtcctttcaaggatgtgctgttcgtgtgactgaatgagattcaagtgggaatccgtttcgcagcaggtcgaccagcgccgcgatagcctcgactatgcccttgagtatttgctgaaacgtgaatcgtcgattaacccgttcggcgtagaagtggacaggttgcccagtggtgccggcgcattattcaacatgctgttcttgccatgatttcgtgagtttggcggcgaatagcagcatcgaccagttcggtttgtcgttatagtcgacgccgaccatttgtgtcactttgtccagtcggttgtacagggtttgccgtctgatgcccaattgctcgcacgcgccggttttgctgtcgaggttgtcgaagcaggcgcacagtgtgtccagcaacaacggagaggcggcgacctcgaatccgatggtctgcaccacgagcatgcgcatcgccttgtccatatcagaggatgcgacgaaacggtcgacgagtgcggacatggtacttacgattcgcccgtatgccggttcctgattggcgatgtcacgcaataccgcgaacccgtcgaccagcgtcaccgtgtccaatgccactcggccatgcaccacgtatataccgtcgccttccagtacggcaagcgcatccatgcaatggcgtccgaatgcggccgcaccgtctgaggaatcggtggtggagcaccatccgaccatcaagtcaccttccagcatgcaggagacggcgcatcccgaccgttcttcgaaccgttcgaccatcgtcgatacatggttgatgccttccaccaccgatctgaaccgaaaagcgaatggcatatagatgcatgatccggcaaaacccagcgcttcgagcatcgcatgcgcttcctgcgcctcaaatgtattgacgtgcacgccgtcggccggacccatactcagatgatgcatcatgcccatgcgcgcaccgccgtcaatataaagggcagccaccggagacacgatggtggcgatggcccgacgcatcgtggcgtcgaaagtcatggtgcgttgcgtgatctccaatgctcccaccggccgggagcgactttcaagggcgatgacgacgctcgattcgttgccgacatcgaacgcacgacccgctcgagcggccaacagaccgtcaccatcgaaaatagcgacgctttcgccgaacagcgacgcaatggtttcggccacagcctcgatattgccggtacgggacaatccctcacgtaatgaagtggacattgtgtccacctccaattgcaagtgcatctgttcgtgcacaatagcggtattgacgctctgacagatgtcgacaaaaggtacgcgagatttcaaaccaatcaacgtcaacccatgcagcctggccgcagacaccagttcgtccggcatccgcaccacaccctccaccagttcgaccaccagagcggcgacaccagcctgtgccaggcttgctacatattgtcctagcgtgccgtgccaatcggcggcgagcagagcgttgccctcgataatcagcatctcaccgcccgaaaggaagctggagacatcctctcgctcgttggtgaacacccatcgcactggcatatcgaggtctttgccttcgacctccaccacaggatcggctcgtttgaactgcgtgttatgaagcacactgcgaatcgatacagtcatacaatctgtccattcccccgcggaacaccggtcgttccggttaacctcaccgcaaagcgtgctgttgacaataacctcagttggttacgcgggcagtcggttcacgtaaccgttcggcaacacaccagttgaaggagcgacgatgactaccacactgttcaccaacgcacatatcgccaccggagaacccggaagcacggctgcaagcaccctgccattgcaggacattctcgtcacggatggtgtgttcaccgcattcggccccggactcgcgcaacaatatgaggctcagggtggtgatccggcggccattgaggtggtcgatctgggcggcaaacttgtctgcccaccgttctgcgatacgcatctgcaccttgattacgtattcacggcccgcaagcccggtgcggtgaatgaaagcggaaccttgtttgagggcatccagcgatggagtgagaccaagtccgacttgacggtcgacgagatcaagcagcgcgcgaaaatcggcattaagaaagaaatgctgcatggcgtacagctcattcgatcccatgccgatgtgaccgacccgaacctgacctcgttaaaggcgctgctggagcttaaggaggaattgaaggatacggtcactctccagatcgtcagcttcccgcaggagggcatgtactcctacgagggcccgcatggcgaatcgggtgccgagctggtggaggaaggactcaagatgggtgccgactgcgtgggcggcatcccccatttcgaacagtgccgtgagtttggcgagcattccatgcacacggtagttgagttggcttcgaaatacgacaagctcatcgacgtgcattgcgatgagacggatgatccgaattcccgttacgtggagctgctttcggcattggcgtataaggctggcattggcccgaaggtcaccgccagccacacctgctcgctgggatcggcggacaacgcctacttcttccacctgaccaagctgcttaaggcggcgcatatcaacttcgcctgcgcccccaccgagaacctgtatttgcagggccgtcaggataccttccccaagcgccgtggcatcacgcgagtcaaggagctcactgaggcgggtgtcaatgtgtcattgggccaggattcaatgcaggacccgtggtacccgctgggcaatggcaatatgatgctcattcttgattatgtgctgcatttggcacagatgatgagctttgaagaaatcgacgatgcgttgaagttcctgaccgtcaacggtgccactacgttgggcctgcgcgatatgtacggcttggaaacgggcaagccagcaaacttcattgtgctggacgccgatagcgtgttcaacgccgtgtatgagcgctgctcggtattgcgttcggtgcgcgccggccgcacgctgtttacccgcgaggagaccatcgacaccggactcgccctgctgtaataatccgacacaaacagtagctccccttgacaggggagctgtcgccagaggcaactgaggggtagaccacaaacgtgcacatcatgtatgcgtttgtggtctacccctaagtcagcttcgctgacagctcccctgtcaaggggagcttttctggtatgcgctagctacgctatcgaaacggactactcctgcggagcgtcaccggaatcggcgggagcggattcggccggttcagtggccggagtggcgtcggctggagtctcgccatcagtggaggcaccggcttcggacgaagtttcggcatcggcggcggccggctcctcgaactcctcacccttgaaggtgaattcgccgaggataccctcgccttccgcatccacaatcacgcgctgaccgtcttcgagatcgcccatcaggatcttctcggagatggcgtcctcgatgtcgcgctgaatcacgcggcgcagcggacgggcaccgagcagcgggtcgaagcccttctgcgcgagcaggtccttggcggcgtcggtgagttcgagcgacatatgacggtcgaacaggcggtcgttgagctgcttgacgtccagatccacgatctggcgcacctgcggctcggtgagctgcttgaagacgatgatgtcgtccagacggttcaggaactccgggcggaactgctgcttcaattcggagctgacctggtccttcatgcgctggtagctggactcgttgttggcacccaggttgaagcccgtgttggcggccttggcgatgtctcgcgtaccgaggttggtggtcaggatgatgatggtgttcttaaagtccaccttgcggccctgaccgtcggtcaggtggccgtcatcgagcacctgcagcagcgtgttgaagatgtccggatgagccttttcgatctcgtcgaacagcaccacggagaacggcttgcggcgcaccttttcggtgagctcgccgccctcctcgtagccgacgtatcccggaggcgcaccgaagagtcgcgaagccgcgtacttctcggagaactcggacatatccacgcgaatcagcgcgtcctcatcgtcgaacaggaattcggcgagcgtcttggccagctcggtcttgccgacgccggtggggccggcgaagatgaacgaaccggacgggcgcttcgggtccttcagacccacgcgagtacggcggatagagcgggacagggcggaaaccgcctcgtcctggccgatgatgcgcttgtgcagttcggcttccatgttgagcagtttcttggactcggcctgagtcagcttgaacaccgggataccggtggtggagctgatgacctcggcgatcacgtcctcgtccacgaccatcttgacgtcggactcgccttcgcgccaggagtcttccttctgcttgcgatcggcttccagcttctcctgcttgtcgcgcagttcggcggccttctcgaagtcctggcccttgatggcctcgtccttgtcggcggcgatcttggcgatcttctcgtcgagttccttgagctcaggcggggcggtcaggcgcttgatgcgcaggcgtgcaccggcctcatcgatcaggtcgatggccttgtcaggcaggttacggtcctggatgtaccggctggacagctctgcggcagactgcagcgcgccatcggtgatggtcacgtggtggtggttctcgtaacgggaacgcaggcccttcaggatctcgatggtctcggcgatggtcggctcgtgcacctgaatcggctggaaacggcgttccagagccgcgtccttctcgatgtacttgcggtactcgtcggtggtggtggcaccaatggtctggagctcgccacgggccagcatcggcttcaacatgtcggaggcacccagcgcgccgtcagccgagccggcgcccacgatggtgtgaatctcgtcgatgaacagcacgatgtcgccacgagtcttgatttccttcagcaccttcttcaggcgctcctcgaaatcaccacggtagcgggagccggccaccatggaaccgaggtccagcgagtagacctgcttgcccttcagggtttccggcacgtcgccggcttggatcttctgggccaagccttcgaccacagcggtcttgcccacgccgggctcgccgatcagcaccgggttgttcttggtgcggcgggaaagcacgaccataacgcgctcaatctcgttggtacggccgatgaccgggtccagcttgccttcagcggcttcggcggtcaggttgcggccgaactgatcgaggatggcggaaccggacttgttctgcttgtccgtcacgccgccggcgttggccaagtcgcccttgccgtcaccggtgccggtgccggagttgccgcgaatcatatcgatggtcgcgctacgcaactcgcccagatcgacgtccatcttgatgagcacctgggtgcccacgccttcgccttcgcgaatcaggccgagcaggatgtgctcggtgccgatgtagctgtggcccagctgcagggcttcacgcagcgaaaactccaacacctgcttggcgtgcggagtaaaggggatgtgcccgttcggagccgcgttgcccttgccgatcatttcttcaacctgcttgcgggtggcatccagctccacgcccttcgaggcgagtgccttggcggctacaccctcaccttcgcggatcaggccgagcagcaggtgttcggtgccgatgtagttgtgctgaagggccctcgcctcttcctgcgccaacacgatcacgcgccgtgcacggtcggtaaaccgttcgaacatgcttgtccttcctcaattgacattccgtcttactctaccgattcacgatgacgtttattcatcggattccacgaattgcgccgtgagaggagaagaaaacgatatgctggttctagattcacccgtagtcgattacaaggaggctcgaaatgagtgaagctgcaaccaagcccgacatcgttgtcggtgtggatggttccgatgaatcctttgccgcgctgaagtgggcgcttgaggaggcctcgttaaccggtcagagcgtcaacgccgtgtttggctggacgcattcctgggatatggggtccgaaccggacagcgacgaggcctgggccaaggtccgccacgatattgccaacgagctgcgtgtgtgggtcgacaaggccgctgcaggcatcgacttcgatccggcgaatctgaagctcacctcggtgaaggcctccggcacttcggccctgctgcagatcggccatgattcgcagcagatcgtggtcggccgccgctcgctgagccgtatggcccgctggttcatggggtccctgtccgcttcgctggccgaggccgccgaagtgccggtgaccgtggtgcgcatcgccggcagcgaggatgagaccgtgaccgaggccattgccaacgccctgactccgggagacaagcccgttcactacacgcagcctcagccggtggttgaggaggctcgccgcccggtggtggttggtgtggatggttccgagacttcccgccgtgcgttcgatttcgcactggaagaagcacgactgcacgacgcgccgctgcatgtgatgttctgctggcagctcaaggatttgggcgttattccgggctatgagaacgccgtggcaccggtgaaggtcggtcagcgccgcgccgaggagattctctctgagctgatggccaaggcccggattcccgatggcgtcaaggtcagcacaaacgccttccatattcccgcatccaaaggtctgatcgcggcctcgcggtacgccagccatctggtggtcggctcgcgtggcctgtccgggctggacgcgcacttcctgggatcggtgtcccgccagatcgtgaacttcgccgaatgcacggtgaccgtggtgcactgattcaccaaaatcggcatggagtgctaacgcacgcctcggtgatgggcttgcagggaggaattctttattcctgcaaccccatcaccatctacttttcgcggaattcggagtttattcctcgtccgccctgttctggcgcagctgctcaatgagatcgatgacggtttcgagttcaggagtcacatcgtctgaaggacgaacgttatcctcttcgtcgtccatctcatcatcctcatcatcatcggcaacggtgttgttgaggatatcctcttcggtggcctcgtcgtcagcatcagacttggaatcgtcgctggaatcagctgcatcaacatccacaacggaatcagatacgttctgtgcaacggactcatcaccggcagactgggattgcgaggtcccgtcgcctgccgcctcctcagcgggctcagtatcgacggcgttcccgtcaacagtcttctgtgcttcgatatcatcaccggcaggctcgcctgtcttgtcggtttcgccttcggcctcgtcctgggcagccggctcctgcttgcgcggacggttggccaccacgtcgatatgcagatcgtcgaaagcaggcttggactgcacccacagctggcttggctcgggaggttcgatttcggaatgctcgccgcagccgtggtccaaggaaaccacgcggccgtcatccggactccacttgttggcgcacacgccgaacatacggtcgagctcgcccgcgagcggcacgaagaaaccacaggtggagcacaggttgccttcggcggttttggtgctcaacgctttggggcctcgcggaccttcataccagcgcttggcagcctgcgcgcggcccagcgaggtcagcacgtgacggcgggtcagtcggaaggtctcgacggcgtcgttgacatcctgcagcgaggattcctcgacttcgccttcctcgatgcgctcgtcatccggatcggtaccgatcgaatcggtgggagccagatccgtgggctcaaggcgatccttccaaggaatccacttgggcggcatcaacgcgtcctcagtggagatcaaggaggattcgttgacggtccaggagtcgatctcctcgtcgtgatacagcgtcaccgaccattgccatccttcgtagccacggatattcgcggcgaagcggaagtcagtgacgtgatcctcaagattatatgaggtaacgaaatcccccacctgatcgctctcgtcggccacttcgagcagcacggcgcgcgcgatggcgtgagggtccggtgtcacgatggtttcggtggtatcagtcatagatcagatcagtcctgtacatcgaattgatccgccaccgcacgcagcaacgtggccagctttttgctgtcggcagcagatgggtaacggtgacggcgcaacgtattgccggccgcatcaagcatcttgatgaggtcctcgcagatggcggccatgtcatccgccttcgggcgggtggccttgaccaagctgggagcggaggcgatcaggcgaacatccatggcctgcggcccacgacggccgtccaccacggaatactccaccttggcccccttgcgcaacgtggtgacgccagtgggtagggcctgagccggcaggaacacgtccttgccttcctcactggtgatgaagccataacccttggctgcgtcaaaccaacgaactcgaccggtgggcattgcgaaccttccttaatcctcaatggaaatagtaaaccgaaggtacagtttacctcacagggcttgacctcacgctttgggctgagtcgcctgagtcttacgctcagagctgaaccaagaagtcttctgtttggcgtccttggttttgccggtggactgcttgggctcaggagcggcgatctgctcaatcggcagcaccacggtgaaggtcaggcctcccccatcggtgccggtggcgcagataaagccgtgatgtgctttgaccacggattgcgcgatggccatgcccaaaccagtaccgcccttttcgcgggcacgggatgggtccgcggtgtagaagcgttcgaaaatcttcgagcgcgattcaggcggcacgccggggccatggtccacgaaacgcaatacggcatatcgatagccggtctgcatcgaggcacctacttcggcagcgtcgatgaaccgccgcattgacgcgtcgctggcgggcatgcgggcgagctgtcttggatcgatggcggccggcatcacaccgagcgcggcttcagcgggcgaatcggcaggcgtgtagcggtggatgttgcccacgatgttggtcaccacctggcgcagtcgagaggcatcaccgggcagtacgacctcaggccaatcgccttcggcaaggctgaattcggcgggatggttcaaatcgcgcgccggttcgagggaaatctgcatgcggcgaacggcacggtccgggtcgagcgcatgcaaatcgtcgacggcgtcggtgaccagcgacgagagtttcaccgtgccggtcatatcgatgccgcgcccctcatcgagacgggccaaagacagcagatcctcaacaagaacagtcatgcgctggctggaccgttcgatatgttcgatggactcgtccgcacgctccaaggcaccaggcatatcgcgctgcatcttatacagctccgcatagccatggatggcggccaacggggtgcgcagctcatggctggcgtcggagacgaaccgtttcatcttgtcggtggtctcctcctgctcatggaaactggattctattcgggtgagcatggaattcagcgaggcggccagagagccgacctcggtgttttccggcgcggaaggaatacgttggctcaggtcgccggctgcaattttcgcggcggtcttctcgatgcgcttcagcggcgtcatcgtgtgctggatgatcagcgtggacagggagccgccgagcagcaccacggcgatgccgaccacaatgcagtatcgggtgagtgtgttgacggtgtcgatttggtcggccagcgacaagccgatgtacaccacggcacggtccttgccgttttgctggaaggtcaccggcagaatacgccatggtgccctcgccgtgacgatggcggcatggttggcattggcagtggggttggccagtaccttggtgatggtgtcagaggaattggagtttccgttggccggatcgttctggctgtccgcactgtcggactgcaccgtgatgatctgcttggccaccgcctgcgtagtgaatgcctgaccgagcgtgatgccattggtatcgccataggtaggcagaatcggcaccgatacgataccgtcctgcatctgcggcatcagcggggtcacgaccagaggattgccttctttgtctttggttccgtcggtgtattgaatctgcagaaagtacgagttcggccccgatgagtcattttttgacagcagatcgatattgttgaccaccagttggctttgcgagcttaactgggtgtcggttttctgcagcatgtagttgttcaccaacgcgcggatggagaaggaaatcaccgacacgccgatgagcagcacggcgatggtgcaggccaccagcttgctgctcaacgagatacggtcgatatgccgcatcagcatgtttttcttacgctcgcgctgctcttggaaatgggcggcgaacggcgacattgcaggcatgggattcgtgttcggggcggcgttcggcgtgctgctcggcggtacgccgcctgactgcttatcggggatactcatgagattgcgatacgttatggatggaggcgattagttcttcggttcgcgaatcatgtatccgatgccgcgcttggtttcgatcagcggagtcaccttgcgcttgccgccttcgccgtcgtcgacctcgatgccgtcgactttcttgcgcaggtaggagatgtacgattcgacgatggctgcgtcgccgccccagtcgtattgccagacatggtcgagaatctgtgccttggacagtactcggccctcgttgtccatcaggtagcgcagcagcttgtattcggtagggctcaggtcaaccggctgccctgcacgggtcacgtcgtgggagtcctcgttgatttccaagtcggcgacgcgaataatcggatcgtcttccacctgttcgcgggtacggcgcagaatggcgcggatgcgagccacgacttcctcgaggctgaacggcttggtgacgtaatcgtcaccgccgacggtcaggcccatgatcttgtcttgggtgtcgtcacgagcggtgagaaacagcacaggggcgttaatgccttcctggcggatgcgacgggtgacggtgaatccatcgatgtcaggcagcatgacgtccaacacgatgaggtcaggctgcactttttcgataacctcaatggcttcggaaccggaagcggcggtgtttacctcgaatccggcgaagtgcagggaagcgaccagcagttctcggatggacggctcgtcgtcgacaacaacaatcgatgcttcaataggcttactcatgcttcctagagtgtcgcgctcttctgggcgtttcctgaatgtcatcttggagttcggccttggaatccttcttgatctccttgcgccgatgaatcaccaccatgaccacgatgatgatgaccagcgccaccaataccacacccatgatgattatgcctacgatcaccgtggacgatgaggtggaggcttttttggatttcacgatttgatccatcattgccgttgccgcgccagaccagctcggcgggttttccagtaacggctgctgtgcggcttcggatagcttatcgacggttttgttatcgagaagccacttatcggagttcttggacacgacgaccaccaggttgccgtcattcgaggccacggcaagcatcactgtgttcggcttgggattcatggactccatcacggttgccgcccagtctcccggtttctgttgactattgaaactggaaagatacagcagatgcacgtgtacaccggtttccttctcggttttggcgatggcatccgtgacttcggccgcatgggagcccaggagattttccgtatccgtgatgttctcggtgatggtcacgccgctgtcggtgctgctgctggagctgtcagagctgtcgctcgagttatccccataggcatttgcagttatccacattgcgttcatcgctactgcagcaagggcgcaaatggcgcaaacaagccattttcggaccatattcccgaaggccgaataggacggctccgaagctaggaccacaatagttgtttttccgtcttcccgattcgttgttgacatatcctccaccttaacggccggtattggcaatcggccgccatacataccattaaccctctagaaaaggagcaacgatgccccaatatcaggtagattccgagcgaatccaatcatcctcggccgcagtggccacttcgatctcgcaaatcaggcaggccgtgggcggcatgtacaccaatctcaatgccttgcaggacgcatggcgaggttcggcggccacccagttcaccgcggtagccgaacagtggcgtgcggcccaacagcagatggaggcctcactcgagtccatccaacgctcgctgacgcaagcctccaccgtgtacgctgacgccgaaatccaagcttcgcgcctgtttgccagctagtttcttggctcccctcaaagaggggagccagaatacaaaaaagggactcccgaaggagtcccctttcagctcaatcagctagcgatcgtttgcggatcagtagcccatgtcggcaccggcggccggggcagcagacttcggctccggcttgttggcaacgacggcctcggtggtcaggaacagaccagcgatggaggcggcgttctgcagagcggagcgggtcaccttgaccgggtcggtcacaccggcggccagcaggtcttcgtaggtgtcggtggcggcgttgaagccttcgccatcaggcagggagcggacggtgttgatgaccacgtcaccggacacgccggcgttctcggcgatctgcttgatcggggcctcgatggcgcggaacacgatggcggcaccggtagcctcttcgccggtcagggaggtgacggcctcggtcttctcggccttggcagcagcctgaacgagggccacgccaccgccaggcagcaggccttcctcgatggcggccttggcgttacgcacggcatcttcgatgcggtgcttgcgctccttggcctcgacctcggtggcagcgccgaccttgatgacagccacgccgccagccagcttggccagacgctcctgcagcttctcacggtcgtaatcggagtcggtgttctcgatctcagcgcggatctgggccacgcgagcgtcgatgtcttccttggagccagcgccctgaacgatggtggtctcgtccttggagacgatgaccttcttggcgtggccgagcacggaggtgtcgacggactcgagcttcaggcccagttcgtcggagacaacctgagcaccggtcaggatggccatatcctgcagcatggccttgcgacggtcgccaaagcccggggccttgacggcgcaggacttgaaggtgccacggatgttgttcaggatcaaggtcggcagtgcttcgccgtcgacgtcctcagcgatgatcagcagcggcttgccggtcttcatgaccagctcggccacgtgcacgatgtcctgctgggatgagaccttgccggaggtcagcagaatgtacggatcttcgagcactgcggtctggtcgtcagcgttggtgacgaagtacggggcgatgtagcccttgtcaaaacgcatgccctcggtgaagtcgaggtccaggccgaagcggttgttgtcttcaacggtcacaacgccgtcctggccgaccttgtccagagcctcagcgatcttctcgccgacctcagggtcagcggcggagatggtggcggtagcagcgatctggtccttggtctcgacgtccttggcggcagcgacgagttccttgacgatgacctcggtggccttctcgatgccgcgacgcagggcgatcgggttggagccggcgaccacgttcttcagaccctcgtgaaccagggactgagcaagcacggttgcagtggtggtgccgtcaccggcgacgtcgtcggtcttcttggcgacttccttgaccagctcggcgccgatgcgctcgtacgggtcttcaaggtcgatttccttggcgatggacacgccatcgttggtgatggtcggagcgccgtaggtcttgtcgagcacgacgttgcggcccttcgggcccagagtgaccttgacggtgttggcgagcttgtcaaggccctccagcatgccctgacgggcttcctcatcataagagatgatctttgccatggttgcgtattcctccaaatggctaggtataccggttatcactcgcaagcgtcgagtcgtgacgaccagccgtcagctgccgattatcactctcgacctccgagtgctaacccagacattagcactcgcgcccgccgagtgccaacaccatcggcggcgattgcgctttgggcatgaaaaagccccaaccgtcgaaacggtcagggccttcaatgcacatccttgcgtgcgtgttgctcactcggagcgggcttcacccgaagacagcttgacaacatcctttgcctgcgtgcctttgccggacgaagcgggcgtatactccacgcgatcgccttcgtacagcattttgaacttattggtgctgccgtcgtccttgatttccgcgtagtgcacgaaaacgtcctcgccgccgtcgtccggctggataaacccgaaccccttcttggcaaggaagaacttcacggcaccttgtgccatatctggtctttcctttgttcccttgggcgtcgcgacacaaaacctatagggaacgtagaaagaaccgcatcgcgctccccctacctcgcgactagatgacgattgtacagtgacgagggaacaatctcaaccgcagtggcacattttcggtacgaattattccataggcgtgagaacgctcacagttttcgatgtatttctcgccgatatcaggggcgcatcaacaacgctagttgagcaacaccaccgtaatgggaacggcgagtccttgcacctgctccacagccgaaatgccaagcgtggtcgccacatcctcagcggtggccttatcggtctcattctgataccacaccacggaagaagccggcaatgtgccgctcggattggtcgcctcgacactggtgtaaccggcggtctgcagcacatcggcctgctgacccgcatatccttggattcctgtggcgttgaccacacgcacctgcgtggccttattcacagtcgcgatggcttcggactgctgagactgctgatcggagttttgattctcattcgaggatgtcgtgtcactgtcggtatcggactttgccgaatccgaagtcgagtccttggacgaatcggtcgaagtggacgaggaatcatccttggtgctgttcttggtctcagccttgctggacgaatcggacttggacgtggtcgccgtctgggacgatcctcccactacattcttgtattctccggaaatccatgcccaggccccgacaccgcacagcgcggccaccagaataacgacgatgaacgggcagaggcgggccattaccgaacgagcgccacggtgaactcccaccggtcccttcggaggattgtcgaaggaatccggttcataggattcgtaggtcatcgtgtcgcgtgccataatcgccctttcttcctatcaaaactacccatgagtgtaatcggcaaacaactcatcagtccaccacaccacgccccatgcaccggatatgcacgtttgactacagtggtgagtcatgatcaaaccattgagcgaactggtagagccagggtgggcccatgccttggccgacgtggagcccaccatccaccatatgggcgattttcttcgtgcggaaaacgccgccgggcgcccgtggctgccggcaagccacaatattctgcgcgcgttcaccatcccgttcgattccatcaaggtgctgattgtcggccaggacccctacccgaccccgggtcacccggtgggtttgagcttctgcgtggcgccaaatgttcacccgctgccgaaaagcctgatcaatatttataaggaattggttgacgaccttggggtgcccatgcccaccaacggcgatctgacaccgtggacggaacgtggggtgatgttgctcaacagatgtctgactgtcggcgtcggacggccaaattcacatcagggcaaaggctgggaggaagtcaccgaggccgcgattcgtgcgttgaacgcgcgcacggacgccgacggcaagcccaagccgttggtggcgattctctgggggcgtaatgcgcaaagcctcgagccattgctgaccaatgccttcattatcaaatcgcctcatccgagtccgctgtccgcttcccgcggattcttcggctccaaaccattctccagagccaatcaagccctagtcaccatgggtgccgacccggtggattggactctttaggcaggccaacagtcattgtgagtagttacagtggggggcatgactttgttccccacgcaaccgaacataccttcgccgaccaccgccgcacgaccggtcaccgttcccgcgcccggcgtgtcggctccgctgggtgccgatgacgccaaacgcgcacgtatcctggccgacgccattcgggcgaggttcgcccagacactggtgggtcaggataatctacgcgaatcgcttatcgtgaccttggtggccggcgggcatattcttatcgaatccgtgccgggcttggccaagaccacggccgcccagacgctcgccacctgcgtatccggctcgttcaagcgcgtgcagtgcactcctgatctcatgccatctgatctggtgggcacgcaggtcttcgattttgcgtcgcagaagttcaccacgcagatcggtccgattcacgccaatttcgtactgctggacgagatcaaccgttcgaatgccaaaacccagtccgccatgcttgaggccatggccgagggtgccacgaccatcggcgggcagcgtatcgccttgcccaagccgttcatggtgatcgccaccgagaatccgatcgaggaggagggcacgttcaacctgcccgaagcccagatggatcgtttcatgatgaaggccgtcatgacctatccttcgcccgacgaagaggctcggatgctggccatgctcacccgccgcggctccgacatgatcggtcccgacaccatcaccggcgaacgcatttccgtgtccgacgttgattttttgcgcaaggcggcacgccgcgtgcatgtttccgacgcgatcatgcgttatgcggtcgatatcaccgccacgtcacgaggtgccggctcccgccccatcaagggactgtcatccttggtgcgtttgggtgcctcgccgcgcgccaccatcgccttgacccgtatcggccaggcgaaggcgttgctgtccgggcgcgactatgtggtgcccgaggacctcaaggcgttcgctcatgaggtgctgcgccaccgtattatgctgacgttcgaggcactggccgatggcgtggtcagcgatcagatcgtcgacaagatcgtcgaaacggttcctgttccgtgagttccgattccgttcgcaagaaaatcgaggcccttggcactcagctgagcctgcctaccgtaaggaaggctttgggcgcgctggagggcgaacacgcatccgggcgtcgtggcggcagcggcgatgcgatggatgtgcatgcctatgagccaggcgacgaatcccgtcttatcgattggaagaccagcgcccgccaaggccgccccatggtggtcgagcgtgagcgcctgtcgacgtcacgggtctggttgctgatggacgtgggcctggagatgactggcgtatgcccttccggagaacgcgcatggcaggttgccgccaatgcgctgcgtatgttcgccgcactgtcgttgcgccggtcggacgatatttcgctggtgttcggcgatgagtccagcatcacccgcgtaccgttcaacggtgggttcgcgcagttcgaacgcacgctggacaaggcgcttgaccgtgattgggatcatcaccgtaatatcgacgcgctgctggaatatgcgcgccgtatcaaggatcgcgaggcattgatcgtattggccaccgatgagcatgcgatggaggagcggcatatcaccacgatccgtcgtattacccgcacccatccgatggtgctgatcgatgtggcgacgatgaatccgttcaaggccgtctcatcccgccacgctcccaccgacggcttgagtgcacggcgtgtgccggcattcctgcgcaacgccaaggcagcggccgaggtcgatactcatcgcgcgtatatggccgcggctttggaacaggagctcacccgtgccggttcccatatcattcgatccgcatccagcgaatccatgttcgatcgtttcgtcgccctggtgtcccgggcattggcccgcaccacacgcaatagactgggtactgcacccgaactggtcggactgactttggctggtgatctatgatgcacagcatgttccccatcatcccgctcgccactgatcccggcgatctcaggcccgtggagtcgttggccttgaccactcccctggtggtggccatcgtcgcatgcctgttgctggcggtaggtctgatcgcgttgatcatcatgctgtctcgccccgcacgcaaacctcggaacagcgaccgcgcgcgtggcgctcatagcaatgccagctccaaggccgagtggcgtgcccgcatcgacgatgtggtggcccgtcatgaatccggagcactgccccggcatgaggctttcgtcgaattgtccgtcatcgcccgtgatttcgccggtgccgcatcaggcaaggagcttagttccagtacgctgaccgatttggcgtacctgaatcgcacgcccgcgaatcgccaaggattggacgcattgaagcagaccattggcgcgttgtatccaccggaatttgccgatgatgcccgcaaccgaatcgcccagacgaccagcgtgcagcaggccgccgagtgggtggcgaatctggtggaaaggtggcgttcatgatgctggcatggcattggccttgggccgctctggccggcgtcttggcgacgctggcgattatcgtgctgattgtcgtgttcgcccgccgtaacgccgccgacgacacccctgtattctcgatggacgacgatctcaataccgagcacgcttcccgcctgttccgtcaatggcgcgctttgggccgtctcgccatcagcgtgctggtgcttgcgctggcgctggccattgtgctggtggctcgccccagccaagtggatgccggtgacgaacgcgcttccagccgagatatcgtcctgtgtctggatgtgtcggggtccacgctcccctatgatcgcgaggtcatcgacacctatttggaactggtcaagcatttcaagggggaacgtatcggtttgagtatcttcaactcgacctcacgcacggtgttcccgctgaccgacgactacgaactggtcaccaaacagttgacctccgccagcaaggcgctgaaaggcgtcgagtcgcaggatgacatcgataagatgtccgatgccgaatatcaggacatcgccaattggctcgaaggcacgcagaaccgcaaggacgccacctccttgattggcgacggcgtggtgtcttgcgcggcgatgctccccggtttcgcttatggcgaagccaatcatgcgaatgccgaccgtcagcgtgcggcatccatcgtgctggccaccgacaacgtcgtgtcgggcaagcccacctattcgctgaccgaagcgttggatttgacccagcagaccaaaatcaccgtggacggcctgtattccgggccgaaagccagtgaatcggaccaaaccacaacggatatgaagtccgcgatcgagtcgcatggaggcatcttcctcacccaatcgaatggcgcgtcgatagatgagctggtacgggatattcagtcgcgtagagatacggatgtggagaacaaggcgaaatcctcgatggtggacgctcccggtctgtggacgcttgctctggccgtgatactcattatctggatcgtatgtgcatggaggttgaggcgatgaacggattcaccttctcccccgccttgggctgggtcgccggcggactgctggcggccgggctcgccgtactggccattctcgaaatcgcattatttgttcgtcgccgtgcttccagtgacgagaccgcgtgggcttgcatacgacgtacgcttatgctgctcattgtcgcggtgatggtactgactcccagcgtggtatcgtctaccacctcacaggccatcaatgccaccgacgtcattgtggcggtggataccaccgggtcgatggcggtggccgacgccacatacgggtccgagaagaccattacccgcatcgatgccgcacgccaggccgtgcatgatgtgaccgccgcttatccggacgccagtttcgcggcgttacggttcggtgcttcggggacgcttgatgtgccgctgaccccggatgcgccggccatcgataattgggccaacacgttggcggtggaagccacatccgtgtcggcgggctccagtctggatgctccgatcgatcaattgctgctgaccgtgaagtcgattcgtgaagcgcacccggatgatgcgattgtgctgtacctcatcactgacggcgaacagacctcgaatgtgacgcgtcgtacgttctcgtcactgcgccagtatctcaatgatgggtttaccgtgggcgtcggctcgaccgagggcggcaagattcccgtcatcgccgatggcgtcagtgccggcgattccaacaccacggaccactgggtggtcgacccggataccggcgaacccggcatctccaagatggatgagaagaaccttaaagacattgccgacgagatcagtggcacgtatgtggccgtgaacgcttcacagactttggcggattcggtttcggccaagtcgtcgaagcagtggcgcatggccaccacggtcagggaacgcacacgcaccacgccggtggtatggccgttggccattgcgttggcgatattgcttgccatggaagtcggtgcatggatcgcaacctcaaggagactgctgtgagaaacagtaacgaaatccacgagaacgacggctcggcgaatactcggatgcgggcgaagtgtccgctttgggcacgtatcgtcctggcttgtggcgccgtattgctgttgctggttgccggcgtggcggcagtaaacctgtccgcttcgattacgttcaatcaggccaccgcatcattgaacgccaatatcaaagcggctcaggacgagtccacggatatcaccacgctcaaggcgcaacagcagcagaccgacgcgcaattcgacgaggccgggcgaatgcgcacgcttctgttgccgcaagtcaaggacgccatcgacaccaatgcttcgatttcttccgagctgacgaagatcaccctgaaacaggccgaggcgcagaacagcggttccgattctgggcaagcccagtcggcacagcaatccgagaattcttcatccaatgccaaaaagggcggcgcgttgaccgacgaacagaagaagcaggtcgaggagctgatgaaggccaatcagcaatccaccgatacccagtcgaacaccacccaatccgagcagaaagcgacgcagaacaagggtaccggggctaccaagccgtggtaagcagtcgttcacagttgttcttttttctcacaccctcacgggtcatggctttatcgcggctgtttcccggtttcggctgtcggctttggcatttatccaattttcgataggccatggctgatccaaggtatgtccaaacaggctatttgtggataatcgttacgactatgcacaacacttggggataacttcacccaaaatcggcaagctagaaccacattggtcgttccggctggacaagcatgagtcttgtccttttagctggatatatgaatacctacaccagcaacccagcacccatcgatcccaccggcggctttgccggcaatacggtgacgccgttcgattacggcacttgcccttgccatgcggcggtacagcgtagtcgcgacctcgtgtccgtccagcgtgcggccacactggcgcaatcggaccagacggcggtggccgtgaaccgctccagcaacatcgtgtggaccggtaaagccgccgatctattccgatcgcggctcagtcgcaccgcacagtattcggccagtctcgcgcaagacatggagaccacccaccgattggcttgggggtcgtcatgagcgagcacgattactggcaagtggaatcgtccgtttacggcggagtgggatatgcgccagccactcttgaagaatatgccgccatagccaaggctctcgatgacgaggcggcaggatttgcggccatagccacggcttgggaatcggccgcattacagttgcagtcacatcggcatagtgcgccgatgtgcgtcaccttgcagtcgggcgatccgagcgccgttgttcccggccatgtcactgcaccatatgccgcgctgggcaatcggtgttatgaccatgcaacggcatgtcagcggttgagcgatgatctgcgtggcgcggccgatctgctgattcgcgcacactctctgtattctcaggcggagatgacggctcggcgcatgtttaccgaattattgcaggccggcacacaggccaaaccgggatatgccgcggcgggtgttgccgctgtggcggcgggcggctttctggccggctggactattgacggcaaaccgaacccggcatggatgtccacgttcacctatccgttccaggaaggagtgcttagcggcgcgggcggaatcattggcggcgtacctatcggcaagagcattgcgcacaccgatgaggtcaacaaggctgcggggaaaatcgccaatttctccggcccggcgaaagacgtcgtccaaggcaatcatctggacgtgcgcgaggtgcaggcgaatgccgacgttgtccgcgcaagcggatcggtggccgagtcaatggagaatctgcgcaggctcgccgaagagcggctcggcaaaatcgagctgaacagcggactcgaatatgggaccatcgccattcaacgctatgaacgatctgatggaaccaactcctggctggtcaccatcccgggtaccgatggacagcctgactcaccatttggctgggcgcagaacgtggaactgatgagcgccgatcaggagcgccgcaggaaagcggacagcgctcgcatggttgccgaggcgatgcgtcaggcaggcatcggcaaggatgagcccgtggcgctgatcggccattcccagggtggtatcgttgccgccacgcttgcctcggattgggcggaggaatataccatcgagcatgtggtgacagccggatcgccggtggccaatcatccgattccgcaacgcacgtgggtcaccagcgtggaaatcgatgatgaactggtcgccgcactggatggtgccgccaacccggtcaccgataactggctcaccgtacaagggcatgtatcgcccgcgcccgcggcaacaccatccacagtgcattcggacggctcatgcactcccggcgcaacgcccatcaccggtctgaccccatatgacgccgcacccgtggctggttcgaccaacggcagggagttgtcgcactggatcaaataccatcaggccgcctatcagaacgccaccgacctcggctcccccgccgtgcaacgccacgaagcccatttccaggaagttatcaacggagagctcaaggaaacccgctactaccaaggccgcatgacccagtccgcgaccattgcccctagcgagcgaaccaccgagttcagcacgttcggcggttaaaagtaaataccacacttgacagagttgtcaagaaaggagttaacaatataatgacgagtaggagatggctcatcaaactgatgaagcaagcggcagaacgcaagaatgtcacgtttgaaagtatcaggcaaggagggagtcatgagatattccaactcgatggacttatgattccccatcccacgtcataacgaaatcgacaacaacctcgcgaacatcatttgtaaggaagcagaagccaaactcgggaaaggctggtatcagcagtgaaaacatatcaggtcatcgttcgtcctggcgaaaaatactggattcttgagattcccggtatcggtttcacgcaggcaagaacaacagcagagattgaaagtatggcacgcgaccttatcaccgtcatgacacaagatgctgatttcgcactcaccgtagagacaaagctgccgcaatccgtgcaggagcatcttgatgaagctcggcgactgcgcaaggaagaagcggaatgcagatcgaacgcagcgcgggaaactcgcgccgcagcacaagaactacatggcatgggtctcgccctacagcaaataggcgatatactcggggtctcacggcaacgggcacatcaacttgtcaatgcttagcatcaatcggctaccccacaatgcaatcaccgcagagacgcggctagcgccactttcccgggattgttgcgctagcatgcccgaaaccccctctatcagcgcaacattcccgggaaagtggcgcgcaaagagtgtcaggcgcgtcgctcgatgagtgcgcggccggatgcgaggcggtcgagcacaccggttttggcgatggccagcatcagataccaggccatcacgccgctgataagcacgccgccggtgacctcggaaatcatgtgcacaatgccacgcgggctgacgaatgacacacccacgtagcgaaacagcatcagatatgtgccgtattccaaggcgaccaacgcaccggatgcaatggaaatcggcagattgaacatgcggtaacgggtcaaggcgaacggaatctcagcgaaaacaccttgcaacagcgccgagataatcacgaagcccaaatcgaactggctaccaatcaccgtttcgaccagcgtgccgataaggttcacgtacagcgccgctccgggtttgcgcagaatcagcaccgccagcgtaccggagaagtaccagacggcgtgcacgatgctggcgaaaccgggcagaatcgcgccgaataccgaagagatcggcatgtacgcgaagttgaatccccagaagatcacgccgcaggccgcacccagcgtggcaccgaccgcgatatccaacggctgccatttcagtgacgatacggcaatcggacgtttcggaagagtatgaatggtggttgcaggcatggtgatctcctagccttaaaggccgcacacagtaatcgaaccacgggcgttccttgacctgtgcggctcgggcgggaacgccgcaccacagtatagccgctcggttcacggctggaagtacccttggaggttatgaagcttaccgatatttcccccgcaatcgcattgaccccactcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtgcacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctccctcacccacggccagccggccacaccgaccacgctcggcaaggagctcgccgtctacgtctaccgtctgaaccgtcagctcaagcacatcgaaaaccaggagtacttgggcaagatcaacggcgcgaccggcacgttcggcgcccacctggccgcatgcccggatgtcgactgggtcgccgtctcccgcgaattcgtcaccaaccgcatgggcctgacctggaacccgctgaccacgcagatcgaaagccacgactggcaggccgagctgtactccaccgtctcccacgccaaccgcatcatgcacaacctgtgtgtggacgtgtggatgtacatctcccgtggagtgttcgcccaggtgccggtcaagggtgccactggttcctccaccatgccgcacaaggtcaacccgattcgtttcgagaacgccgaagccaacttcgaaatcagctgctcgctgctcgacaccctctccgccacgctggtggaatcccgttggcagcgcgatctgaccgattcgaccacccagcgcaacatcggttccgcgctcggctactccttgctcgccctgaccaacctcatgggcggccttgagtccatccacccgaacacccacgtcatcgagcgtgagcttgatgagaactgggaggtgcttggcgagccgatccaaaccgccatgcgcgcctgcgagctcaagggcctgccgggcatggacaagccgtacgagaaggtcaaggagcttatgcgcggccacaccatcaacaaggaacaggtcgagcagttcatcgaccagcagtccttcgacccggaaaccgccgctcgcttgaaggctctgacccccgccacctacaccggtgtggccagccagctcgtcgctttcgaccgctgaaataggtgcgatgcgagtccctcgagcccatcgcatccaccacactactgcgctgagtcacaaaccaaaccgcaaactgaaccgaacaaggacaggcgtcaggtaaccatttcatgactactgaacaggagcagtccactacggaagatcgcccggacaaggcgacctcctccactaccgaccggccgatcgcctctggtgacggccggtcggccagttttgctgtcagcggaccggacagcccggcaaccgacgacagcaacgattccggaccgtacatcgacgacatcgctccgcgccgcacgcgcgacttcggcgatctgacccgggccggtctgtcgctgttgatggccgccgtggtcatggtgttcgccgtgtatctgggcggcatgacgcgcggcgtcgaatccgacgcacacaccgcagcccaggtcatcaactggttggctgacttcccctccaccgtgctgacgcagctggccaccatcgtcatcgtgatcatcgtgctcgctcaattgctactggcccgggaatggctgcaggccgcggtgtccgcgctggccatgttcgccggctacggcatggtgtgggtcgtatcgacggcaatcagcagtctgaacgatttcaccctgccaatggcactagtctcagccgccacctcatacggctccgggctgttgcccgacatctacgccggcatggcgtccttcctgaccgccgccgggccacgccgcacccgctccacggtcaaatggagctggaatatcctgtatgccatcgctgcggtgatggtggtgctgtcgtggcattcggtcaccggcatgctggtgtcgatggccgccggccgcacagtgggcatgctgatccgattcgtggtcggcacgcagaacaagggcgtgtggggccaagatctggtcgccgccctgaaaggcatcggactggacaccgcctcgctgattcggcatcaggagcccggcgtcggccacggttcactggccgtcacgctggacgacgatctggccgaaggctcgcgcatctacgatctggataccacggacaaccgtcgtttcatcgtttccgtcatcgacgcgcagacccataccgtcggctatctgaagcagttgtgggactgggtgcgtttcaccagtgtgtccatccgacgtgaccgttccgtgcgtgacgccgtccagcatcatttcgccatgctgctgggtctgcacaatatcaaactgcccgcgcccgcaccctacggcatcgccgataccgacgaatccgcgattctggtgctggatgcacacaccatcgagctgcccgccaacctgaacacgcttaccaaggcggatgccgtggcctacatgcgctacctgtccgtggcgagccggcgcggctatacgcaccggcgcatcacgccggacacgctcgcccggcttgaagacggcaccgccgtgattgccggctggctcaacggcgacaacgcttccggtccggccaacaccgcgctcgacaaagttcagctgctagtgctgttcgccgcgctgatcggcgtggaaccggcggtggaggccgcccgcgaggcgtggggagacacgactctgacggccttggccccgttcattcagaaggtcgcggtcccctcccccacgcgcgcgctggaatcctgggacaagcagctgctcaagggcctgaggagtcgtatcaccgcgctggctgacgaggagacggtggaatccgccgaaccggtgacgctggcccgattctcctggcgttcgatgatcaccatgctgctggtcatcgtggccgtggtcgtggtcttcacccaactgaagcccgaggagatcatcaccgcgctgaccaacgccaacccgttgatggcggtggtgacgctcgcgttcggtgtctgcggctggatcggctcgtcgatttcgctcggttccctgatggcgcggcacaagcgtgacaatatgggcgtcttcatgagccaggtggcaggcggcttcgccaccgtatccatgccagccggcgtgggcccctcgttcgtcaacctgcagttcctgcgcaaatccggctatcgcaacacccaggcgaccgcaattatgagcgccgcgctcgtggtgtattacgccgtgtacttctccatgctggtcatcatcggcctgttcaccggccgcaacatgttctccggcgcaatcccgacaaacacgttggttatcgtgctgggcgttgtggtcgtggtgctgtccattgcgatgatgattccgccgttgcgccactgggtgacccgtcgtcttatgccgctggccaagacgtatatcaaccagctgctggacgtgctttcccagccccgacagctcacagtcagctgcctgggcgcgctgttccagaacgcgaccactgggctcgctttctgggcggccctgcaagcgttcggccattcatcgaatccgattgaaacgacgttcgtcttcctgctggcctatgcattgggttccgcagtgcccactccaggcggtctgggcggtgtggaagcggcgctgacattcgcgttcgtggcggtcggagtgccgcagggcgtggcgctttccgccactttgctgcaccgcgtggtgttctactggctgcgcattccgctgggcgcggcggccatgaagtggcttgacaagcataatcttgtctgattcgtctattttcatacccccttcggggaaatagatgtgaaaacccttataaaacgcgggttttcgcagaaacatgcgctagtatcattgatgacaacatggactaagcaaaagtgcttgtcccctgacccaagaaggatgctttatggcatacaacaagtctgacctcgtttcgaagatcgcccagaagtccaacctgaccaaggctcaggccgaggctgctgttaacgccttccaggatgtgttcgtcgaggctatgaagtccggcgaaggcctgaagctcaccggcctgttctccgctgagcgcgtcaagcgcgccgctcgcaccggccgcaacccgcgcactggcgagcagattgacattccggcttcctacggcgttcgtatctccgctggctccctgctgaagaaggccgtcaccgagtgaccttctgctcgtagcgattacttcgagcattactgacgacaaagaccccgaccgagatggtcggggtctttttgttgtggtgctgtgacgtgttgtccaaccgtattattccggactagttcagcgcttccataagctgctcgaatcccagggtgggctcggcctcgaagggatcgaggagtatggcttcccggcgttcgggagcggtcagggtcaggtgggtccagtcggcggagaactgggccccgacgttcagggccgcgtccacgaaccggccacgcagggcggcacgggtgtcggtcggcggattgtgcacggcgtattccacgttgtctcctgtcagcagctcacgcatctggttgcgggctacgagcgaaccgtacaggcgaccgttggcgatgtcgtggtagtcgagctcaagctgttccatctgggcgaaggtgacgtccgggcgacggcgtttgagcgcgtcgaacagacgcttcttggcggcccagtccacgcggtcggcgagcgcatcgtatgtaccacgctccagcgcgtccagaacgcggctccactcccccataatcgtgtcgatcgtggtggccggcagcgaacttgccagcgcatcgccatgggtttcgatgaaggccttgaccgccgcataataccggcgctgcagacccagtgcggacacggattcgcctgattcgaacgtcagttcggcgcgcggattgtcaaggaatcgactgaccgtgcgattggcggcagccggatcagcaaaggcatactgctcgaatccggacggaacgccatggcggaaggcgtcttcgatcgcgcacagcacaaggtgcgtgacggcaagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcgcgctgggtgatctggaagccgtccggggtcatgcggccggcaccggtgtacagctggcgggtgatgaggaacggcagcagctggtgttcgatggtctccaacggcacgaagcggcggaccaggtagttttcgtggcagccgaaggcgtggccggcggagtcgacgttgtttttgaacacatggatcgtggcgtgtgcgccgtaggattcgcgcagcttgcgctgggccttcagggctaggttgcgcatcacgtgttcgccggcgaggtcctgggccagggcctcgcgcgggtcgcgcgcttcggcggtggcgtattcggggtgggatccgacgtccagatacagacgtgagccattggccagatacgtgttggtggagcgggaacgggagacgatgggctggaacatggtcatcgccacctggccggcgtccacggggcgttcggcaccggtgaccgccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggcggattcgatgtcgtcgaggatgtcgtccaacacgtcggcttggtcggtggactcggtttgggcggcggcctgcgtggtggcgagggcgtcgtcttcctgggtcgcggcctgctgtgcttgaggttgttcgaattgttgtggcatgttgtcttctttttgggctgtcaaactcccctcagtcagccttcggccgacggctcccctcacccgaggggatccggaggagtcaaaaaattatcgctggttgatggagtcgagccacggatactgctgcaggtaatgctgcagttcgcggatgatgagtccattggaggccactacatcgttatcgtgacgccagtggatgcgttcgccgtcccaacggctcagcgtgccctgtgcctcccagaccactacggtgccggcggcgatgcccgcgatatcccacacgtgcagcatcggctcgaagtaggcgtcataggtgccgtcggccactttgcacaggtcgagcgagacggggcccacgcgcttgatgtcggccgggcgtccggcgagcgaggaggccacgtcgagcgcacgctgcgattcgctggggatgaaggacatgccgtagctcagcacagaaccatccagcgaggaggtcatcgacggcacgaccttgtcgcgcttctcgccgaccgcggttttgtggatgcgcacggcacccgctcccctggcggccaggtaggtcaggccgagggccggggcgtgcacgatgccgatgatcggcttgggctcgttgtccgggccgaattcgaacagggcggcggtcaccgtccattcgctcatgcgacgtacgtagttgatcacaccgtcgatcttgccgatgtaccagtaacgctggccagggcggctttcggcggggcgggtggtccagaagccgtcgaagtgggcgatgtcggcgattctggcgctcatgaagcgcatgatcttgttgtccacttcaagcttgtagcgggggccacggtccgcgttctcggtgctcggctgggcgaggttacgcggattgagttggtcgtggagggcatgctggccggcttcttcgagcaggccggcgactttgagcgcaaggttgcgcaggtcctgtggggtctcttcgcgtgtttcttccatagctaccaagtctatcgttcggcgttgatggccagcgacttcagcagatcgatggcgtgttcggctgaattgagttcggtttcgcagtgcgccttggtgaaggcgagcggatcggagatgtcgagggagaacaggtgatggtcggtagcggccatatggccggcattgccgtagaattcgaccgcctcgccctcgtctgcggcgcgcgggtcgcgaacagtgagtcgggaccagctggcggcggccacctcatcgccgaattgcgccacgagttttgccctgagccaggcgcgggtgtcttccggcggttcggtggtggcgcgtgcgatgtcggcggcgctcaccacccgttcggtgcggggttcgagtttggtgaagatgctgtccgcggggtcgagcgccgcccatttcaggtcgatgaccttcagtcgcggatcattccatccgttggccacgccgggtgcggacgttgtggtgattttgcggcgcagtttttcgagcagctgccatttgagcagccattcgatgcggctggcctcgccggtcatggccagacgttcgtcatcgtcggcggcatggcggatggaggcgcagtcgatgagcgcctgctgccacatcgccataatggatgtggtggatttgtccggccaggcgggttcgccggcggtgtcggtaccttcgaccagtgcggcaacctggtagacggcttggcgcagtttgagctggataagccatgcgttggtttcgccgccgttggccagcggcaagattgcccccagcgtcaggtcgcgggaaacggtgtgtatggcctcgactgggtcagacagttcgagttcgtcgaggaaggcgttcaggtcgaatccggcctcgtccgcatgttcgagcagccacagcagcatgctcgtggtgccgagtttcagtgcctgcggcacctccatgcgattggcgtcgccgacgatgacgtgcagacggcggtatgcatcggtggagtgggattcgtcgcgcgtattgatgatcgggcgttcgaaggtggtttgcaggccgactttggcgtggatgtagtcggcgcgctggctgagctggtagcccgggatctcgctgttctcgccaatccctacgcggccggagccggcgtagatctggcgggtgacgaagtggagggtcatcaggcgtgtgaccaagtcgaatggcaccgcgcgggccatcatatagttctcgtgcgtgccccagcaggagcccttgccatccacattgttgcgatgcagggcaatgggagtgccagtctgtttgcgggcgtgttcggtggcggcctgcatgatgaggtctccggcgtggtcgtatcggaccgcttcgaacgggtcggtggtttccggcgccgagtattcggggtgggcgtggtccacatagacgcggccgccgttgggggcgatcacgttggtgatgttgagctgcggggcgtcggtgagcatgtccgggcgggcggcggcgcgttcgagacgggtgccgcgcgcgtcgttgaccgggtcctcctgccggtagtcccagcggatggatttgctgtggctgtccgcggcgccgttcaccacgtcgaaggacagttgcaccggattgtagcggtccggggtgttcagggataccgcgtattcggtttcggtgcccatcactcgtttaacggtcatgtagtgctccttgagcttgagctattcggcggtgcggatgcggcggatcgggtccatgccgttgatgcgcgaccattgttcggggtccacgtcggccatggaatcgcgggtctcgcggtattcgtcttccacggcggcagcgagcagcggcacggtgagtgccacgtccaagccggtttcgatggattccttgaccgctcgggtcttggcccggtccacgatgttcttgagcatcgcgccggagaccacgtcggccaggaacaacgcatgccactggccgttctcctcctgcacgtcgcatagatggcggcgttcggaggttccgtagatgtcatgcaccagcacggcggacaaggcgtgcgcgtcgacgccatcttccagaggcaggtcgtcggtgaggtaatggtccacgatggcgatggcctgattggttttgggccgaccaacgcgaatcttgacgtcgagacgccccggtcgcaacacagccggatcgatcatgtccacgcggttggaagcaccgattaccatcacattgtcgagtgattccacgccgtcgagttcggagaggaactggggcacaatcgtggtctccacatcggaggagacgccggagccgcgggtgcgtagcagcgaatccatctcatcgatgaacacgaccaccggattgccgtccgcggcgcgttcacgggcgcgctggaaaatcaggcgaatcagtcgttcggattcaccgacgtatttgttgagcagttccgggcccttgacggacaggaacacgcccttgacatgggtttcggccggactgattgcgccgtcgccattcgaatcgtaaccaccctcgcatagggcgttcgccacggccttggcaatcatcgtcttgccgttgccgggcggaccgtacagcagcacgccctttggcggcttcaaatcgtagcgctcaaacagcgcacgatgctggaacggcagttggacggcgtccctgatacgaccgatctcactatccaggccgccgatgtcggcgaacgtgacatccggggtctcctccagcaccagatccttgtcgccctcggcgggcagcgcttcgatggcgaggcggacggacggatcgacgataatacggtcgccctgattgatgcccgcatacgcgagcgcgccggaacggcggatgagcacgggattgccggaggcgtcggtaacgatcagtcgaccgtcgtcaagtacctgcttgacactgcgaatctggcccacggtgtcagcatcgcgctgctcgaccagcacgagcttctcgttgagcatcacggtggccccggcggtcaggcgggcggcgttgacgttggaggccacaggcaccaccatgcggcgggtgccggaaatgacttcggccgacgcgtgctggatgccgtcttcatcggtgcgggtggaatcgaccttgaccatggtggcgaaggtgagcggcggctgagcgagctgggcgagctgtgacttcgccttggtcagttccttgccggcgcggctcagcgcttcggcgagcgcatggttcttggccatcaggcgatcgttcagcgcggcgagatcttcggtgtcgctcatgcgggttcttcgcttcccttctatccgggattttcggcaacttatggcagtcggcagaccctattcgttgccgtcggcggatttcctgttacgtataacagtacgcacttttcgcaccacgaaccatacgatgaccacaatcacggccgcgatgaccacgtcctcgaacacgccgagcgcgccttgaatcgagcaccactggtcgccgagcaggtaaccggcggaaacgaggatggtgttccacacggccgagccgagcagggtccagccggtgaagtgcaggaagttcatgcggttgaatccggcgggaatcgaaatcagcgagcgtaccacgggaatcacgcggccgatgagcaccgaccatgtgccgtatttggtgaaccagtcgttggctttgctcacgtctttgcggctgacgccggggattttgtctgccgcgagattgatgcgatgcaggcccacccagcgggagatgccgtacaaggtccaggcacccagtacggagccgatggtggcccagatgattgcgcccggcagactcagggtgccgcgtgcggcggtgaagccggagagcggaaggatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggtgtggggtcggttgcaagaatagtggcggctgccatggaaaaactcatagagggcattgtcccaaggttttcccagaatcagaagcatgacgcaagaagatgtgcattttgttgacaagtccgccgagagcgaagttgggagcccggctgattctgcggtttctgtgccgacgctgagcaagcccggcctgctggttatggatgtggactccacgctcattgacgaagaggttatcgacgagttgggcgtggtggctggctgcggtgaggagattgccggagtgaccgcacgcgccatgcgcggcgaactggagttctgcgatgcgctgcgcgcacgagtggccctgttggagggcctgccgatctccgtgttcgacacggtgcatgacaagctgcatttcaccaagggtgcgctggagcttatcgacacgctgcatgaacacggttggaagatcggcgtggtgtccggcggcttccatgaagtggtcgatatgctggcggccgaaggccatatcgactattggatcgccaaccggcttgaggttgccgatgggtgcttgaccggcaaggtgctcggcgaaatcgtgagcaagactgtgaagttacacgccttgcagacatgggcggaccgtttgggtattccgatgagccagaccgtggctgtgggcgatggcgccaacgatattccgatgattcaggccgccggtctgggtctcgcgttctgtgccaagccaaagacccagctcgccgccgacaaagccatcaacgaccgcgacctaacccacgtgctcgattatctgcgccggtaaaattttaccgacctcggctccggcacttatagttgagccatgactacttcaggcgcagaacagttgacgcttgtggggctggctccccgcaaacggcgtaaacgtgcgtctgcggagcatacgccggccgagcagcatcccatagcgcaagtcgtgttggatgtgcaggcgctccacctcggtcagacattcgattacttcattgatgaaaaagacagcgaggccgcacaaccgggtgtgctggtgcgcgtgcggtttggcggtcaaagggtcagcggtgtgatttgggcacgcaccgataccagtgatacgccgcgctcttcgattcgctatatcgaacgggtgttgagccccgatgtgctggttcccgcttcgatgcgtgaggatatcggtctggttgccaaagcctatggcggcacacgggccaatattctgcgtttcgccgtgccaccgcgcgtggccaaggtggagaccgagcagcggttggccgcgtcgttccgtcggccggtcggcggctcattgccggataatacgcaaggcggttttgccgggcgtggcaccaatcccgatgggaccaaacttgctggctctacctttgccgttgctagcaccgtttcggagggggctgcgcaggggtatcgtcgtctgaccgccaattacgccgatgtcaatgtgcttcatgatgcgcttaccggtcagcgtttccaatcttttgtgtttgattcgttgcccggtgcacaggagtggcaacggaacatggcatggatggtggccactgcgttgagtgccggtaaggctgccgtggttgaattgcccaccatgcgcgaggtcgaagacctgatgcatatgctgcgcaattatgggctcaaaccgttcgcccctgctccggccggcggctgggtgggcgacgtcgccgtgcttaacgcggagaccatgcccgcggccgaccggtatcgcacctatctggctgtggcgttgggacaggtgaaggtggtgatcggcacccgtgcggtgatgtatgcgccggttgaaggcccggcgctgttcgccattctggaggatgccgcctatcagaacatggacggtatgatgccatatccacaggcccgtggcgtgatgcggctgcgcgccaagtcccatggcggcgtgttcgtggccatggccaatgcgcgcaccccgcaaagccagtgggaaaacaccggtccaggtacagtggagaccccagtgagcggctattccaccacaattcatccgctcgcctcgccgctgaaggacgccactccttgggtgcgctggctcaatcgcgatgaacttgcgcgtcttgccgacccgtccatcggggcgcgcgtgccgcatacggccgtccgcgtgctatctaaggctttggagagcggccccgtgctgctgtccattccgcaagacagcgtcagtgagactctgagttgtgcgaaatgccatcgtcaggcgcgttgtgccaagtgttctggaccgttgcaactaccggccgaccgccgggattccacaccgcgatgccgctggtgtggggctgctgccatcaattggaagtgcccgggctgtgggcatgaacgtatgcgtgtggtgcgcgtgggtgctgcaggcactgcggctgaactggccgggttgttccgcggcgtgccagtagttttgtccagcaagacgcagggcctggtgcgcgatgtggcttgtcagccgatgatcgtcatcgccactcccggtttcgaaccgcgcgtgcgtccggtcagtgccgagcagggatcggctggccatgagtatcgtgccgtggccgtgctcgacgcttggaccagcttgtatgcgttgggcgtggatgctcgcttggatacattgaccgcgtggatgcgtgcggtgtcgttgtgcgcgccgcgttcccgtggcggccaggcgttgattctcggcgaaaccgacccggccatcgcccaatcgctgatgctctgggattcgaggattcttgcagccaaggatcttgaggagcgtgtggagaccggtatgccgccggccgtggccgccgcctgcgtatggggacgccgtgatgcggtgatgacgctgatgcagcgtatcggcgccctgggcggcgattggacggcctgcggcgagctgcccggcatgttgggaccggtgccgatcgcgcaaccggacacggttgatgccagggagctcgaagccacggccgaccgggtgaaggcagtaatccgtgtgccacagagtcggcgagccgaactggcggcccgactgcaccgggaaaccgctcgtcatgtagcgtcccgcgagcccggcgagcttcgcttccgagtagatcccaaagatctgatctaatcgtctccaacacgtgaaacgatgattacagaacgaacatcgctataaggaggacaccatgaagggttggcccggagagccggatatggattacgacgtgctggtcgcggacggcgaagccgccgcgaacgccggcaagccgatcaccgacgtgatcttcgatttcggcaacgtgctgatttactgggatccagtggccgtgctcatcccccgctacagccagaagaccatcgacgaattcctcgacaacgacatctccggcttctacgatgtcaacgacctgatggacggcggcaccagcaccgacgaggccatcgccatcatgcgccgtgacaggggcgataagtgggcggacatcctcgactactacatcaagaacttccgcgactccctgaccggcatcgtgccgggcgcacgcgtgctggtcaatgacctgaaggccgccggtattggcgtgtggggcctgagcaactgggaatccagccttttccacgtggccgaggaacagtgcgatattctgcagcagcttgatggcaagctcgtctccggtttcgtcaagctgcgcaagccgcacaaggaaatctacgaggccgcgctcaatcagttcggtatcaaggccgatggcgcgttgttcatcgacgacaaggccatgaacatcgtcggttcgaatgcggccggcatccgtggcgtgcgtttccaggatccggtcaagctgcgtgaactgctcatcgccaatggcgtgaacattccggccgtgcagtgagcatcgacgttttaaggaggaccatgctcaaactcgtgttcgccggcacccccgatgtagcggtgccctcgctcaaggcctttgccgccgatccacgttttgatgtggtcggcgtcatcacccgccccgacgcgcctaccggccgcggccgcaagctcacgcccagcccggtcaaggcgacggctctggagctcgggttgcccgtcatcgatctcaaaccccgctcccccgaattcatggaagcgctgaacaacctgcatgcggatatcgccgcggtcatcgcctatggcaatatcctgcctaagaacgtactcgacgcagtgcccatgggctggtacaacctgcatttctccaacttgccgaagtggcgtggcgccgctcccgcccagcgtgcgatttgggcgggcgacccgaccaccggcgccgacgtgttcaaggtcggcgagggtttggacgatggcccgatcgtcgcttccctgaccatcgagctgaccggccgtgagacctccggcgaactcctcgaccgtctggccgaggaaggcgcacccatgtatgtggatgccttggccgccgtgggtgaaggcactgccacattcaccgcgcaaccggccgaaggcctggaatacgcgcacaaaatcacggtggaagatgctcgtatcagctggacggacgaggccgaggccatcgaccgtcaggttcgcgcctgcacgccacatcctggggcatggaccgaactgtttgcggaggggccaatcgccgataatgacgagccggccgccaaacccctcaccctgcatattctcgccgcgcaaccggccgaccagtccaatcccaacactccggccgagcttcagcccggcgagctgaaggtgagcaagaagaacgtgtgggttggtaccggcagcacgccgctggaactcacccaagtcaaggcgcagggcaagaaggccatgcgcgccgccgactgggcccgaggcgcgcgcctctcccccgccgcctgcgtgcgataacaagcaatatcgctcccgcccggaagcacagcaaaaagcccggcatcttcgcgaggaagataccgggcttttcagctatgcaatcggcgatcagtcgagaccggagagcttgttgatcagctccgggtcacgcgtcgcacccttgtcggccgagcgggcgaaggcggcgtacgccttcagcgcctgggagacgtggcggttgcggtgagccacgtagccgtcgccagcctcaagctcgcgacgacgctcgtccagctgctcgtcagtcagttcgacgttcacggaacgggcttcgatatcgatatcgatgatgtcgccgttcttgataagcgccaccggtcccttattggcagcctcaggcgccatgtggccgatggccagaccggaggaaccgccggagtagcgaccgtcggtgagcatggcgacctgcttgccgatgcccttgcccttgacgaaggaggtcgggtacagcatttcctgcatgcccgggccacccttcgggccttcgtaacgaatcacaagcgccatgccgggcttcagggtgtcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcgtgaatctccgggtggttgatgtcgtggatggcgccgttggcgcggtcacggtcgagcgaatcgaacagggtggtgtgggtccacggctccggggagatgatgtggccaggagcggccttgtacatctgctgggcttcctcggtgcaggtcgggcgcatgatgtcccaatcggccagcttggcttccagcgtcggatagtcgatggagtgcacgttggtgtgcagcttgccggcgcggtcgagctcgccgaggatgccggtgatgccgccggcgcggtgcacgtcggaaatctcccacttgccggacggcgaggccttgcagatgcacggcacggtgtgggaaatacgctcgatgtcgtccagagtgaagtccacgtcggcggactgggccatggcgaggatgtgcagcacggtgttggtggaaccgcccatggccacatccatggtcatggcgttctcgaaggcttccttggtggcgatggagcgcggcagcacggaatcgtcggaatcgtcgtagtactggtgggcgatcttgacgacctgcttggcggcacgctcgaacaggtccttgcggtaggagtgggaggcgaggatggtgccgttgccgggcagggccaggccgatggcctcggtcaggcagttcatcgagttggcggtgaacatgccggcgcaggagccgcaggtcgggcagacggtcttctcatagttgagcagttcctcatcggagacgctgtcgtcggcggtggcgtacatcacgtcgataaggtcggtgctcttgacggtgccgtcggcgagcaccgtggtgccggcctccatcgggccaccggagacgaacacggtcggaatgttgaggcgcagggctgccatcagcatgcccggcacgaccttgtcgcagttcgggatgcagatgagggcgtcggcgcagtgcgcgttgcactgatattcgacggtgtcggcgatgatgtcgcgggaaggcagggagtagagcatgccagtgtggcccatggcgatgccgtcatccacggccatcgtgttgaactcgcgcggaatgccgccggcttccttgatagcctcggaaacgatgcggccgaccttgttgaggtggacatggccgggcaggaactcatcgaacgagttggcgatggcgatgatgggcttcttgcccatgtcgtctccgctgacgcccgcagcacggtagagggctcgggcgcctgcaaagacgcgccctgacataatttttgcagatcgcatttcagtcatggttctattcaagcctttgcgagggacacgccatttgtcaagagtcgaatagtggaattttcaaaaacgtaacgtttctcacagttttttttggaatacattcctctggcgagagtccggtatagggctgacagaagtccccccaaacggctacacttgcttcggttgagatagattttccaatgtctggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacatcggcccgctggtcgaataccagaacaatgagaagcccctgtccatcgccttccgcgaaatcgacgagggcctgcttgaggagaccttgggcgaggacgacgccaacgagggcaactgatcgattccgacaattcgtttggattgtttggacagttcgtcgccgaatgatggtgtgagagttctctcacaactgattttgagcgacacgcttgcctgagttatcgcaatcggctataactcaacatcgggagcgaataagacgcaaggctcgcgccaccgcgctggttggcacgagcctttatttatgcccgcttccacagtgacaagtaaaaattgacaccgtatcattgtgcctcgcatcccgcggggcgataagtcctgaagaaagggatgatatgacagaagaacatcggcttatttccgccgaatccgtgaccgaaggccaccctgacaaggtctgcgatcaaatctccgacgccattcttgatgatttgctggcccaggattcgtccagccatgtggccgtggagacctccgccgccactggcgtgttcctgatcttcggcgaagtcacgtccaaggggtactgcgacgtgcagtccaaggtccgcgaaaccctgcgcaacatcggctacacctcctccgaagtcggccttgacgccgattcctgcggcgtggtcgtggccatcaccgagcagagcgccgaaatcaaccagggcgttgcccgtctgactggcgatcaggagaccgccgccagccgcgaagagcgttacgaagcacagggtgccggcgatcagggcgtgatgtttggctacgccaccgacgagaccccgacgctgatgccgcttccgatctacttggcacatcgcctcgccttccgtctgaccgaggttcgtaagtccggcgaagtgccgcacctgcgcccggacggcaagacccaggtaaccattgagtatgacgataacgataagcccgttcggctggacactgtgctgatctccacccagcatgatcctgaggttacgcaggattggcttgctgttgagctgaagaagcacgtgattgacccggtgcttgatgaggtgctgggttccaaggtgccgcatgacaactaccgccagctggtcaacccgaccggttcgttcatcctaggcggcccggcggccgacgccggtctgaccggccgcaagatcatcgtcgacacctacggtggcgccgcccaccacggcggtggcgcgttctccggcaaggacccgtccaaggtcgatcgttccgccgcgtacgccacccgttgggttgcgaagaacatcgtagctgccggcttggctcacaaagtcgagatccagatcgcctacgctattggcgttgccgaaccggtgtccgtcaacgtggagaccttcggcaccgagcagggtgtgacgcgaggccagatcgccgccgccgtgcgcaaggtcttcgacctgcgccccgccgccatcatcgacgaactcgacctgaagcgcccgatctacttgaagaccgccgcttacggccacttcggccgcacagacgttgagttcccgtgggaaaagaccgacaaggtcgaggagctcaaggccgcgattgctgcggagtgatatcgactagtccaagaaggggtgtttccgctgatgccagcggaaacaccccttcttgtatatgagtctagtgctcgttcttcgtctcgctttgtccatccgtattgtcggtatcatcgatgtcgaatccgcccatgagtacgaaacgcttcaacatattggtggcgcgcatacgcaccttgaacaccggcaatgccttgtgatcatgctgctcaaagaaggcttttgcccgttgcacgtcaagcgaggaacgcagtgcatcgaaacgtccgaactcgttgatgttcgcctcgtctatacgtttggcaaggaattcctcgaccaccgatctgttgacacccaatcgatcgaccagtttgtcgacttgctcattcttctcgcgtgcagcatagcgcgtgatgtaatcacgtagcgtcataccggcttcgacctccacgtcgccacgctccacgtcatgcaggaacagttcagcgagtcgttgttcatcccgcgagagcgcggcaaaggaccggtgcagctgcgcagacatctctgccaactccgggctattctccttgagcgccttcagccatttatcgaagttggcattcatgtaatcggtatcgatgagtccggtatcaatttcggtgaggtaaccatccagttcatatggcgcttcaggattatcgttcacatcatcatctgggtcactaccgcgatcgctattgccatcgaacagttctttatagcgttgcgcaagaatgaggtacgtacgttcgtcaatttgaggacgcaccacttcagactcgccatgctcatcattgtcctcattcgtatcgtcagtatccgtgctatcgaccttgtattccgtggtgctccagtcaaagccctgcactttcgccgcttcaaggtaccgattcagttccacgaactccttggcaaacttacgtctagcctctaccgactccggcagctgcataaggtccgattctccgctgtctgagaatacgtcgagaatctcacggtaccgagtatccatggatttcacattcgctggcaatttctgtacgaacaggtcgagcggtcgatcacccgaatacagtttcacagctgcctcgatgaaaccatgcatggtgtacggcttacggtaatagcggatgacgccaaacggcttatctgggccaaacagacgattcgtacgactgaacgcctgaatgatgctttcgtagtcgataatcttatcgagatacagcgtattcacccatttcgagtcgaacccagtgagcatctggtctacgacaatgagcaaatcaagctgctggctgcggttcgttgctataccaccatacggactcttgtgcgacagtcgcgaagaaatatccttcttcatcgccggccatgtaggaatgacgaattctttgccgaacgcctcgttgtaatcggtgatgatttcggtcagcgcatcctctttgtctgtcgctccttcgttgttgtcgatattgggatcgaacaacgccgtcacatgcaacttgggtgcctgctgcttgaacaagtgataatagttgacagcttcaggaatggaactggcagcgagcatcgcatggaatttgcccgcatggctgagcaccgggaactgttcaagaatgtccgagaccaccatactcgggtgcggagagtcgataccatattggtctcgtcccaggaaatcctcgatgccactgatgcggttcccggcaccatcaaccatcggacccatggggacctcagacttatccatgtaatgctggaatactttggccttgaccgagtcggcgagcgcatcttccgcactctccgccttcgccttgtcgagagccacggcacgtctgacttcagaatccttgtacgtggtcaccatgtacgggtcgaacccgagcacattatggtcgcgaatgccgtcggcaatgctgtatcggtgcaaacagcggccgaataccatggcagtggtggaattcttcttttggttctcatccagaatgggtgtgccggtgaagccgaagaacagcgcattcgggaaggaacgacggatgtcctgcaacatgtcgccgaatgtggaacgatggcattcgtccacaataaaaacgatacgtcgtgcagccagctgatccagccacgcctgggtgacgccccgctcccctgctttcacgttgctcatcttctggattgaggtgacgatcagggtgtcgttgacattggtgctgttgagtttgtcccgcaaaacgccggtgttctcagtaccttgtacttccgtctcactgtcagcaaaactgcggtattccttcagtgattgggtgcctagctcgatgcggtccataaggaacacgactttatcggcgtcatgcgaatcagctatgagttgtgccgatttgaagctggtcatggtttttccggaaccggtagtgtgccatacatagccgcctggtcgtcccggggtagttggccgctgttcccaatcacatttcctcaccacatcggaaatggcgtttgccgcgatgtattggtagctgcgcagcaccttaagacacccatccgctgaatcagcaatggtgtagaagccgatgagctgatgcgccatgggaatggacagcaagccggcggtgccggaagtgccgccgatgaacagcttccattcgtctttgccggggttttgcccgccgcagataggctcgttgttgtagtcagcccaatggaagtaatagcttggattgaatttgtctacgcccggattggcgaagtagacggcgtcatcggggttcatggccacaaaaatctgtactagacggaacaaaccggtgaacacaccttcgtgcgcatatttctcgatctgattggttgcttggctgaccggtatgccacttttcttgagctcgatatggatcaatggcatgccattgatgagaagcacgaggtcgccgcgccgcgagttcaacatcttgttcttggcgggatagaccggttgctgagcgatctgataggtgcttttgccgcctgcgatttccttgcggtcatagatgtagaggctgatttccttgccgaaatgcgccacatcttctttgttgtcacgcgtgatggacacggtacgcccattgacgaacgaattgagcgcgagcggggttcgtagggtctcaatctgctcgattatctgtgccatttccccgtctgtcagcgggtatttgccaagcctgtctatgtcgttgttgttgcggtacagtatgcctttccaattgtcgagcaaatcccgctcagttggatagcgcaggacaccgtccttccatccatgctgcttaagcacggtgatgacgttttcctcaaacaccgattcgctatcgaatatcatgattcttctctccccgaacttcccagtgtcctgcctttcgcgagccgacgcgcttaagcaatccacacccaatgagtatttcagcatcccttcgcacagtcgctgatgagactcccgcagcacgcgccatatcatcgtatgtcgcgctggggctcttctctacaaaatgaagaatgactcgctgtctctcggttatccgctcattcgaaccatttaactgctcattattgtcagatatctgctcattcgaactatttatctgctcataatcgtcagttatctgctcaccacggatgaatacatgctcattttgatagagcttggcatccggctccaacataagcgtgagcaccgtacgatcagcctcgccgaagctctcttcaatctgcggttcaggaagtcctgcattcgcccatgtggcaaacacatcgggaacacccgtaccagctcgctcgcccacatcgattaggctgaacatcttcatgacaagaccgttgcgcggatcggacaccccgccaagacgcatctgctcaacacccgttcggatatcgcccggattttcgaacaccaatctatcgggtgcgcgtctgaccaccacaccacgcacgccatagtaatcagcgttgaacaaacagttggccaatgcctctcgaattgccttatgcatgggagtgtcatcaacgcggaagatgccattaagtttgaaaggggtcttcagagactcggcaagtttgagattcacgcgaaaaaagaaatcaaagaggttacctgaccacatgccatcgccggaatggacacgatcagtccaacgaatcgtcggatctagagtctcctgataatcaaggaaataatgcggacattcgcgcacgatgtcatagtcgttgccgaacataagcagaccgccgaacgtaggatgaagcttaccgtcttctcggctcaccattgccgcgccaacagcacgcagaaaacgctcgtcatcgagatcggtccaagaactgccctgacgtaccgtacggaaacgattgcgatatgcccgcactgtgtctgtattgaagtcggcaacagtgagatcgtccagcaccttggaatccatcgtctcagctccctgatcccggagcattgctgagatctcctgccgcgtgcaacggtagtcgccctcgccacgccgacggtaggttcccccgaagagatcattattgatatacacggggcgttcgtcacgcggagcgcgcggaacgtgaatagccagcactatcccaccatccgcttcgagcacttcaacttccgattcgatgggcagcacggcgctcaccttggaccggttgctgaccgtgttccaaaagtcctggcgaagatgttccgcttccactggtgtgagcccgactgtttcaaatgtgccgtcttcgcgttctttgacaccaagcaggatgacaccgccataggtgttggcgaaggcggaataggtctcccacatgctgcgtgggagaccgcctttcgctgctttcgcttcaatccggttattctcgcgatatgaggcgagcttcacgatatcgaatgtctccattgctctacctcccttcacacaaacatcttgtcaagcaaggatttcttgatattctgcagcaattccaacttacgctgatgaagggtgatgaggtcgtcgagagatcgcaatgtcatcccgatttgctgctgttccgtttttgaaggaagcatcaattgataatctgcgtattcctgcgcattgacaccaggctgcccggaccgctgcgaggttatggcaacatacttcttgtatgcatcggtcaaggttgcctgataggcgaattcggggtcagcgccttcgccgattcgggcacggataaggaatccagcaaagtagaccattccatcgaattgcctgtacagatatgtttttcctacactcgcgcctgtgcgagcaaagagcagatcgccctctttcagtaaataatctgcactcattgcaaggtcagctaacggcgtcgtaagatcgcttttcgagaactcatgggtttcgtcatcaatgtcggtgatacgcagatatttattttggccatcgtattctgttgcagcagcgttcaagccgtaatcaaatgaagacgcaacgtctcccaacttacgctgttcccaagaactgttagaattacaggaccaacaagggtgttgcacttctaaatagacatcggggagagacttcacaaaatcttcgtgagctagaatggtgcgtggtgcggctggttgtgaatgccgtgccccaagcgagagcgaggagagtagtaatgtccaatatcttccaatggcaattgcatggcgacggcaagacgctggcgcccggcgaggtagtcgagcccgatgaacgtctgacttgggtgcgcaccgccggtatcggcgcacagcacgtcatcgccatgttcggtgccaccttcctggtgccgattctgacgggcttcgacccgtccaccaccctgttcttcacggctatgtccaccgcactgttcctgcttatcaacaggaacgtgctgccgagctatttgggctcgtccttcggcttcattgcaccgatcaccgcggtctccaccgccaacaagggcattgcggtcgccagcttcggcatcatggtcaccggtattctgctggccctggttggcgtgctcgtgcattacgccggctccaaatggatcgacatcatcatgccgcccgtggtcaacggcgcgattgtggccatcatcggcttcaatctggcaccttccgtgtggaccaacttccaagccgcgcccgacaccgcactggttaccctgttggccgtgctgctcgtggccgtgctgttcaagggcttgctgggccgcctcaatattttggtcggcgtgatcatcggctatgtatatgcctgcatccgtggccaggtcgacttctccgccatcggcgacgccgcatggatcggcttcccgaagttccacctgccgcaggccgatttctccatccttcccatgttcatccccgttgtgctcgtgcttgtggctgagaacgtcggccatgtcaagtccgtggcccaaatgaccggccgcgactacgacaaccagatcggcaccgccctcatggccgatggcctgggcaccacgctcgccggcttcggcggcggctccggcaccaccacctacggcgagaacatcggcgtgatggccgccaccaaggtgtactccaccgccgcctactggtgcgccgccgccttcgccctgatcctgagcctgtgcccgaagttcggtgccgtgatcaacacgatccccgccggcgtgctcggtggcgtgaccacgctgctgtatggcatgatcggcatgatcggtatccgcatctgggtggagaacaaggtcaacttcgacaagccgctgaacatcatggtggcagccatcaccatgatcattgccatcggccaattcgcgttcactgttggtggcatttccttcaacggcattgccattggcacgatcgtgattcttgtggcctaccacggcctgaaggccattggcaaggcaaccggcactattgccaaagacgatccggatattttgtagtgtgttttagggctactgggctgtattttggctcagcccttttgcacaatggcccctaccttcacgggtaggggccatttgcgtgttccatggagcggtgctcgccttacgtggtggtaaaacccatggggcggcaaacatcccatggggtggtaaaaccctcatggggcggtaggtgaaaatggctttattctgcggtttcacaatttcttcaaaccgccccatgggcaagttaccgccccgtggggtcataagtaaagagtgggatgacagtgtggcgagcaccaagcaaagtagggggcttacgctaagctcggaaagcttgcgtaatttgcgtaacctttgacatgaaaggccactgtgccccgtaataatttcgatgatcgtgacgattccgctgatttccagatgaacgacagcgcggaatcccgcccccttacctttggcgaacttggcgtacccggaccgctggtgcgcgtgcttgcggcagatgacaagaagaccgcattccccattcaggccgacaccctgcccgattcactggccggccgcgacattctcggccgaggtcgcaccggctccggcaaaaccctcgcattctccattccgctggtcacccgcctcggttcctacgattcgttcggcgaaatcgcgatggaggagttccgcaaggaaatcaagcgccgcaagaaggccagcctggaagagcgccgcgccgacgacttcctaccgcacccgcgcggcctggtgctggcccccacccgcgagctcgcgaaccagatcaacgacgtgctgatgccgctggcccacacgttcggcatgaacaccaccacggtgtacggcggcgtcaagtacatccaccagatccgcgatctgaaggccggcgccgatatcgtggtcgcctgcccgggccgccttgaggacctgctgcgccagcaggcgctcacgctctcgtccgtcgaagtcgtggtcatcgatgaggccgacgaaatggccgatatgggcttcctgccgccggtcaagcgactgcttgagcagatttcgcccgacgcccagcacatgctgttctccgccacgctcgatcacggcgtggatgaagtggtgaacaccttcctgcacgatcccaaggtgcacgaggtcgattcggccaccaccgaacccgacctgatgacccaccacgtgttcgaaaccacgcgcggcgacaagcacgaactcgtgcgcatgctcgcctcgggcgaaggccgccgcatcctgttcacccgcaccaagttccaggccaagaagctcgccaagaacctgacgcagaacggcattccggccgccgagctgcacggcaacctgaaccagaaccagcgcgatcgcaacctcgctgcgttcgattccggcgatgtgcgtgtcatggtggccaccgacgtggccgcccgtggcatagacgtcggcggcgtggagctcgtggtgcaggtcgagccgccggccgacccgaagtcctttgtgcaccgctccggtcgtaccgcccgcgccggcaaggcgggcgacgtggtcaccctcgtgctgcccgagcagcgccgcgagacgcgccgcttgctgaaccaggccggcatcaagaccaagatgatcgaagtgacccacgattcgcccgaagtgcttgagcttgtgggcgaccgcgccgagcgcgtagatggttggagcctcgacaagtcgcagcccgtgggcaacccgcgcaagggcaagaacaggggcgccaagaacgcggcgggcgacgagtccggccgcggcggcaagcgcaagcacaatcgcaatcgcaaccgtgacgagcagaacgttgccgagaccgagttccagcacgagaacgcaggcggcgagtttgttgccgaaggcgagccgcagcgcaagcacggcgacaaggccagcaagaaggccgtgaagaagaaccgcaaccgtgcggaacgccgtgcaggcatgagcaaccccgaggccgagcgccgcgactatctgttcgagcatggcgatgaccgccgcgaggagcgccgcaagggcgaccgtcgcgacggatacggcaagaaccggtacgacgagcgtcaggacaatggccgcgaccagcacggcaagaaccgtcgcaatgatcggtacggcaagggcgacaagttcgataagcgcgacagggccggatacggtcgcaacgatgatttcggcagccgcaggcacaatgcgggccgtgatttcgaacggtccgattcccgcgatttcgagcgtccgcgcaagcctcggcgcaatgaacgcagccacgaggattacggcttctcctatgacgagcgctcccatgacggccgcagacagtccatgcgcaacacccgtcagggcgaaggcggcaagcgcatccatcgcaagaacgagaaccgcatcgtacgcgacgagcgttcagaaggtgccaagcgtcacgaacgccgcatgatcgccaaatacggcaacacggaaggcccgaaccgccgtcattccaagaagaatcgccacaatgcgccattccgtatgaagtctggacgccgttagtccgacagcgcgtatgaatcaggcccgacgacctttgatggtcgtcgggcctgattgtgttataggccggtgtttgcgatgcggatgcctgttcgcctgcctagcggccatgacgattgcacttatcgccgcagtcgttgtgatcgtggccatgccgaaacggcggtaatggcctgtacgcaccctagaataacggatatgacgcaatcgcagccccgatccaaacgcacgcccacccttgaaatccacgggagaatccttgacgcggcaaggcggatcgtggaacgggacggtgtggatggtctgaccatccgtgcgctgtccgcacaggccgatgtgtcgcccaccagcatctaccagcacatcggcggcaagcaggcggtgtgcgatgcgctcatcgacacatacttcaccgatctgcgcgaacagctcatcgccattgacgaatccgaccccgtgctgcgcctgcgcagggcgggcataatctaccgtgaacacgcgctggacgcccccggcatttacgcgctggtctggatggggcaggcgtcggactcggcccagcactgcctggacgccatcacgcagatcattcgatacggccaggcagcatctgtattccgcggcgatgacccccatctaatcgcatcctccatctgggtgtccatacacgggttcatccaattcgaactgcgttccgcacaaccccgcacacgcggccgcgaacgggtcgaccggtcgtacggttacctgctcgacctgctgatccgaggcattcagaggtgaatgagttagctccctctgatgagggagctcaccattgatacgctgtactgccatcggcgttgcggatggtgaaagtgggggattgctcgatgttgaggtccacggtcagggaatgctgggcgtcggcgctcgtcgaacgatagacgaagtgcttgttttccagcttcacggcctcggtacgcgcatccagcagccatgggttgcgacggcgcagcgcgatcagcgcctgatgcagccggtatgtcggctctcccagcgtggacagttcggcaggggagccggggaacttcggacgtacgtcgtcatcgccgccgaaacgctcctgcttgacgcccacatagccctgttcgtcgccgtaatagatgcttggcacgccgccgaccgtcatgagcaccgccaatgccaacgccgccttggccgggccaatctgcgatgcgatacgcgtcacgtcatggttgccgatgaacgtctgcggcacgaaggaatccaggaacgcgttgtgccgcttcaagttccaatccagctcgaagaagttctccgtctccagcgcatgctggatcgacttccatagctcgtattgcgtgatcgaatccatcgtggattcctcgatgatgcgcgggtaatcgccatggatcacctcgccgaaaatccacgaatacgggtgtgcggctttgacctgcggcaacacgcgcgcccagaacgggctcggcacggcatacgcggcgtcgaggcgccagccggcggctccgcgatccagccaatggctcatcacatggaccacatagtcaacggtctcgtcagccgaatggtccagcgccaccagattcccgtgcccctcgaacacatccaaagcgggttcgccattatcaccgacatgcgcgcggaccagaccatgccacgggttgtcggccggattcaagcgtccggcggtctcgtcaagcgccgcctgaacggccggatgattgcggctcacgtgattgaacacgccatccagcatcacctgcaatcccatgtcccggcaggccgcgacaagctgatcgaacgcggcatccccgcccaatcgcacatcgatatgcatatggtcgagcgtgtcgtatccatgcgtcgccgactcgaacaccggacccagcagcaggccggacgcgcctagatcgcgcacgtactccagccagggaattatcgcgtcaaggccgcggccatggaactggcgcgggccggcgggcctgatatcggcaccgcagaagcccagcggatacacgtgccagaacaccccgtacttcacccaatcgggcattgtgcggctcgaatccatgcttacaaccactgtgcacctcctgattgacaccgtgtccattttcgcacatcgcggtgcgaatcccgggtaatcggcatgaaacgcagtccgtgaacatgtggccaagctcacatattgggacattttcctgaggcgcgacatgccgtggctacgcttccaaccagtgccataagcagacgagagataccccaaaagggtcgcaatgaagagaacctttcccgcaaaggttattgaagaggaacagagggttattatgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcggatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgaccgccatcgccatggcattcctggcgctcgtggccatcaaggccatggccgcctcgccgtgggctgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctccggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtagtgcgtcattggctccccttttttcaaggggagccaataatcagcgaaaggagacaaaatgctcggcaaactcgttgccgtatggcacggcatcgtctggtatctgcgtgagatcagcggcgaggcccgctacgaccattatcttgagcatttcgcggccgagcatcccggcgaaacaccgatgagcgaggtcgaattcattcgcgcccgcgaggaatacgaccgtctccaccccaataccagttgttgctgctgacaggccgcaatagcataacaacaccataaaacccgcgcgccatgggaactacgtagccattcttccgttacaatcagtgtgacggcttccgcccccgaagaagaaggtgttaattccccttggacgtctcactggcgcatttcctccaacaagtgctttccaacccggctctgaccgtcacaacgttgctgacgctgggagtcatcttcgtcaacggctggaccgacgcacccaacgccatcgccacctgcgtgaccacacgatgcatgcgcgtacgctccgccgtcatcatggcggccatcttcaacttcctcggcgtcttcatcatgacgcagctcaacgcctccgtggcctccaccatcagcaacatggtcgatttcggcggcgacacgaacgcggcgctcatcgccctatgcgcggcgctgttctccatcgtcgtatacagcgtgggcgcctcgctgctcggcatacccacctccgaaagccacagcctgatcgccggcctgtccggagcggccatcgccatccaaggcggcatcggcggcatcaacatgggagaatgggtcaaggtgctctacggtctggtcgcaagcctcctgttcggcttcgccgtcggctggttggtatgcaaggccgtgaccctgatttgcgctggcatggaccgccgccgcaccaacgggttcttcacctacgcgcagatcgtgggcgcggcggccatgagcttcatgcacggcgcgcaggacggccagaagttcatcggcgtgctgttcctcggcatggcgttctgcaatggccaacccagcgtgaccggtgtgatgattccgatctggctcatgattctgtgcagcaccatcatgggcgtgggcacgtccgtcggcggtgaacgcatcatcaaatccgtgggccaggacatggtgaaactcgagaaataccaaggcttctcggccgatctgtcaagcgcgctgtgcctgctcgtcatgaccgtgctcggcatccccgtctccaccacgcacaccaagaccagcgccatcatgggcgtgggcgcggtacgccgcctctccgccatcaacttcggcgtggtgcgcgacatgatgctcacctgggtgttcaccttccctggttgcggtctcatcagcttcgtaatggccaaactgttcatggtcgtgttctagaaaggaatccacccatcatggcgagacaaaaagacacgttctacttcgacggattccgccgcagcgcggactacgcatgccaggccgcgaagctgctgtccgaggtcatgcacgacttcaatccgggccagctgcgcgaacgcatggacagcatgcacgcgattgagaagtcagcggacgaggtgcgccacgacatgatggacgaactggtgaccgcgttcatcacgccgttcgaccgcgaggacatcgacgagctcggccacgtgctcgacgacgtgaccgacagcatcgaaggcgtgctcaaccgcatgtactacgacaacgtgaccgacatgcgcgacgacgcggtccagatgtcggatatggtggtgcgcgccacggaaagcatctgcgagctggtcaacgaactgccgcgattccggcattccaagacgttgcgcgaactggtgttcgccatcaacacgatcgaaacggacgccgaccacctgttcatcgagtcgatgcgcacgctgcacaccacctgcaccgatccgctgcaggtgttcgcctggcatgacgtctaccgtcacctcgaacagtgctccgacgactgcgagcgcgtggccaacaccatcgacagtatcgtcatgaaaaacagctgaggttggtttttcacaacctccctctgatgagccgagccgtgaagaaaacgccggaggcgtttttaggcgagggtgagtgacaacgagcgaataagaggtcagctgcaagctgtcctgaatcgcgttcgaggtggcatcgcgaagcgatgtcggagggagaggcctacttgaccaaaagccccctcacctatgggcgttgagccagaggatggcgagttgggtgcgattggtcaggccgagcttgtccagtatcgcgctgatgcgattgcggaccgtgccttcgctcaggaacagtctggcggcgatgtcgcggttatcgaggccctcggcgaccagcgcggtgatctcacgttcgcgctcgccaagcaggccctcgatggaatcggcggtatctctggaatcgtcggaatcggcaggatccggagttcgttcggtgagcttgccgagcacttccgcgccgagcaccacctgaccggccatcaccgcctgcagcgcgggcccgaccgccgccacatcctgtttgatgagatagcccttggcgccaagtcccatcgcctgcgcgatatacgactggtccgcaaacgtggtcaggaacagtatgcgcgcggccgggtccgtggccagaatctcgcgcgcggcatccaaaccgctggtgccgggcatctgaatatcgatcagcagcacgtccggtcggctcgccggtgtctcgaaataacggcgcacggcggcgtctccgtcatttgccatccatagcacctcggccgtgccggtggccgtcagaatcgtctccaacgactggcagacgatcggatcatcatccacgattgcgattctcatcaatccctcgattccatggtccaacgcttcttcggcacggatacgaacacacgccagccgtcctcatacggcccgcagaccgcggtgccgccaagggcgcgcacgcgcgattcgatatccgccaaacccatgccgcgcatcagctcatcggccgaaccacgcatatcggcaacgccgtcggcggcgagtcgcgagccgacgtgcgtggcgcgcatcgcacgcgggcgggcagcggccgtccgggacccatcggactcggacacggccggccccggatcctgaatgaccaactgccagaacgcggggaagtcacgcaacgtcacgctcgcctcgcgcgccgcgctgtgatgcaccacgttcgacaatgcctcgcgaatcacggtcgcgaaacagcgcgagaccggcgcaggcgccttggcgatatcgttggccagcgtcacggcgaaaccgggggagatgccgtcgaacgacgtgacggcatcatcgatctgcgcggcgaaatcagtgccatcatcctcaagatcatgcaccgaacggcgcaccatcgtcatcgcatcatccaacgtcgcacccaacgtggcgaacccttgcgcagcgaccgtatcgttcgtcgccttggccaccgttttgccggcctgcgcctgcatgatcgcgcgggtcagcagatggcccacattgtcgtggatctcccgggcgatacgcgtgcgctcgccgagggtcgccatgcgaatcgactgggcgcgttcctcatcgatgtcggcgatgcgcgaacgagtggcccgcgaggattcgcgcgccctgtcctgcgcgtgcagcaacgcgcgccgcgcctcgtccgaggaggcgcgggcccggcccagaacgaatccaagcagggcgaccagcgtcatcaccagcgtctggagacggtcggtgccacgggcgaaccagagcgcgatcagcggcaacacccatatccagcgcgcggcggccgaaagccacggggccgaacgcattgcatcggcaagggaacggcgagaggccgcggtccgcgagacactgggggagcggccacttgccgcagtccgtgccccagcccgggctccggtcgaggcgagggccggcagccgtgcagtatcgtaggcgatgagcggcatgaacgcgcaccatgaaggcaccgccacggcgatgacgagatacgccgtacacaagacccaagaccattgcgcgggacgcagccattccaccaatccggcgacggaaacggccaacagcaggccggcgatgaacacgccatcggaccgtagcctgacaagccaggccaaagccaggcccaacacgagtagcaagcccatctcggccaacacgcgcatggcacctccccggctcgacgctcttccaccaccagtctagcggtgtgcggaacacgacgaacttgacgggcgtgcggaattacccgcatgacggtccaagacaacgggcctacacttcccgaatagatgaggcacaagcgtcggatgtcgtcgacacaaccgtaaagggatgataccgatgattacgcaaagccacagggcgtccaactattcgatggacgagatcagcctgatgccggtcgataaggtgtacaaggccatgcagaccgacgccgaaggactgtaatgacaaatgtcacgcctgtacggccaagtcgtgacgtttgcctgtggcggcgtccggccccttcttgggatgatggaatcgccaaggaagggagtgactatgacaaccgacaacagagcttccgaacacgactcgacaaccaacccggctctggccgtgcacgtcagccaactggtcaaacgctacggcgacatggtggcgctcgactattttgaccttgacgtgaaccagggcgagattttcgggctgcttggaccgaacgggtccggcaaaaccaccgcgatcaactgcatcctcgcgctgctcacctacgattcgggcacgattcgcgtgttcggccagccgatgacgccgacctcctacgcgctgaaacgtcgtatcggcatcgtgccgcagaacgtggccgtgttcaacgaactgaccgtcaccgaaaacatcgactacttctgctcgctgtacgtgccgaagaaaaccgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctaacctgatcttcttcgacgaacccacggtcgccgtcgacccgcaaagccgcaattcgattctggaaggcatccagcggctcaaccaggccggcgccacggtgatctacaccagccactacatggaggaggtcgaacagatctgcgaccgcatcctcatcatggaccacggccggcacctggcgctcggaaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccgtcgcggcgaacacaacctgaccgacgtgctcgacgcggtgaaacgctccggcgccaacatcggccacctgaccagtcgcccgcccaccctcaacgacgtgttcctcgaactcaccggcaaagcactgagggactgaccatgctcccctcagtcggcaagcaaataacttggctcccctctccgaggggagctgtcaccaaaggtgactgaggggagttcctgagtaaggagacatcatgtggaccacatttctggtcgcattgaaagcgaacttgcgtaaccggtcggcgttgttctggatgaccgtgttcccgattgtgctggcgaccatgttcaacggactgttcggcgggctggccgaagcatacgaactcaagccggtgccgatggccgtcatcgaagacacccgttggcagcaggcggacggtgcccgcaccttcgtagacgcgctggccggggaaacggaatcggcctcagacgacacgacctacgccgaaatcgaccaaaagctgctgaccatcaccacagtcgacaccgtgaaggaggccgaacaacggctcgccgacggcactgccaacggctatctgaccgccgacaataacggccgattggcgatgaccgtgagccgggaaaccgccgtcacagccaaggactccacgcaaaacagcggactggacattagcctcgcggccctgcgcagcgtcatcgacctgtacaaccgcaccgacgccgttacccggcagaccatcgccgacaatccacaggccgcgctcagtcggaacttctggaacagcgtcgggcagaacgtcgacatgacccatgagacgacgctcacgcatttccagcctgacgagatcgcccgatactattacgcgctgctggccatgtcctgcatgatggccatgggatactccatcagcacagtcgccgccgcacaggcgaacctgtccgcgctgggcatacggcggaccgtagcgccgctgagccgggccaaacagctcgtcgcgggcttcctctcctgctggctgtgctcgtcggtcgccctgtccatcgcattggcctatatccggctcgcctgcaacgtctcgctcggcggacgcgaaccggcggcgatcctcgcggtcatcatcgcctcgttcatgaccagctcagcaggcaccctgctcggtgcggtgccgaagctctcgtacaacacgaaatacgggctgtcgaccggcatctcctgcacgctgtcgctgttcaccggactgtacggcgggtttgccatgcagatcagcgactggatagcccgcaacgcgcccatactcggcaccatcaaccccgcacagcaggtgacgaacctgttctacgacatcctgtactacgacagctaccggccgttcatcaccacctgcatcattctgctggcgatgagcgcggtattcctcttggccggcatcgcaatgctgaggaggcaacgttatgaacacctgtaaagccacgctgcgcgtgctgttcgcgcaccgggtctacctgatgatctacctcgtattcataggcatcctgatgatgtccatcagctgggcgatgctgacctccgcatccggctccatgtccgcggtgttcgaatcgaccaagacgcgcgtcgccatcatcgaccgcgactccgaccggggtgatatcgccacgtcgatgcgcgcctacctgcgctattccagcgaactggtggacctcgacgacaccagcgaaacgctgcaacaggccgtcgcctcgaactgggtggacctgatcgtcatcattcccgacggattcgctgacgattatgtcgccgcggcggcggacggcgacaatccgccgaacgtggacacggttaccagctacgcatccggctccgggtcgatggcgcggatgaacgtcggcgggttcctctcgctcacccgcaccgcactgatcggcgcgcagacgagggtcgaccaggcggcgctcgccggcatgatgaacgctacaggaggggccgccggttttgatggcgcgagtctggaccaagacatgctggactcgctgccggaagggcaagtcgacaagccggatatcaaggatctgtcccaggccgccaaaatggccgccgaatcggccagcgatacagacgtgaaccatcagatcgccgtggtcgatacgccgaccgaggagtcggcaagcgctgcggatacggcggtcagcggattcggcggcaccatgaaaaccgcgctgtacccgctgtccctggcgatgaccatctgcggatcgatgatcctgggcgcgttcaccaccggcgaggtgcggcggcgtctcaccgcctcgccccgacgcatggtcctgatgggactccagcggttgctgacgttgggcggattcgcgctcgtcgtatgcgtcggctatttggtgctgtcaatcggtctgatgatggcggcggggctcgatccgttgcacctgagcatcgggggagtgctgatgacgttcggcgcgacctgcgtgtacgcgctgatgaccgtcgcctgcggattcatgctcagcgagttcgggctctcggaagaggcggccaacgggttcgccaacatcttcggcctgctcatcatgttcacgtcgggtgtcgcattgccgattgacatgatgcccggcgtgatggtgaccatagccaagttcctgcccggctggtggtattgcaccgcgatcgacaacgcgctcggcttcggcacggcggcggaaaccggcataagcgtcgccggctggtccggctcgctgggattggtcgcactgttcggtgtgatgttcatctgcatcggcctggccgccggccgcttccgccgatcccgccccgccctggccgcgcccgccaccacgcagctggccgagtgagaaatcagcctttcaaccgataccgctgtgccgggtcgtcggcgaacttgactcgggcgacccgcccttccttcatcagctcgcgcataccggatgtggcggccagcggcgtcaactgcagttcgcgcatgatctccttgacgctcatggccgaatgccgctccagtacggtcataatcgccttgaccacgtcgcccggtgaactgttcgccatcgtgcgctgcttggtgatggtcatcgtgaacgtgttgatgtcgttgcgcgtggtcgccggctcgatgccggcctcgcgcaacgcggcggcgatgcgctggtagccgtcgccgccttccgggttcacaaacccgccgcccggatacggcgtggactccagcagcgtgaacaggaactggtttcgggtggagacgaacggcgcgcccgtcaccggatgagggctcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagcggcggatagtcgggcttcttcgcgccaatccaacgcatcaacgagtcgaccgcatcgtcgatcatcaccggaatcgaaccgaccaccgacttcgaggcgaccaatcgttcgtcaccccggaacacatcgtcccggctcgtccccggaaacacggcaatcgaaatgccgagccgcggatagaacttctgcggatagcggcccaacgccagcagtccggccaaggtggggcgcaggattccgccgacctccgactcgtcggaatcatcatggcgcaacacctgcagatccagcagcacatcgataccgtctcggtcggcgaacacgcgcggatgctgttcgcgcacgcgtgccaacagtccggcaacaagctgcgggtcgaggtcatcggtcgtggcgtcgggcacgatatccagatcgtatgtgggctgcagatgctcctcgatgagccggtcgacctcataggaggtcatgcgccggtcgccgtcgccggtacggatgaacgagccgccgtgcggtccgagcgcggtggtgaagcagggcttgtcgcgcggcagcatctcgtcgatgcgcgcgaacaccagattcgcgccttcgaacgggcaggtgacgatcacgggccgcaccaccggcgtcatcttctcgcacgcctggctcagcgcctcctgcatggcgcgcgcgtcgaatccctcgaccggcgtgaacccgttcttttcggacaggcccaggataatccagccgccggagccattggagaacgcggacagcgtatcggtgatggtcgaggagatcttgcgcttgcattccttgacctcgcactgttgcgtatcgttgccgatcagacgcatgagttcgatcagctcagtcattttggcagtatagtcatcgaccatggcggcctccttgaaaccattgtgccccataatccgccgcccgctcgcctccagccccgccagttcaccccaattcatgcagaattcatgggccaaaccagacgaaacgaacgtcgatgtagggttcggttccgcgtgttcgccgatgatatcggccggtcgaggcgggcgggctatgttgggtggcgtgggaatcttgcgcgtgattgatgctacggctgtgtgcttcgctctgggtatatccggcccgatcagcgggactcagccaatgtgatgccgcccgcagccatctgcttgcgggccgcaacaccaagttcctcgctgaccggcacggtcagatcctcgaacacggtgacctcgaagccgagcttcttggcatcgagcgcggtgtccttgacacaatgcgattcggcgatgcccaccacatccacgcgactcacgccggcggccttcagcgcgttggccagcgtcttgccggcggattgctcggcctcgacctcctcgcgggtctggatacggtcggtattgtcctcgataccctcaaaaccggaatatgccgccgaatactggcccttcttgaaatgatgctcgatattcagcgccttgatcgccggatgcaattcggcgttcagcgtgccggccgcaccatgcttcggccacgtgtccacgaaatccggctccgccgaccagtgcgcgcccggctcgatatgccagtcctgcgtggttgcgatatacgcgtactcgctgcgatgcgcgttcacataatcggcaatccgctcggcgaccgcgttgccgcctgcgacacccagttcgccgctttcacagaacgtcggctgcacatccaccacaatcagtgccttggtcatcgtcattccccttattgccttggattcgttttgaatattgtctcgaactcgacgtgcgattgctctcatcatagccatgcgcggccctgtgggaaacgttcgggcttacactgcaagcagcaatcgaatacaagaaccaggggagggcgaccaagaccatgctggaccatctgacgttgcacgtgaaagacatcgaccgtagcatcacattctacaaacaggcgctcgcaccgctcggctatatcgtcaaggcgcatcatgagcctacgctcggattcggcgtggatgacggaaccctgcactccgatttctacgtgtcaccgattgaagggctggaggcggaggcttcgccggtcacgccggtcacacacatcgcgttcttggctgacagtcagcaagccgtgcaggcgttccatgcagccgcgctcgccgccggcggccgagacaacggcgctcccggtccgcgcccgtaccatcccggctattactccgcattcgtgctggacccggatggcaataacatcgaagccgtcgtggattgggctcattcgaacgagtaaaaacatatccgtatcgtgcctcaggcggcatcgacggcgtaggctccaaccagtcggatttgtggtcgcaacggcggtataggtcacatcacgcaagcgtgaaggtgatggtctgctcggcggtttcggtgccgatccatgtgccggctttgcggttccaatccatgccgtccgcgtgcagtgcgtcaatgccgtattgacgtgcatgcgtgaccagccagcctgccgtctgccagcaaagtcgagtgcggttgtcggcggacaggccgtccggcagcgtgatcgtcaacgttgtgctggccgtattggtcgcagcgccgttgttcgtgccggttttgccatttgggggcacaaccgagacattgacattcggcagtgtacctcctatggcggcaaccaacccgtccgcgtccgaggaggttgctggctccaacgcgcacgtgacgcccgccgaccgttcaccggtcagccccgaggcccaagcgcgtgccatcgcatcccatgcggcatatagttccgggtagcctgagcgctgcacctcctgcgcggcgtcctccaccggaatcgtctcccaatccggcacctgcagcagatgatcgtagaagatgtttgtcgcataggtcatgtcggacacctgctccgccgtgccccagccttggctgggccgctgttggaacaggccgagcgaatccaagtcgccgtagtccagattcgtcagcctcgactcctgcatggccgtggcgatggccaccgtcgccgcgtgatccggcagtccgcgcgtgacggcgatgttcgcaatcagcgccgcgttctgcgcctgatcaggcgtcaaggtgcggcgggctccgtcgggcgacaccgccgcgcaatatgcttcctcggccgtgcgcgcggtctcgtgaggcgtgaatagccgtggcagcagcgtccatgccgcgatcagcgccgcaacaacaagtatgacggctgcaatcagcgcgcccgcgccatgggagcggcgtctgccgtaccgcacctgttgtcccattgcgcctccaatatttcggtgtcatggctgaccgtgaccggctggcctatgcagcatgcgggatttgccgtgttccggctcggccgtcatcatgacagcgtggcatatccacctgaacggcggctgcgtcatcacgcgactttgtgacaagtcttcacgcttcatgacatccgcgcaaatcagcccctcgaaaccgagaatggcggtcgggattgctccgacaccaagggagctgctgccgctattgtgtgaaaggcgatttgtaccgggttgaaggagaggaacacatggcacaattgcagccgtactgcgcgattgagggcaatgatgatggattgcccgtcgtgttcgtgcatggcatgggtgtggaccatcgttcgctgatgatgctcgacaaggcgtttgacggcaatgattcaattcgccgtatatatctggatctgcccggtttcggccgtacgccggcattgcccgagcatgcctgcgggctgccggaaatggcggattggctgcaaacggccattgacggccttgtcggtaaagcggctccattcgccatggtcggcaactcgatgggcggtgcgcttgtccgcgaagtattggcgcgcgaacctcgccgagtggccggtatggcattgatcgcgccggtcgtggacccgcagcatgccggccggcatgtggccgaacatgtggttgcacagcccaatcccaagctgacgcactccttgccacaggaacaggtgttcgatttcattaccatgggcgtcaaccagtcattcgacgcgtggcggcgctaccaacggttcatcctgcccggcgtggcgttgtgcgaccgtgcggcatgcgaacgactggatcagcgttattggctggccgataatcccgaggaaatgctcggcacataggcgggtccggtgctcatcgtcaccggcaagcaagaccagatcgtcggatacgaagaccagcaagccctgttgccgcactatcccaacgccaccttcgtgactctggataatgccggtcacaacgcgcacatcgaccaacccgaagccgtcatcacgctcgtgcgcgaatgggtggctcatatggcgttcgttccgttgagctgacggtctgctgacagtctgccgaagcctatatgtatacgagcgaccaatgccggttgacgcaatacgccttgcaaggtatatcgtttttcgatatagtcatatcgatgttcgcggtgtcgccaaaaaaacgtcggcacctgaaaggaccgggctatgaaaaactacatgaaccgatgggtgttgctcgcgttgaaagccatcgtgattctggtctggctggcctgcctatggggccaactattcgccgtaccgggattgagcggcgcgctggccggcctctacccgagccagacgtcgatgcgctggccatatctcattatgggcgtgctgttcctgttctgcatcgaagcggcgttcgtggccgtatggaaactgttctccttgtccggctcgggcgcgaactcgagcaggtgatttgagatgacgattcgcatcaatctcgacgtcatgatggccaaacgcaagattggcgtcggcgagctcgccgaacaaattggcatcactcccgccaacgtgtccattctgaagaacggacgtgccaaagccgtccgcttcaccacgttggacgccatctgcaaggcactcgactgccaacccggagacatcctcgaatgggaagatgacgattgatcgacacgccaccggctcgaactcatggttcaacttgtagtctctcccaaaatcaatgatgccctatcatcctgcaagacgatagggcatcatcatgtgattatgcgcagctgatatgttgcgttgttatcactcggcgtccgcggccggtgcctccttgggcgcagagaggaagtgctcctcgctgggcagcacggtgttcaggatcacggccaccacgaacgccacggcgatgcagttcgaggcgaagatttgttggaacagtgccgggaactgcgtgaagatgtcgctcacctgggtgaagccgatgccgatggtcagcgaaagcgccgcaatcgtgatgttgcgctgcgtgaagcccgcctcggcaatcatctggaagcccgaaagaatgatgttgccgaacatcatgatcgtgcagccgccgagcaccgcctgcggcagcgagttgaacacctcggcgatggccggcacgaagctcgccagcaccagaatcagtccgccggagagaatcaccttgcggttgacgaccttggtcatggccaccaatccgatgttctgtgcgaacgaggtcagcggcagacagccgaacaggccggatacggtggagatcaggccgtcgccggcgatggcgcccgcggtctcgcgttcggtgggcgtacggttcaggcccaccttggtcagcgcggcggtgtcacccagcacctcgaccgaggagacgacgtagagcaggccgatggagatgatcgagccccagtcgaactcaggcttgaacggcatgaactgcggcacggacacgatggcgaggttctggaaaccggagaaatcgaccttgcccatgcagatagccgccacatagccgaccaccagaccgaacagcacggacagctgcttggccgtgcccttcatcaacagctggaacgccaggcaggcaaccaaagatataagcccgagcgtcaggttctgccaggaaccgaagtccttggctccgctgccgccgccgaagctcgtggcacccacgttgagcagcgagaagccgatcgacgtgaccacgatggcggagacgatgggcggcacgaaccgacgccaatacttggccgtcaaacccagcacaagttccagcagaccgccgaccattaccgcgccgaccaccgcgccatagcccttgtccgcgcagatcgccacggcggccgccacgtaggtgaaggagatgccggtgaccatcggaagtcgcgagccgatgagccacgcgccgtacagttgcaggcaagtgcccaggcccgcaaccagcaggccggactggatgatggtggccgattgggccggggtcatcttcgcggccgaggcgacgatgaagatcggggcgaggttcgccacgaacatggccatcacatgctgcaggccgaacggaatgcccttccagaaggatactggcgcgtccagcgaagacaacgcctcaaaggatacggaatgattggttttcttctctgacatgattctcttcttctctctgttgctcccgccggcgggagcagccaatgtgctcagtgcctaaatgtgatttcgccggtctcgggattcatggactcgacgatggccagcgaatccacctcgtagccttcagcgcgcagcgcgtcaccgccgccctggaagcccttctccacggcgatgccaatgccctcgaccgtggcaccggctgcttcgcacagatcgatcagaccgcgcaacgccttgccgttggccagaaaatcgtcaataagcagcacatggtcgccggcgttcagatacttcttggccacgatcaccgggaactccttctgcttggtgaaggaatagaccgtggtggtgtactggtcgccgtcaaggttgatggactgcgccttcttggcgaacaccaccggcacattgccgaaatgctgggccgccacacacgcaatgccgatgccggacgcctcgatggtcagaatcttggtgatgtgcttgccggcgaaatgagcggcccatgccgaacccatgcggtcgaacaggcgtacgtcgcactggtggttcagaaacgcgtccaccttgagcacattacccgccttcaccgttccctcgctttggattcgctcctcaagttcctgcattgaacctcccattgttgtatgtcagtgaatgatatggatactcgtaagtgtacgttgtcctgcgctgacccgtgcatgtggtaaacatgaatgtcgcgattcaaagggaggcaacagtgtacgacgagccggaagtcatcgcacgcagcgcacaggaactcgtgggcgacctgaacccgcagcaggcggaagccgtgcaataccgcggtcaggcgctgctgatcggagccggtgcaggctccggcaaaacccgcgtgctgacccgccgcatcgcctggatcttgagccagttcggcgcatggccgagccagattctagccatcaccttcaccaacaaggccgccgccgaaatgcgcgaaagactcggctcgctgatcggcccggtggcccagcgcatgtgggtctccaccttccactccgcctgcgtgcgcattctgaggcgcgacggcaagtccatcggactcaagtccggcttctccatctacgattccgccgactccgagcgactcgtcaaaatcatcgccaccgaattcaacctcgacatcaagcgctacactccacgctcgattctcggccatatctccgacctcaagaacaatctgaccggttggaaggaaaacctcgccgttcacgcgcccgacttcacgcccggccagcgcggctaccagttcggcacggtgggcgaccttgaagccatctacgcggtgatctacgccgaatacgagcatcgcttggccctggccaacgccgtcgacttcgacgatctgatcggccgcacggtcgagttgctgcgcactgacccggccgtcgccgagtactaccatcaccgcttccgttacattctggtcgacgagtatcaggacaccaaccacgcccagtacgtgctcgtgcgcgagctggccggcgtggacacgggggagaaggccatcccgggcgcgcctaacgccggcaagtccggccccgcctggatcaccgtggtgggcgattccgaccagtccatctacgcgttccgtggtgccgacatccgcaacattcaggacttcgagcaggacttcccgaacgccaagaccatcatgctcgaacagaactatcgttcgacgcagaccattctggatgcggccaacgcggtgatcagcaacaacgagggccgcaagcccaagaaactgtggaccgcgctcggcaagggcgagccgatcgtcggctacgcggcggacaacgcccagcaggaggcccagtgggtggccaccgaaatcgcgcgcctgcacgccgaagcgggcatcgcctactccgacatggcgatcatgtaccgcgccaacgcccaatcccgctcgctcgaagaggcgctgatcaacacgaatcagccgtatcagctcgtcggcggcaccaagttctacgaacgtcgcgaaatcaaggatgcgctggcctatttgcaggcgctcgtcaatccggacgacgatgtgaatctacgccgtattctcaacgtgcccaagcgtgggcttggcgaccgcgccgaaggcgtgctgctcgcctacgcgcgcgagcatggcaccagcttcttctacgcactcatgcacttggatgagatcgaggtgccgacacgcaccgccacctcgctacgagcattccgcgatctgatgggcgcgctctcgcagttcacgcgcgcgcacgactccaagcccagcgagatcgtggccgaagtattggagaagtcgggcttaagggccgaactcgagaaatccgtggacccgcaggacgcctcccgtctggagaacctctcccagctgcagtccactgccgccgaattcgaacagaacacgcctgacgccacgttgtccgcattcctggagaccaccgcgcttgtggccgactccgaccaactacccggcgaggcggaggactccggcaaggtgacgcttatgaccttgcacaccgccaagggcctcgaatacccggtggtgttcctgaccggcatggaacagggcaccttcccgcattcgcgttcgatggaagacaccactgaactgcaggaggaacgccgactcgcctatgtgggcatcacgcgcgccaagcagcgactgtatgtcacgcgcgccgccgtccgctcccagtggggccaggccgccgatatgatgcccagccagttcctcgacgagattccggattcgctgattgattggaaacgccgtgaagccggcgtggagcgtatgcgcgccagctgggagaccgatggattcgccgacgatttgggcggctgggatgatgacgattttggcggcgccgcgtttggcgggtcgtcgacgttcggctcgcgtggttcgtccggttcgggttcgtcctatgggtcgcggtcgcggtatgggtcgtcgtatggctcgggttccggctcttcgtcgtatggttcccgttcatcgtcgtatggttcccgctccggctcgtcctcctatggttcccgctcccgttcgggttcgtcctatggttcttcaggctccggttcgaggtcgtcctacgggtcgcgttcccgttccggttcttcgtccggttcatatggtggcacccgtggcggcaaggtcaccacgcgtcgtaccgcaccgaaatccgattcgaccggctctgccgtgcctagctcgaagctcaccaaggacaatggcctgaatatcgccgacttcgccgtgggcgacatgatcagccacgaccagtacggtctcggcaaggtcaccgacgcacaagacaagggccgcaattcggtaatcaccgtggacttcggctccgccggcgtcaaacgcctcatgctccgcgtagcgccgattgagaagttgtagataaattggcccctctgacgaggggctgagttatataccaaataaattcgcaaaaaacaagacttgtgttcttcatcacagtgtgggcataatgcggaggttgtgcctacgagccctgggaacaggggagaggaaaaagtagttatgaagaacaagctgtttgcatccgtgcccaatattctgttcggcgcgctgatcaccatcgcgccccagacctttgcgcacgcctgcaccggccatgacatgccgggtgcctgccactactcgcagcaggcggccaccggcatcggcgtcgtcatcctcgtgttcggcgtcgtggctttgttcgtcgccccgcagattcgcatcggcctcaatatcgccgccgcagccgacgccctgctactactcgccgtacccacctttctgatcggcatctgcaagggcgcgatgatgcactgtcgcatggttatgctgcccacgctcatcgtgctcggcgtgctcaccatcgtgttcgcggccatcgccatctggctcgactctcgcgccgccaagcgcaactgatcgagcagacggccggagcccagccattccgaacgctggactccggcctcgcttattgcaaccgcactataagcaacataaggattcatcgtgccatcccatatcgcattgcgcggccttccgattgaaaacctcaaacgcaagccgttccgcaccggcgcactgctcgccgtcgtcaccatcctcgcgctgacattcttcggcggcaccatgctgaccatgaacctcaacactggcatgaccagtatggaaaagcgcctgggcgccgacctcatggtcgtgccgcaaaacaccgtgcagaaggccgaagcgctgctcatcaacggcaatcccagcactttctatttcaccaaagacatcgccgacgaggtcatgcaggccgacggcatcgcacaggccaccgaacagacctatatatcatcgctggccgccgcctgctgtgccgaaaagctgcagatcatcggttacgacccggacactgacttcgtcatcgaaccatgggtcgcctcccagttcgaaggcccccttgaagacggtcagatgattgcaggcgcaaacgtcaacgtgtccaccgacggcaccatcgaactctacggccgttcatggccggtcgtcgcccagctcgccaacaccggcaccagcctcgacaactcggtgttcatcaaccaaaacaccgtgcccgacatggtcgccgcctcggccaaggtctccaagcaggtcatgtccgccgaatatgccggcaaagccgtctccaccgtgatgattaagacgcagcaggggtacgaagcgcagaccgtagctgagaacatcaagcgtcttgattcccgattcgccgatttggggtacgtataccccggcggcatcaccgccaacaccagaacttcgctgaccgcgcttgtcacctacctcaagattttcgtggcggtgatctgggtaatgggcgtgattgtgctgctcgccgtattcgcctcgtcggtgaacgaacgcaaacgcgaattcgcgtccctgcgcatcatgggcgccacgcgcggcatgttgaatgccatcattctgaaggaatccgccatcatcggtctgatcggtggcgtaatcggcgtcggcgcggccagcctggtgattttcccattcagttcgctgatcggcaaacagcttcaattgccgtatctgcaagccagcccggttgcggtgatcggattcattgccgtgaccattgtgtgctctacggtcatcggcatcatcggttcgctggccaccatgtggcgtctcggccggcccgaagcctacctgaccctgcgagagggggagtgatatgactgagacaactacgccgcttcagccgaccacggttgagccgaccaagctccagccgaccacgccagctcagccgaacgcgccgactgcgccggattcgccgcacgtaaccgagacgccctccccggaccatctgctgaccttgacggacctgacccgccagttcgtccgccgcggcacgccgttcgacgccgtcagccacgtgaacctcaccgtcgatgccggcgaattcatcgccatcgtcggccggtcgggcaacggtaaaagtacgttgatcaacatggtcgctgggctgattcgcccgacctcgggaaccgtgagcgtggctggacgcaatgtggccgacttgggcgataaagcactgtccgtgctgaggaatcgcaccatcggattcgtgactcaaagccagaccctgctcggcaacctgaccgtgctcgacaacgtgattctgcccgcaacgatgtttccggagccgctgccgttcgcccaaaacgcagaagcaacggatgccgtggcgcaagccgctgccaccaatgatgaagcggccgccgattcagccgccgacccgttcatgccggatgtcattgcgccaatcacagaccaggaaaacacgccgtcaaacacggctgcgagccgttcggacctgttcgccacccgagctcgcacgctgttcacccagcttggtgttgccgatctggcagacagctacccgcgcgagctgtccggcggtgaaatgcggcgcgtctccatcgcccgcgcgctgatgaaccagccgagcttgctcatcgccgacgagccgaccggcgacctcgaccaagagagcaccgacatcgtaatgcgtctgctcagagaccaagccaacaacggcacggcgattctcatggtcacccatgatcccgatgcactcgaatacgcagatcgggtgtatcgcatggacgccggagtgctgtccatagcctcggtgtaatatggtctgctggtgtctgccaacaggtagataccgtctggagtcatagcccatcagcgggtcggcggtaggtaatcgcaagaaaaccaacccgttcgtgtttattcacgacgaagcgctggggaggcccgactcagcgcttgttaggcatatgcaaggcaagcgttccgttcagataacgacagaaggattaatccaatgacgaacgttcagcgttctcgccgtcaggtgcgtctgtctcgcgccctcggcatcgcactgacccccaaggctcagcgcatcttcgaaaagcgtccgtacgctcctggcgagcacggccgtgaccgccgccgcaccgagtccgattacgcggtgcgtatgcgcgaaaagcagcgtctgcgcgctcagtacggcatctccgagaagcagcttcgcgccgcttacgagaaggccacccgtactgccggccagaccggtaacgccatgctgaccgacctcgagacccgtctcgacaacctggtgctgcgtgccggcttcgcccgcaccaccgcccaggcccgtcagttcgtggtgcaccgtcacatcctcgttgacggcaacatcgtggaccgcccgtcctaccgcgtcaagcccggccagaccattcaggtgaaggccaagagccagaccatggttccgttccagatcgccgccgaaggcgtgcaccgtgacgtgctgcctgcggtccccggctacctcgacgtgaacctgccgtccctgaaggccactgtgacccgtaagccggaggtcgaagagatcccggtgcaggtcaacatccagtacgtggtcgaattctacgcccgctgatccgggccctctggtcaacaaatccaggacataccgctcgaaccccgcgcttctttcgagaagccgcggggttcctgcgttgtagggcgattactggccgcacaccgcctggcgaatcatcgtcgcgtacgcataggcaccggtcatattcggatgaatgccgtcatcgttgaggtattcgctatgaccttcgctatacccatgccaatcgatgatgcccacgttcttgttcttcttggcggcctcacgcagcatcgtattgttgttgttctcctgccacgggtatggcatacggatggtgatgaagtatgtcggcttgccgccggtcaggtcaatgagctgttgcacttcctgctcattcgaaatcacgccgttcgtgccgaggccaaacaccaccacactgccactgtggccggcagcggtgtcctgctgatacacatccaccgcctgcggcagctgacggttcggcaggccatcgataaaagcgttcgggaatgcggcctggatggcgtccgaagtacccgacgtcactgaatcgccgaccatcatcatatccgcgttgcagctttccgttgccggatcataggcgtacttcgaaatgtcaagattgtttggcaccttttccgcaatcggtttgatgatgggcggctgagaatccgaaccgttcttattcgcgtcagcggtattggtttcgccgttcgcggcatttatggcagaagactcgggctcgggcttcgccggtttcttgaccggcttggcgggtgccgcgagttcggggcgcagctgaatggctcgcgcttgagcgatgccattccagtccaccggtgcccacgtcagcgccacaacggtcaccaatccgataaccgacatgacccacgcgcccgggcgcagccggtagccggctttcggcagcggcttggcgtgttggctacgaggcatctgcaccgatttacgggccgcctcgaccagctggtagaaggcttccgacgccgccaacaccacgacggcctcaagaacccaaccccaccacggcaacgcctgcgttcgtgtcgccgggttcatgaactgcagcagcggataatgcatgacgtacagcgagaacgatcgcgacccgatatagcgtaggggagcacaacccagcacgtgcgaccagattgagtcattgttcacggcacaggccaaggcgcacaacgatatgaacgcggtaatcaggtacccgccttggtacatgtacgacagatacccgttggcgaaccagaatccggtcagcagtgccgccaaagccgcggtgccaagaacattgcagacgatagtgagacgggcgcccgtcttgtcgccggcctgacgttcgatctgcactgtttgcgaagccgctccagcttccgcagcttccgtacctcgcgaggaaggcgcaatccagatagccaacagcgcgccggcggccagctcggcgaggcgagtatcggtaccgtaatacacgcgggaggtattggccgggtcaaacagcagcaccatgtcggcggtggaagcagccatgatgacaagaatcgccatggagcgcacccatttggacttggtgattttgccgagcaccaccatcagcaacggccaaaccagatagaactgcatcgtcacgcccaagaaccacagatgggtcagaggagaaggcaatccggccgcctcgaaatacggcaccttgcggaagatgtacacccaattgctggcgaacaaggcgctcggcagcgaatcggaaaccactttctgcaacaggctgggagcgaacatccaagtgagccaaggcaccacggcaatggtcgccagcatcaccggccataaacgagtaatgcggcggatcagatatcggccatatccaaaggacccggtgcggtccaccatgttcagtaccgaacgtgtggcaagaaaaccggtgataacgaaaaacatcgtcacgccaatgaatccgccctgcaatagcgacgggcgggtgtggaatgctatgactccaagaatcgccagagcgcgcagtccatcgatacccctgaaatgggcaggcacagacgatcgagatggtgcaggtttcaaggttatgctcacagtattctaagtgtactctcaggaatcgttaggtatactgcccggattacgcatatctcaggtagtgacctatgccgttatgacttatgacttccggcaacccgcaccgaaaccgccggaatggtgacataatcagaaccatgattcttcatctgcatctggtccgtcacggacagacctatttcaaccgatacaaccgtctgcagggatggtcgaattcgccgctgaccgagtcgggcgtcgccgatgccgtcaaggccggtgagcgactgaaaggattgacgttcgccgccgcctactgttcggacaccacgcgtgcccagcagacggccgagaaaattctcgacatcaacgaagccgcgggtaacccgcgccccgcactcgtgacggacatgcacttccgcgagcagttctacggctactacgagggacttgacatggccatggcctggtacgccgcgggagcgccccacggcgtcaaaacctacaaccaaatcgtcgagaagttcgggttgggggcctcgcgtgattttctcaaggaagccgatcccttccacgacgcggaatccgatgaggaatattggacgcgcgtcgaaggtgcgttccgtcttatcgccgacaacccgaatctcaaggacggcgacgatgtgctgcagatttcgcatggcaacacactgcttagcctcggtcaccggttcggcggccctgacctcgatctgaacgaacgcccggccaatggttcggtaaccgtgatcgacttcgacaccgacaagccgttcggcgaagccgtgaccatcgtttcgtacggcaagtagcaaatagcaagcaatacatatcgaatagcacgtacggtccacggcggcacgccgcaaacgaaagcgtcagcaggacagcctttcgcctatagccgcatacgcccacgcgcacggttttcgccctgcgcatgcaatggtatgccaagaaatagggaaggagtgctacccttaggcgagtaagtgtgaccgcaaggaggaaacaatgggagtcggagagatcgctggcctgatcgcggccatcgcgttcgcagtattggccggtttcatgatctatccgctgatcaggctgggcaagatgtttgatcagatatcgcagacggtccgggagtccggtgaacacgccatccccgcgctggacgaaggcgtgaccaccgtcaagcaggtcaacaagtcgctcgaagacgtgaacaagatttccgccgcggcttccaccaccgccaacaacgttggtgcgttgaccgatctgtatggctccttcctcggtaagcccatcatcaagatcgcttccaccttctacgcgctgaaaaccacgggtcagtccttccttgcgaagaccgccgcgaaaaccaccgtcaacgacaccgccgagaagggggagtgatgttcaaacgcatcttctgggtcggcgtcggcgtggccatcggaatcgttgccgtcaccaaggcacaggcctatgtcaaggccaatacgcctgatgcggcacgccagttcctgcttggccccgatcaggacaatgtgccgatgaaaacactcgaagggttggtcaacgagttcaatgccacccgtcgagcccgcgaggctgagctcaaccgtcagtacatcgagcgcgccaactgacacgcgcatgccgccttgccatctagtcactgaatcagctagaacaaactaatcctcataatccagtcttttccaccaataccaggcgcaactgcgcccattacccaaacaaggagttcatccgctcatgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcaccttcttccagatgctcggcaacttctccttcggcgactacttcaaggaagaggccatccactacgcctgggagctgctcaccacctcgcaggatgagggcggctacggcttcgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaatgacaagctgcgcgacaacctcgccgtgaccaccaaggaaatgaagttcgacgacgccatcgccctcggtgccatgcacctgttcggcgagaagtacggcgacatcgtacgcgtggtctccatcggcgaagacggctggagccgcgagctgtgtggtggtacccacgtggaccacgttggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaacgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccctcgaagcgctcaagcacgaggcgcagaaagcctgattccgccagtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcgttgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtgaggtatcggttatgaccgatgattttaacgagttctttgatgacaacacgcattgggtcgaacaggggtcagaaccaatgcgcggggccgagccgccagaaccgccgaaatcccgcagggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcacgacactctatccgggaacgttcacattgaagaagcatatggccgcatccaaagtgatcgacgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacaagggtaaggatattctgcccaatgaagcgggcggtagctttgagggatggctggagccgggaacctacaacgtcaagagcatgaagagcgcttcggaaatcctcaaggccatggtcgataagcgtatcgccaagttggatgaattgggcgtgccggccggcagtgaccgcgaacgggtgatgatcatcgcctctatcgccgaggccgaggtcaacaaagccgattactacggcaaagtgacgcgagtcatcgcgaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaggcggcaattggctgtacttctgcacggtcaatctggacaccggcgaaaccaagttcgccgcaaccgccgatgaacatgaccagaacgtggccgaactacgcaagtggcaagccgaaaaccagtagtcatcccgttagcttccttcgcttggggaagctgatcggacgttggtctcttcattggctccctcgccgaggggagctgtccgcaaaaaagcggactgaggggagcactgcagggaatgtaacgctcaacttaagcccggggctcccgcgaagcggatggaagaaatctaggacaacaccccaacagccaccgccacaatcgcgcccgccaatatcaccggcacatacggcaccttgcccgcatgtgccggtgatgtgcgttgtgggtcgaatcgcgtccacaaggcaatccatgtgatgccggcaacgcccatcgccagccaccagaccaccacaggcaacaggccaaacagtccgacagacaatcccataggtatcaaggcggtcacatcgccgaatcccaatgaccgaggcaccagcaacgccaacgcgaactggatcaggcaacatagcacggtgaacaacagcgcctgcaacagcacgaacaggtcgttcaccaccactccatacgcgaaatcggcggccagctgaagcaacgcgcccgcagccacccacgcgatcggcacccgccgatgacgaacatcctcaatggacagtgcaagcccacatagcagaccgggtagcgtgaacaggtatggcatggcttaacattaacccctagctagacgtacacatagacgtacacacatgaaacgagggaagttatgctgcgttggcagacggcaggggagtctcacggagaagcattggtggccatgattgaagggttgccggccggcgtgcgtattagcacggacgatatcgtttccgcactggcacgccgtcgacttggatatggtcgcggtgcccgcatgaagttcgagcaagacaaggtccgtctgctgaccggtgtacgccacggcctgaccctcggctcgccggtggccatcgaaatcgccaacaccgaatggccgaagtggaccgaggtcatgagcgccgatgcactcgaccatgacctgccgcgcgaaggccgcaatgcgccgctgagccgcccgcgcccgggccacgccgatctgaccggcatgcgcaagtatggttttgacgacgcccgcccggtactggagcgctccagcgcccgtgagaccgcctcccgtgtggctttgggcgaggtggccaagcagttcttggatcaggcgttcggcatccgcaccgtagcccacgtggtggcgcttggtggcgtgcagaccaaccccgacctgcctctgcccacccccgacgatctggaagcgcttgatgcctcgcctgtccgtacgctggacaaagaggccgaagcccgcatcatcgaacgcatcaacgaggccaagaaggcctccgatacgttgggcggcgtgattgaagtgctggcttacggtgtgcctgccggcatcggcacgtatgtggagtccgaccgccgactggacgcggctctggcctccgcgatcatgggcattcaggcgttcaagggtgtggagatcggcgacggcttcctggaagcctcccgccccggttcgcaggcgcacgatgagatcgtggtcaacgccgacggccgcatcgaccgtctgtccaaccgcgcaggcggcattgaaggcggtatgtccaatggccaggtgattcgcgtacgcggtgccatgaagccgattccgtccatccccaaggccctgcgtacggtcgacgtgctgaccggcgaatccgcacaagccatcaaccagcgttccgacagcaccgccgtgcctgcggcatccgtggtggccgaggccatggtgcgtctgactttggcgaagtacgcgctggataagttcggtggagacagtgttgccgaaacacggcgcaaccttgagtcgtatctcgcctcgtggccggagcacatgcgctgaacgaagggcgtatggtttcgtgacgactgccgcggaaccatcagcaactgtactcaccaatcgtcgagaggattcgtagattatgaccgcacgcccccgcgccgtcatcatcggcatgatgggagccggcaaaacacgtgtcggtaaggaagtggcgcatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgatatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggccatgccatcgaaaagctcgagcatttccgctggaggcatggcaatgcggtggccgtcggtatggtgtatgccgccgagctggcccatctgatcggttacatcgatcaggatctggttgactatcaccgctcgttgcttgcttcgatgggtctgccgacgtcgtggaatggcggctcgttcgacgacgtgctcgcattgatgcatcgcgacaagaaggcccgcggcaatgagctgcgcttcgtggtcctcgacgagattggtcacgtcgtacacctcgacaacccgcccgccgaagccgtggaagaagcattccgtcgtatccagcagtaattgaacggccgtaggccgtgccgttcgccatcccctcagaaaaaagtacttggctcccctctaacggaggtaccccggagtcggatttaccttctacctccctctgatgagggaggtgccccgaaggggcggagggagagaagcacaaacaaaaggagtcccaatgaccaaagtcatcgttgtcaatggccctaacctcggacgtctcggcgtccgccagcccgacgtctacggtcgtcaagacctcgacaccctgcgcaagctctgcaccgaatggggcaaggacctcggcctcgaagtcgaggtgcgccagaccgacgacgaagccgaaatggtgcactggatgcaccaagccgccgacgagaaaaccccggtggtcatgaaccccgccgccttcacgcactattcgtatgctctcgccgacgccgcgcacatggtcattgacgagaacctgccgcttatggaagtccatatttccaacccgtccgcccgcgacgagttccgcaagcgttccgtaatcagccctgtggccaccggcaccatcaccggcatgggtttctacggctacaagctcgcgctcgatgctgtggcgcacttgctgagcgaatagaaccaagccctccagccaatcccgggtagcagtcgacgttgcgcccgggattcctgttacctgaggaaaccataagcgtccaagtaaaggaagccatgactctcaccgccacggaacgtgatctcgtcgatgccgcgtcacgctggtttgacgcccaccgcgcacagttcgtcgatgagctgtgtgagctgctgcgctacccgtcggtttccgacgaatcggacccgaatcctcgtccgggcgcgccttatggacccgaagtacgccgtgtattcgaccatatgctggccaaggcaggacgagacgggctgcctacgcgcgactacaccggccacgtcatggaagtcgtttatccacaggagaacgtggagaccgaccgtgacatcgccttcgtcgaccacctcgacgtagtccccgccgacgacggttggacgcacgatgccttcgatccgcaggttattggcgatattgttatcggtcgcggctcattggacaataaaggcgtcgcgctgaccagctatttcctactccgtttcttcaaggaacacgaccaccgtttccgccaccgcgtacgtatactgttcggcggctccgaagagatcgcgctcaacgacatcaaatggttcgtcgccaacatcggcgcgccgtaccaggccatcgtcaccgatggtcccttcccggtgaacaatatccaaaaagggctgctcgatgtggatgtcgaactgccggtcgggccgcaattgcgcggttggcatgccggcaccgccactaacacggttcccggggccgccgcaatcaccctcaccggcgtcgacgaatctaccgtgcggcaagcattctgccagagcggcaacatcgctccagatatcgccgagcgattgcatatcaacgcaacagcgcaaggcgtcacgattgaggccaccggtgtcgccggtcatgcctgccagccgtccggtaccgtaaacgctatagcggtgctcactacggcgcttgcccggtccggtctgctcgaaggccgtgacctcactgcagcgcaggcgattgcccaatggacaaaagactcatatggcaccggcttgggtatcgattgcgagaatgcggaaagcggaccgactaccgccaatggtggtttgattataccggcgaatgagttcgctgaagcagaccccgttgtctaaatgaaagtgcaacacccgttagattggaaattgcctagaaaacgttttctaggcaatttccaatctaacgggtgttgcactttcatttagacaacggggaatgacattcgtgggcgattcatccgcgcccgtctgcccttggccggctcggcatcttcgcggcgcgtggaacgcatccgagaccttcgatacagtgggctgcatgcatattcctacacaacgggagattcgataccagtgggagcgcggtggtccggtgatgacctgggcgctgattgttgcgtgcgtggcagtgtggctactggaggtattgttgggatttattgccccgggcctgagggcttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggctgtaaaaaaaaacgattgatgccgggtattgcggaacatgcagtgcccggcatcaatgtatgtgcggaaagcgacgatgtggatattagcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaaggacaacctaacgatagaaaaaacaatctaccgatagataagcgcaacgagccggaactcagcgccatcccatcgtcatcaggaatccgatcatgatcagggcgaagccgatgccgaggttccacgcaccgatgttcggaatcggccaggaaccggacggggagaggtagtacaccacgcaccaaatcaggccgatgatcataaacgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgtcaccaacgatacggctgatctggtggagcaaggcgtggacgaggccaaccagctgcagcaggacgtcagcgatctgaccgaacaggtcgccaatcttacggacgcgctcaaggccgatggcaccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgtcccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaaccccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcaccgattcgatggttgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacgctatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatggcaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggcttaaggtctgcggccaagacaacgccgtggccaagtccgccggcctccagcccaaagttacgaagtagcttttccgcgcggcgatactctccccggaatgtgtcgctagaacgaggcttgcgtactggttttgcgacgcttcccgggattgttgcgctgggatagctctttatacagcaaaggggaggggcgcagaagcccttcccctttgtgttgcgtgtatggttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacgggtaatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggacgtggaagcgttgcacacctcagggatggtgacggtgtcttccgaggacttgttgccggagccgttcatggcgaacacgatgcccacaatgacaagcaccgcgacgatagccgcgatcaccgaaccgatgatgatcttcttgcgcttcttggccttggccgccgccgcacgctgctgcgcacgggactgcaacgccgctgcattggcaccattggccggtggaatctgctcgaactgaccggtcaccgggttgaatgcctgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtatggcagacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttgtccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgttggccatttcggtctgctgatccagcagacggcgttcgatgcgtgccagcgtacgggacaccaccagcgcgtctttcgggcgatccaacgggtccttggccagcattgacatgacaaattcgcgtaactggacgtccaccgagtccggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccctgacccgtggagtagctcacaccgaaatcggtgatcttcacttcgccggtgtcggaaaccatgatgttggccggcttgacgtcacgatgaatcacgccgtgcgagtgggccacgaacaggcctcgcgcggtctgaatcaggatgggcagcagttcgatgggatccatcgcgcccttgctatggaacaggtccgccaacgatttcgaggggacgtattccataatcagaaagccgatgccgtcatgctcgtagtattcgaacaacgcagcgatattcggatgcgccagattggcggaattatgggcttcggcacgcaggcggcgtagcttggcctcggcgttggtcacgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtacacatctgtgttatgcaccaacaccgcgacggcgatttgcggatcgtccgccggcgcgaaaccgatcacccagccgtcgatggcagagttgtcggtaccgatttgtgcggtaccggttttggccgccaccttgatgccgtcgatggccagctgcggattggcctcggtcaccacgctttccatcatcgtggtgagcttgtctgcggaatcctcgctgaatgcgttggccatggtctgcggcttggtctgcgaaagcacggtgagatcggcggcgcgcacacgatcgaccagcgtgggctgcatcagtttgccgttgttggcgattgcctgcgcgaccatcgccatctgcaatggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaaagcggtgttggacgaccatgcgacggcctcttgcagggagatctgtccgttgacgccatcgctctgtgcctcgtcgttcggcagctgtgtggcggttcccggcaaggtatagctggagcctgcaggaatcttcgtgtccgtctgataatcgccggtttccagcgcagccgaggcgacgatggtcttgaacgtggaccctggcgggtacagctgcgaggtggcgcggttgattagcgggctattttggcccgcagagagttcgttgtaggcctgagacgcggctttggcgtcatgggtcgccagtttgttcggatcgtagctgggcgtgctcaccatggcgaggatacggccggtgttgacttcgatggccaccgccgcaccatcgcgcgtaccgagctgatcgtaggcaacctgctgcagcttggggtcgatggaggtttcgatggacgcgccctgattcgtagtgccggtgagcatggccttggcccgctgccagatcaatgaatcggcctcaccgttgagcagcatgctgcgggaggcttccaggccgcgatcggcggtctggttgatggagaagaagccggtgaccggagcatacagcgggccgttggaataggtgcgcaggtatttgaacgcgtcgttgaccggttcggatttggccatgaccgtgccgtccgaggccagaatggcaccgcggtaggcaccgagctggtggtacagcgaacgggcgttgcgcggatcgttgttcagcgcgttggcccgtaccgccatgatgatggtggacgacaggccgagaatcacgaacagcgcgaccacggcggtgaaaagctgacgaagatatttgttcatacgcgagtgcctccgttaacgggaggaagcgggggaatcgtaccggtaggcgtgtacggttcatcggcttcggcatacgacggagtggtggtatccacgatggggtcgtcaaacgattccgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgagttcgagatgatgatgagcagggtcgcgagaatatagttggcgatcagactggagccgccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctgaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcaggccgagcacttttttacctcccacggccagctggtcgcggtgatcgaacaggtaggcggcgaagaagaacgcaaggaacagcttggcgaactcgcccggctgaaactggcccagtcccggaatcttgatccagatgcgcgcgccgttcacttcctgaccgacaaacggcagcatcggggcgagcagcagcactaggcccaccaccatcgacacgtaggagaagcgccgcagcacgcggtagtccttcaaaaagatgatgagcagcgcggaaagcacgatggcgatgcacagccacaccagctggcgttgggccaccgcccaaccttcgctctggtcgatgcgggcgatcatggtcacgccagtggcggtcagcagtagcacgcaaggcagaatcgactggctggcgtacggctggaagcgcacaatcagcccccacagcaccagaaacagcactacggccaatgccagcatgccggcgtattgcatagggaattcgccggcggtgcgctggaacatctggatgaacgccaacgcactgattgccatggcaatcagcaacaaagaaatctgacgtagacgggtaacgatcattgagaatctcccgtggccgcgttgtcggccgctccgataccggatttatccgaggaatcggatgagcttgacgaaccggacttgtctgacgaggagccggactggctggacgaatccttggtgccgtccttggaatcgctctgggaactgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggctacggtgccgttgctatctcccacgtagtagtgcgtctggctccacgtgtacgcgccccagccggcgccggccaatgccagcacggcaagaatgcaggtaataatcaccgcaagcttattgcggcgcttcttggtgcgcgtggccttcttctgctcgacctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgtggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcaggtcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacaggccgtccgagcacagtagccaacggtcggcggggtgggctcggcgaaccgaaatatccgggcgcgggtcaatgtcaaagtcgccaagcacgcgcatcacgacgttgcgctgcgggtggttcttggcttcggacggggtgatacgaccggtgttgatgaggtgctgcacgtagctgtggtcgcacgtgatgcggctcaggcgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtttccatcatgcgggagatcgtctcgacgttgccaccggtgtcatcctgctcgatgtgggccagcgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcagaatggtggggcggttgatgcgctgctggttgaccacggtgccattggtggagttcaggtcttcaatggcccactgcccggagcgcgtgtcacggtagacacgggcatggtgggaagacacgaattcgtcatcgagcaccacggtgttcgaggcggcgcggccaagcgtgatgtcggcttcggccagcggcacggagctgccggcaagcggaccatcgatgatgaccaacagggtaggctgcgccgaggcggcggacgacgcggaagcgctgggctggcgatgcgggcgcggcgcagctgcctgcggcgtttcggccttggccttatgcacttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccaggtgcttgcgggagatgcccggatcgtcgatgacgatatcgcaaccggaaccgcggccgattaccgtcttgtctttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccgggcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccaaacttggcgaatactccgttgactgcaccctccacgcttttttcaaaacggtcgagaacgctcatagtcctccctttctaatcttcacccatcctacgcggtgatgggaatatgagacaaaaaaccggtctttcacgtgacgatgagtgcaaaatatccaaaaattcagggcggaaatgggtgcggcgcaccacccgaggtgctttaccggtggagcacctcgggtgggatgcgcgtgttatcgatttgtcaggccagcgcgtcgcgcaggaaatcgcgctggagggtgagcaggttttcggccacggtctcgtcattggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgtttcggtagtagacatccgggtcgaggcccagatagcgctcggtgtagtgcgtgtcgtacagcgtccagtcggtgggcggggcgccggcgcatgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccacatcggcgttgagccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaagccttggtcggcccaccactggccctcccagtagaaggactgcgaggcgatgacctgctggaagccgggcccgccgtacggcttcatcagcaccggcagcttctcggcgtgcgcgtacgggctttccgggctcggcgcgatgatcgccgtgtacagctggtgctcgcccagtcgcgtaaacgtgacgttcggtgtaaagccgggttcggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgattccaatccacatcggcgttgccggtgatgcctgcgtaccggtcgttctcatcgaacgccagcgtgatcacggtcagatacacgtcggcattgcgggtcagcgcgcgcgggtaacggcggccggcgtccggcttctcggggtcagccggatcgctgatgtgccaggtcggctcgtcggcggtgtcgaaggactcgaacagcacgtgctgcgaatccggggcccaccagaagccgtcgtatcggtccatctcctcgccggccacgaactcggccagaccgattttccacgtgttttcggccggattgccgtcctcatcctccacgctcacgccgtagacggcggtgatgcggtcacctagttcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacagtgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctctgccccgatgatcgcccccgccaccggcatgccgctgggcgtggcccgtgtgctggtcggcgcgctgtgcggactcggcttcggcaagaagcgcgtgttcgggcagtcgggcttcacgccggaattctcgatggaaggcaacgagggcgcttccgaagcgcgtgaacgctggtacttcaagctgcgttgcgagaatagcgaataccagacctactgcgcggcgttcgaatgggtgcgccaagcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccgacccgctttagatggcgggagagccatggaattatgggcataatgtcttctctccgccgccgcgccgccgcggttgcggccgcggtatgtgccggcgtgctcgcgttgaccggttgcacggcgttcaataattccgatgacggcacagcggacggcaacggcacgtccgccaccacgcagaccttccagccgtccggcggcaaaccgactgccaccctgagcattgcctccggctccgaaaacaaggaagtcgccgtcgccatccagaaagcggccgaccaatccaacgtagccgtgacgatgcactacatgggttcgctggagattatgaacgcgctcaaggccggcggccaggattacgacgccgtctggcctgcctccttgatgtggatttcgatgggagacaccaagcacatcgtcaaagacgcggccagcacctccaccacgccgatcgtgttcggcatcgccaaatccaaggccgtcaaactcggctgggctgacgacaccggcgccaccaagcccgtctccaccgcggacatcctcgccgcggtcagcgacggcaaactcacgttctccatgacctccgccacggtgatcgacagcgcgctcaacgtctaccagaccgcgctcaggaaacccagctggaccatttgggtggtcgattactccggttcgatgtctggagagggcaagaacggcgtggtcaaaggcctgaacgcggcgctcgacccggaccagggcaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcaactcaactcgatcgccatgctcaccaagcaagtacgtgacccagccgtcaaagccgaagccaacgacttcatcgccgctaccaaagattgagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggtacgaatcgaaaccatcgaggcgctgcaagtgctcgaacagaccgccgccggcgaactcagccgggcggtaagcgccaagacgttgggcattacggccgactccgacgccatccaacggttggcccgcatggatggatacgacgacgtcgcaccttcgcctgtgccttcctcggctgctgatgaaggacggcatgcgcccagtcagactccatctggtggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcgccggccgaaccgaccgaacaggtgagcatcaccggctatctgggcggcgagaaaatcggcctgttcgatgacgccaagttcaaggcgctcgccgccaagcaaggcattgccatcgactatcgcaaggccggatcgctggccatgatggatgcggaccggaaaggcatggattacctgttcccctcctcgcgcgcggccgtcgaatacggcaatgcgaaaggcgtcaaggccccccaaagcgacatcgtcttcaactcaccgattgtgctatacgcgcacaaggccgtggcggacgggctcgtgaacggcggacttgtgaccaaggacgattctggcgcgtaccacatggatatggccaaagccgtggacgcgatggtcgccaacacaacatggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggacgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaagaacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggctctcgacctgcagaacaaggccgacgaagtgaccaacaagctgctggcgcgtaacgcggccgccctgcacaagggtgcagtggacgcggaaaaggccaaccagcgttccgtggtggaaatcgacacgctggagaagatcaacgccgaactcatcgccaccctgaaggagaccgtgcagatccagaaggaaggcaaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcagccattcccgccgcaatttctctgtgggcataatcccggaatgattgccgcgctcgggaattggatgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgactaccgatgtgcgcgagaccgacaagggttacgacgtcgacatcgatatgcctggctttaagaaggaagatatcaaccttgagctcaacaacggctatctgaccgtgtccgcctcgcgttgcagcgagcatgaggacaaggctccggccgctgaggacgaggcttccgacagcaagtgtgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagctttgccccctctgacgagggggctcccgcgaagcgggtgggggagagataaatcgtaaccaagccatgcttcccacgccgtctgccctacgctttcaacgccgactaacctgacagacggcgggaaacatagccaatgcaaatgccgggtagggatttaccctacccggcattttgctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccattccggcggccacgtcgtatccgcgcgcgccacgaccatcggcctgatggcaatcctgctgtggagcttcatggccggcaccgtgcgcatcgtctccgaaaacttcggcgccacgcttggctcggccctgatctacacggtcggcggcatcctgctgctgatgttccggcgcccggccccgattcgcgagttccccaagaaatacctgattatcggcggcctgttgttcgtattttacgaatcgtcgatatccctctcgctgggtctggcctctaccgacgcatcctcggtggaagtgagcctggtcaactatctgtggcccacgatgatggtgctgctgtcggcgggcgtatcccatcgcaagcacgcggtcgtcaaggtgctgccgggcgcgatcgtggccactgccggcgtggtgttggcggtcggcggtaattccgggctcgactggcatgcggccgtgcagcatatcgccgccaaccctttgccctatgcgctggcgttcgtgggcgcgctcgcttggtcggtgtacgcggtgttcacgccagccatgagtcatggggtggacggcacttcattgttcttcccctgcgtggccgtggcgttgtggattatccacttcgcgtccgggcaggggtggccggccgagccgccgagtctggtcgcatggctgtttgtgttgattgccgcggcggcgattggcggtggttatgcctgctggggctatggcattctgcacgggtctatggagcggctggctattgcgtcctatgccacgccggtgctgtccaccggggccagtgcggtgttgctgggtttagcgctgtcgctgccgttttggtgtggcgcgctgctggtggccgtcggatcggtgcttaattacttggtcagtgcgcgcaaatagcggggtggctttgctcatggggcggtaataatcccatggggcggtaaaaccctcatggggcggtatcccaaaatgactttattctgcggtttcacaatttcttcaaaccgccccatgggccttttaccgccccatggataaattaccgcccgatgggcagcagcaacttactcgccgcgacgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggttttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggacaagcctgcgcgccgctaatccagcgctgacactggccttgagctgcggacgtccagaccggatgtgaacaggtgctgaacggagtctggggaaaccatgagaactcgcgacaatttttgtgaaattgggtgacgctctatgaatcgcgcgctagtgttgcgtgagcttacaaggcgaggagcctggagcgcgggggggtgaaggatgaagaactccgtttggaaaacgttcatggaattgtctctggtccgcggaatcgtgccacggaccgtgttcggactgaccgcgatcgcggcaatcatactggttattggactggcgctgagcaagagcaataagcgcggccgcctgcacccgctgattgtctcgctgattgccgccgtgctcgccggcgcggctggaatgctggttgcatggctggtgtccgacgtgtttatggtgttcggcgtatcgctggggtggccggtgatcttcaccatcgcgggcggcatcgccggcgtcggcttcgtgatcgccgcagccgtgaccctgcgcggggtccgccgtgcgctggccgtcgtgctggtgccgctggtgctgctgtccaccgcgctcggcgtggactcgatttacggcgaataccagaccatcggcaccctcgtcggctacacgccgtacgcctcgctcggctcaatcgaggtacacaaggccgcgatgagtgtcagcgactggcatagcaaggcgcggaagggcagcctgccgtccatgcccagccaaggcaaggtgctcaccgtcgacattccgaacaccgaatccaacttcacggcccgcaaggcgatgatctacctgccgcccgccgcgctgtccgaccgtccgccggccttgccggtgatggagctgttggccgggcagcccggtagccccagtcgcctcatcgacgccggcaacatcgccgccacgatgaatgcgtacgccgccaaacatgacgggctcgcgccgatcgtgctcgtgcccgaccagaacggcgaggccacgcacaacagcctgtgcgccgacaccacgcaaggcaacgccgaaacctacctcaccacagacgtggtgaactgggccaagaagatgctgcccgtggccaaatcggcccgcatgtgggcgatgggcgggttctcgcaaggcggcacttgcaccacgcagctcgtcccgcgccaccccgacatctacggcgcgatgctgccggtggacggcgaactcaagccgaccaatggcagcgtcgccaagatggtccaggagtatttcgccggcgaccgcaaggcgtacgacgaacaggtgccggtcaacgccatcgccgccaccggtacgcccgagcaggcgctgttcaccggtgctggcgaacgggacaaggaatcgattagcaacatgcgcacgatcgccgacgccgcgcgcaaagccggcatggaggtcaccgagctgatcgtgcccggcaccggccacgactggcacgcggtgcaggcggtctggcggcccggtctcgactggttcggcgaacggaccggcttgggcgagatgacgaaatcgttgaaggagtacccacaagtggaggtgttgcaatgagcgaagaatcgcgtaagcacaacagtcatgcggcggaaagctggcgcgaactggccggcgacgtgcgacagtgggcggacggtcatcgactggccatcactgccacggtggcgctggtggtgctgaacttggtggtgtggctggtggtcgcgatggccggattcgcgttcccgctgcggctcgacaccagcatggccgaattcgatttcggcaaactcttctgcacgctgttcttggcgcgcggcgtcatccagctcattcttgatgccgcgctgtggctcgtcatgctgtcaatcgccgagccgtggcttggccgcgcacgtaccgtcggcaccgcgctcgcctgcgcgctcggcggcgtgatcgtgggcctgatcttgtgtgcggcggccggatggctgttccaggactcccaattcgtctcccgcatgcagttcgccctgagcccgctggtgttgccggtcggcgcgcttatggcggccagcgcgttctgcagccatctgttgcggcggcgtattcggctgatcggctacgtggcgattctggtcgcgctgctttacagcggcaatcctggcgattactgcattctcgccgccgcgctgatcggacacgcggtcggccgcgtgatggccgggtcgcccgcgcatgccgagaccggctggcactggctgcgcagcacctccttcgaggcgcggcgcatgtttgcggccatcgccgtggtgctggcgctggggccgatcatcgccatcacctcgcataatcacgcggggccgctcagcacggtcggcctgctcatgagtccggtctccgttgacgacggcacgctcgcgcgctgcctggccggcgccacgcacagcggctgcttcctgcaattcgacctattgcgagcctcgatgccgggcgcggtactgcgttcgctgctgcccaccgccgtgaccctggtgctggcgtggggcctgtatcgcggccgtcggttcgcggccatgtgtgccgtggccatcaacctgttcactgcgggagtagccatcgcctactacctgatcgtgccgctgagctttgcgccggacggcatgacctcactgctgcagcacggcgcgatcaccgcctgcgtggcgaacgccttgccgccgctgttctttgccgtcgccttgactgcggcgttgaagcatttcccgattcgcgtcggctggcggcgactgatcggcggcgtcggcgccatcgtgctggttctgctggcgtgcgccgccgtgtacctgatgtacggcatcgcccagccggacgccttctcgccgcgcgccacggcctcgtcgctgttggccgaactgccggggcgcttcctgcccatcggcttcctgagccatatgaagttgtcgttcgtgccgcgtaccccgatggcctcgatcgtgtatcagggcgtcggcctggtgttctggatcgtggtgctggtcgtggtgatccgctggatgagcgacgtgagcgaatcgaacgagcgggcgcaggcacgcgccgagcggctggtcgaaaccggcggcgaatcgatgagcttcatgactacgtgggaaggcaacagctactggctctcgcccacgggcaaatcggccgtggcatatcgcgtgctcaacggcatcgccttgacctgcaccgggccgttcggcgagccctccgagtggatggacgacctgaccggcttcacccagtattgcgtggagcggtcgctttcgccggtgttctacagcgtgcatcgcgaacagcgcgacgcgttgctggaggccggctggagctccatcgaggtcggcagcgaaatggtcgtggacccgcgcggctggaagacgaccggcaagaaatggcaggatgtgcgcaccgccatcaacaaggccaagcgcgacggcgtgaccgatgtgcagtccacgttcctggaagcgtcgctcgatgtgcgcgagcagatcgaggacatctccgaggagtgggcgcagctcaaggcgctgccggaaatgaagttcacgctcggcggtgtcgaggaactgcgcgacccgcgcgtgcggctgctttacgccatcgacgcggacgggcgcgtgctgggcgtcaccagctggctgcccacctggcgcgacgggcgcatcgtcggctggacgctggacttcatgcgccatcgcaccgacagtcccaacggcattatggagttcctgatcgcgcgcatggccgagcgcctgcgcgacgaggggcttgcggatcctgagcatgccgtagagttcatgagcctgtccgcggcacccttggccggcatgaaccccgagcgagacaatgcccgggaaggcggggtgccggccggcgaaggcacgcaggtgctccaacacgcgctgcagattgtggccgactggatggaacccgcctacggcttccactcgctgttcaacttcaagcgcaagttccagcccaccgaagcgccggtctacgtgtgctacccggacccggcggcgttgccgcagatcgggctcgcggtggtgcgcgcctacgtgcccagcgtgacgcccgccgaagtagccggcatgctcagcacgctgcggtcgtgaaggtgtgcacacgggtacgcaggctagccgattcgagcctgagacggggtatctgctttcagagaggtacatttggcctcttgcggacaactaactgccttcaaagaggtacctgaactctgaaatcccgagtatgagcgttgcaatgacaacgtttgtactcggggtttcccgtattcggtacctctttgaacgaagatagcattctgcagaagcccgaatgtacctctttgaacggagaaagcctgacaaggagggcgcggcaagcgctatctccgtttcgaggggctgatttggtctctcccggaggtctactcccgtttcgaggggctgatgccgaagtattcacgctccaaaatcggcggaatggcgttggcgcggatgggtttttacatgcggtctagcggccgaccagccccttgaaacgggagtagacctccggcgggggtcaaatcagcccctcgaaagcggttttgccggtgcagaggtgtcgttgactgcatcgcgagccgcctcgacgtagtaacgtggggcgtatgagcgaacgtaacgaacacaatgacggaaatacgcaaaccgcatacttcgccggcggctgcttctgggggctggagcgctacttccagaacgtcgacggcgtcacggacaccacggtcggctacgcgcaatccaccgtcgaatcgccgacctacgagcaggtctgcgcgggcggcaccgatgcggccgaaaccgtgaaagtcgagtttgacccggcacaggtcagcctgcggacgctgacattgctgttcctggaggtcatcgacccgttctccgtggaccagcagggcgaggaccgcggccggcagtaccgcaccggcatgttctacacggacgagacgcagcgcgccgtgtatgtggcggctctggagcagctggtcgaccgccagccgcagcgcccggccgtactggtcgaaccgctgcgcaacttctacccggccgaggcacaccatcaggactatctggtgaacaaccccggcggctactgccatgtaccgatcgccgcaatcgcgaacgtaaaacgccgtcagaagtacgtggaacgcatctgggatctgacgcttgagcagttcgcggtcacgcagaacgccgctaccgagcgcccgttcgtcaacgagtatgacgaggagtttgagcccggcatctacgtggacatcgtcagtggcgaaccgctgttctcgtcgcaagacaaattcgattccggctgcggctggcccgcgttctcccgcccgattgccggtgacttgctgaccgagcatgaggaccaccgcattccgggccgcgaccgcatcgaagtgcgcacgtcggacacacagattcacttgggccacgtgttcaccgacggcccggccgaccgcggcggcctgcgctactgcatgaattccgccgccctgcgcttcgtgccgcgctcgcgcatggccgaggaaggatacggcgactggatttcggttgtggatggggatgagcaggcatgagcatggagaatattgcgggcgctcgcaagcccgccaagcgtgaggatgagcacacggtcgccggcgagcatcgcatgatgcgccgcgcggaccgcgaggtgaccaatcccgagcagatcgccgcgattgtcgccgcttgcgacatcgtcgaagtggcctatgcggatgctgagggcctgaccatcgtgccgctgaatttcggctttgattacgagtacgacgaggcgactggcaagctgacgctctggttccactccgcgccgcgcggccgcaagctcgacgcgattcgcgccgccgccggtggccgactgcccgtggctttcaccatgcagaccgactgcgaggtggtggcgggccgcaccacgtgcaattggggcgagacgttcaagtcgatcgtcggcaatggcacggcgtcactggtcgaggatctggatgaatgccgccacggcctgcagacgctgatggcgcagcaggcgcatatgccgaatgtggaattcaccgatgcgcaggtccgcagcgtcacggtgtggaagattgagtccgactacttcaccaccaaagtccgcaccaagcctgcgcccacgcacatgcatcagcaccctgccgtgccgcgcgcaggtgtgatcggtgcccgataacatcattgcagcaaggatgggatgtcggttgtggtgcggctcaacggttcttaacgtaccgggtgccgcggccggcgcccagtttggtgatggtgccgttgtcaagcagtgtcttcagtgtacgttcaacagtgctggcgctgatatcgggcaattgttgaagtatgtccgcttttgagagcggcgataacgtgcgctcaaatagattgccgatacgctgctccttggtgggttttctattgctgccccagtcggacacttccccaatccgttcgtcgaactctttacaggcagtgaggatgacgccgagtaaatagttcacaaatggtgcatagtcgttgacgttgtcgttccagccgtatgtgctcgcggcaagtgcctcgtaataggtgtctttggtccgttcgataaggtgttcaatgctgatatatttacctacttggtaaccattgcggtagagcagtagcaaggtcagcagtcggctcattcgaccattgccgtcattgaatgggtggatgcaggtgaagtcgaaggtgaacattgctgtggcgagcaatggatcgatatgtccgtcttggatggcttctgtataggcggcacaggcgcgctcgatgagctccggtgtgatgagtgcgtttgggggcgtgaaacgaatgatttgttttccggtggcgtcgcgctcgatgatggcattgtcgctgtctttgaaatgtccgccgaaagcgaggccggtgtatcggaacagatcgcgatgcagttggaggattgtatttggggtcggtggaatgtagtcgtggctttcgtggatggtggcgagtacgtcgcgatagccggtgatttcctcctcggcacgattgtgtggcgtggtttttcctgcaaccagtgcgttgagtcgcttgtcgctggtagagataccttcaatacgattggatgcgttggtgctttgaatgcgtgcaaccgcgatgagtgtgttcaacaaatcaggcctgattgcagcctgtacgctttggcgacctttggcttcgtggatggcggatagcagcgttgtggttcgtggggtgagcagtcccttggcggcggtgatgtagtcaaagtgcttcattgtgagtctctttctgcatcatcaaatagctttctgcatcatattctatcaatatgatgcagaaaaaacgatagatgatgcagaaaagtggattgttattcccttgatgatggtgttgctcaaatctcacctcccgttggcgggaggtggcgcgcagcgccggtgggtggcctgcgcccgaacccgataaacttgccgcatggcagcagtgacagtcgtaattaccagctacaaccagggtccgttgattcgcgaagcagtcgagtcggcattgtcccagacagttcgcccggaacgcatcatcatcgtggatgatggttccgatgagcaaacatctgttgatgtattgagcgcaattctcgatgattgccggcatggagcgttggatacgggcggtgtcgccgtcgatttcatcgaccaggtgaatgcaggtccctccgccgcgcgcaaccgcggcatcgccgctgccgggacgccgttcgtggtggtgctggatggcgatgaccgtttgatgccgaccttcattgagcgtacgttgccgttgctgactgctgatgattcgatggttgcgtcctctggttggctgcgtacgttcggggttctggactcagtggtccagccgaccggtggcgacgcgggagcgttcgtgtcgcataactgttgcccggcaacatgcatgattcgccgctcggcgtgggagcgttgcggcggatatgacgagtcgatgcgcagcggctttgaggattgggatctctttttgtcgatgttggagcggggattggaaccgaaagacgacgccgggaagggcgcggcccatatcggcatcgcccccgagcccctgatcgaataccgcacggccccggcctcctcaaacgtgaccagcatgaccaagcgcctcgatctcatgcgcttcctgatcgccaagcatcgcgatctctacgccgcgcacatcgccgacgccatcctcggcgtcgaagccatctccatgagccgcctagccatgtgggaatcgttgatgcgcggtgacaccaccgccagccaagccttcatgacccaccccacctatggcgacggcggaatggccgccgccgttcggctacaaagctgagtctgactgttaatacgcttgatctatcaactgtttggtgagatcattggcgtgacgtaaggagccgctgatgtcctcataccgtattgacgaattatccgttgaccaactcgatcgcataagtttgccaaaattccaacgagggtttgtttggacaaaaaagaagcaggaagatttcgtgcagaccctgcatgatggatacccctttggtactttacttgtttatccggagaacgataacgataaagatgcgaagctccaactattggacgggcagcagcgtctatctactattaagaagtatcggcaagatccattgcagttttggaaaccgttgaacagggaatcgtatacaagcgtctatcagtctgtaaagaagatgttgccggaaggggatcccgatgtctatttagaagtgcaacacccttgttggtcctgtaattctaacagttgttttctaggcaatttccaatctaacgggtgttgcactttcatttagacaacgggctcttccgggaaaggctatttgccgtaatactccagcaggtgtgggtcgacggcctgcaccacatccaccaaatcgccattggagagatacgggcgcttgaattcgcgccacggctccaccttgacctcccagcggccggtcgtctcgtcgagcacgggccgggcggtctgctcccagcgcacacgcttggaggtgcggccggtttccgggtcgcggcgtgtatagtgcaggcaggtgcagttggtgatcttccagtcgtccgaatcggcgcgatgcaggaattcctcgtcggccaaatcctcgatggtgagcatcagggcgagcatgaagtcgccgtgggtgaccatgaccacggattccgaatcggatttgcggctcagcgaggtcaggatgttgtgcacacggtcctcggccacatcggcaatcgactcgcctgccggcggacgccagtacagcggatcggtgttcttgaagttccagttgcgcgcgtagttgtttttgaattcgtccttggtgatggtgttgatctcgccccaagaacgttcgcgcagcacacggttctcctcccatttggctttgggcaaggccatggtggccgcggtctcgcgggtgcgcacatacggcgagaccatgtagcggtcgaacagctgctgctggctgaccagccagcggccgatgcagtcggcctgcttgcgtccggtggcggtgagtctccaggagcggtcgggtacggtgacgttgtcctgcgtgtacagggaattgtcgccctgctcgcccgcctggacgatgacgttcgcttcggattcgccatgccggattacgtatagatcgagcggcatgctcatatatgttcccctttcgttattggttacgttgtgttgttttctgttgtttcctacttgacttgcgtgatggtgttccccttgaccatgaacgcgtgccgggccatgtcgatcatcggctgatcgaatttggagtcggtgtagaactcgtcgatgacgacgtccggaccgtacagttcgcggaaccgtttggccttgttggtgctgaagttgaggtacgtgaccttcatcgtccccacatccacctcgctggccacgagattcctcacgccgagtctgcggcaggcctcccccaccgtcagatcgaaggatgcggtgaggatcacatcgtccgactcaggctggtaccaaggcttgatacgtgcgtaatatcggtcccagaagtcgtccacgagctgttcgacgctcgccacccgtttggatcggctcagttccgtgagatagccttcggtcatcttacccacgccgtattccatttgttcaagcgtggcccggccaagcttgtatttgactgcgtaccgcagcacgggggcgatgtagcggaacactttcgggtcgtgccgggcggaatacaggtacaagtcgaacaggctttcgccatcatagatggttccgtcgaaatcgaatacgcgcataccttctgcttctactctgttattccttgtctaaggctaatctcggtaagccggcgaaagcgcaaatacgcagtgaatttcacatgaacactgttttttggattgatttcggtacaggtaacgtacactggtgacagcgtggaaggaggtgcgtaatggcgacgtctgaaatcgaacaatggtggattgataagtttcaggagaacctgggtccgattcgcaaggtagccggatggacgactcagcaactggccgacgagctgggagtcgcgcgacagacggtgtctaacttggagaccggcaaaagcccgatgaccaaactgcagtatctcgctttacgtacggtgttcagcgccgagatcgcacgtcgtgaagaccgcgatctggcacgcatcatcaagactttggtcgacgatcccattgagcaacgcattcgcgaacggcgcgcccaagagcaagacggcgaggccgttgccgacaatgccccagtcaatacaggctgtggcaacgctgccgacaacgccgccaccgagaaacgcaagcccagtgccgccacattgaaggcttcaaagactgccgcaacgggcaagcccacgctcagcacggcgatgcaggctctcgccgtcatcaccggcgcattggccagtggaaccgccgccggcatcatcacctacttgatgttcccggacggcggcccgaacaagcgctgagtcgccgaaatatcgaaacggattgaacaacccagttcgaagccctgagcaccattttgtccgtgtcgcaccagcgtttccctcattatcagctgtttcgagttgcatgaatgcaccgtttacaggccgagaatttcgtgcttttttgcatcaaattcttcttgggagagaatgccgatatcaaccaattccttcaatttcttcatcgcctcgacttgttcttccacagacatggatgccgtgtgagaggcgggagcagcggcttccggtgccggcgcaggtgccggcgcttgaaccggggcggcagtcataggattgatggcttgcgccatattcataccaagcaacatgccgccatcgccaaagccgttgtcttgaataccttgcgcaatgcgctgctgggcagccatattgccagcttgttgggaaacgccctcgtatgcggcaacattcatcttattcgaggcgaactgctgcacgagctgacgtgattgctcggtgaactcgatgctttcgatgcccacgctggacacttcaaagccaaaacgatcattccatgtaccggcattggctcgatcgccacgcacgcatgctgcgatgtcattcgccttgccgggcaattgcgaaatacgatattcattggacaacgaattgatggccacaataaacgactgtacgaattcggacagaatctgcctacgtggcccttcatcatcgaatgaatacgacacggtagtggcaggcacaaagttacgaacgaatcgaactggatcagtgacctttagcgacatggctccgcgtgcgcgaatttccaaatcgacgccatagaaccggtcgttatacaccagcggcgcagaagtgccgaatttgatgccacgaatctcacgcaggttgacgaaggccacatatttggtgcggccaggctgacctccgaaggtgaatcgatcggcgacctggttgaagaacgatccgatgccgtctccggcgagcacgctctgttccccgttgcgatattcataaccgcccgactcggtgatgacgttttcgatacctgtttcagagaaaatgaacgccgcagtattctctggcacatagatacgcgaaccattggtgattattccctcggaaccgtattcattcgaaccgcgatcgttgttgcttccgcggggaatgcccggcacaacgacggtgtgttccgtgaacggaccagcggtgatgatatcacgccacaggtccgcgaatgtaccgccgagcgcgccggcgaacgccttaataactgccatctgttttttcctcgatatctcatgcatatggccgatcttgcgactatgcaatcgcaagaccggccgttatgctggcatgttggttatagctgcgtttcgcgatcgcagtattcgcatcgaacgacttctttgcgatgaccggaaagcggagcgccacaaccttcgcaattcaccgaaaccacgggttcggtaatcccaagcccactacggaatgcgccaaaagtgtccttcagcgccccggccagagcctccgttccggggatggccttgttgaagaccggctcatccattggcgtgtactgtctgccgcgtatacccatgtatcgtcatcgttcctttcttggaaaaccgttacctcgatacgccagtctgatcactggcccaccgatgcgagcttctgcatgcatcgagtcatgacctcggtgtagtaggccgaatcctcactgctgagggagttttcgtcaatggcgtctaccttctgggagaactcagagtaacgcttcatcatgctggcatagtcggtagccatgctgaccacgttgtcggatttctgatatttgttcatgaaggcaacatactcatcgataaaggcctcgtagctgtccatcgtggccttgaagtcagcactgtcattggtgttctgctgcgccttctgatccgaagactggtcgctctgcttgttggcatcgctggaatcagtgcccgtaccagtgctcttatcatcctgtttcgcggcgtcgccgtccgtagacgtatcttccttcttttccggaacctggatagtgatggacatgatggtctcgtcgtcagtgttacgagaaacgctcacactgtatccatcggcgttcttggcattgaaactgtcagcggacttgctatagtccacggtgaaaccgttgtcttgcacggacttgacgtagtcggcatactgcttggcgtcggtaccgcacacctcgatggagaaatagtccgaagactcgcttttaatttcaccctttgtggatttcggctgcggcagcagcgccgcgatatccgactccggccatgaatatgcttcgcacttggtggcgagcgatgcttccaattccgcccgatcagccttggccttcgcatcgtcacgaattacgaacacgccaccgattaccagacccacaacggtgataccgactgccacccaggccagcactcggccttgcaccttgccactcgggcgggtcacgtatacggcgaagcctgagagcagtgccggaatcaccgtggcgaacagcagtccgccccaggatcggccagaaacatccacaaattgggcgagtacgaacaacactccccaaataatggcgaacacagccagcttggaagtcttcttcaccccttgtgcattcggagcaagcacggcaggcgcagcggcaccagcaaaaccagtggcagcaccggcaccatgtgtggcgggtgcaggagccacaccaatacgcttgtccagagcggcgaggaactcatcaacgcgcttggcgctttcgtttccagtcgcctccagacgaatggcggcccctgccgcaccctgcgggactacggttagcgtgcagttcaccccatcataggagtggaaggaaaacgctccggtctgggtgttttcgttatccaaggtaaacgtggcgccagtagtcagctggtcgtgaataacttggaacagctgttgcggactgaccgcatatacacgatcaaatggcgcgccggcgggccgctgcgatgccgtagccggagccatcggagtggtggtagcaccatcagacgctacgttcggttggccagccggtacagtattcggcatggtaggcgcattcgcgcgatcttccggtgcgtcattcgtgccttcggacggtggaaccggctgaggttgttgatcaaatggcgttgtcatgatgcccttctttccttaagcagcagcattaccagcacagaagaggcaagcccggcaaccgttacggtcaatccgactgccatggcaagccggtatcgttcgctcatcattgcgtcccttcttattgctcgctttgctctgcgatacatcgaaaccagtgtatggcgttgttattatgtacgcaaattagcattttgtatgcatgttagctttattgtcgatgcttgataccgcgcatgaacatcctttccgccaccgcacctacacggatggcatcgaccattgtcggcgacacgcgcgggccatacatcagctgacaactgaatttttcggcgtgtttccgaaaagtcggcgtcctgtacgctgggaatcgagcaaccgcgtacgatggcgcagcacagcacccgcaacacagcgacaaggagcatgggcaatggcagacatccccgaagaacatttgaccgaggaactgttggatcggctgctcgccagcgccagcattgagcagtatctcgatgagggactcgtcagcgcacgcacgctgaccgactatctgttcgaccgtatggaagcccatgacctgagacgagccgacgtggtgcgggcatccggcctcaacgccacagtggtttatgacattttctccggcaaaagccgccccggccgagatcacgccattatgctggcttttggtctcaagtgcacattacgtgaaacccaacggctacttcgtcttgcaggcgtttccgaactgtggtgcaaacagcgacgcgacgcgattatcatctggtgtatacgcaatggattcgaccgcattgccacggacgacgagttgtatcgtatgggagaggcgacgttgctaccggccgattgacgacattcggcccaacaacactcaccagtgagacgcaagtaagagggcgtcaaggagagacatggacgataagcaggcgatgcatgcgatgagcatcgacgatgcgtaccatgtcgagcgtacgctcgctcgcggaccttccggcgtcaccgaactggtgagcattgacggcaacggcccgttcgtacgcaagaagattccctctcccctagcgcaacgcaatgtgtgggcggcgctcagcgcctgccagagtaatcgtctgccgcgtgtggaagcgacgtacgagctgcccgaccggttcgtcatcgtctacgattacgtgccgggcagcacgcttgcgcaaattgcggaggaaaacgggcggcttgcaccgaatgtggccgtgcagcttatcgaccaaatttgcgaagccgtgcaggagcttcaccagcacggcgttatccaccgcgacatcacgccggccaacgtcatcgtggcccaggatggcgcgcatctcatcgatttcggcatcgcgcgcatccggtcagaggcaagcaaccgttcacgggataccacggcgcttggcacctacggattcgcctcgcctgagcaatatggctttgccaaaaccgacgcgcgttccgacgtattctcgctgggccggctactcggattcatgctgaccggcgtatatcccgatgccagcgactacgagcagcgacttgccgatgatgccgcagtaccggctcgactacgcgccgtcatcggctatgcgtgcgcattcgagcccagcaaacggccacagagcatccaagagtttcaccaggcgctgttctcccagtccaatccgcccataccgaacgcatcatcggcaaatccgccatcaacgagaacaacgaacggcagcgcgtcggcgtctcgactattccggcgtctgcacttgagcaaacgcgccatcgtgctgtggtccattgccggagcggcactgataatcgccgccattgcgggaggcattgtgttggcaggccaacttggcattatcgggtcggcaacatcacccgattcctcgacacaatccagcagccaatcaaccgataaggccgatggcgggcactcctcgaacgggtcaggaaccgacaatgccaatggcacgggcggagtaggcggcactgacggcgctgatggagacaatcaagacaccgtcaccgacaatcctctgaaaatagtggaatccggctggtcggcggaccagcaagggtatgtccactacgctttcgccctgcgcaacaccagtaagacccagcaggtgcagtatccgcagattaccattacggggcgggccaaagacggttccatcgtgttctcgcagacgcaagcactgaatatggcattcccgaatcagactgtatatgacgccggccaagcgggcgagggcacggccccggccaccgtagatttcgttgtgcttagccctgatacgtacaacgtcaccgaggctcaaggaaccgctaccttccccatcagcggaacatccaaaatagacaacagggacggcggcacgacgttcaatggcgaggtccgcgccgtggcagatggattcaagccatctgatggacagcaaatcaagatttccctagtactgcgtaacgcacagaacgcaatcatctatggagatatcgcattcgtggattggccgggcaatggccgatccacgccattctcgattaccgtctacgatctgccgaagtatgtgtcttacgatctgtatgcgcaaatctggtagttgactttacgtctggcaggtggccgtcaggtgcctgtcaggccgctgttcgcgtcacctgcgcactgacgttacggcgcgcctggccgaacagatagatgccgatgggcagggtcagaacaccgccgatgatgaacaccagcgaaatcgggatcacgtcggccagtggcgcgaagatcaacatgccgagcggcattccgagcgtgctcagggtggtgtcaaggccgaatacacggcccaccatcttctcatcggcctcggtctggatgatggtgcgcatcgggcccatgcagatggccgaagccaaaccgttcaccacatcaatcagcaaatacgccagcagattgtgaaccacgccaagaccaacgacggagacgcccaccagagcgatgccgaaggcgaccacgcgcatgttgttgcggatgagcttggcaccgatggtagacatcagcgcgccgccgagcagcataccgatgctccatcccagctcgttggcggcgagtttatcggaggcggtggtcaggttgatgaatccgagattcaaatcgatgccctcatattcgcgggtcatgagcaacagcgtaaggttcatcggcgccacggccacgaagcacaccaaggcgtcaccgagcaccacgttgcgcaggttcgcccggcgccatgtgtagctgaaaccatctttcaagtcagcaaacacacgacggacgctggcaatcagcgaacgatcagcattggcatccgacatcggttcgagtgtgggttgcccgctattctccgcttcagccatacgcctcgcaacatgttccgtgctcttcttcggcgctttgatcaacgccacaaagccgacgccgataatggccgtggtcacatcgactaacagaatcgaccacagcggcactgtgttgataagcacagcagccaccgcaggtgccacaatcatattcaccgaattaatcacgccgtatattgagttgacgcgcaatagtttgcccgagggaacaacatccggtatgaacgactgcacagcgggcgtctgcaccccgcctcccgccgaacgaatgaacagcaccacgaaaatcatggtcagactcgcccatcccatcgcgaagctcagcgacagcacgacggtgaccacagcaatcaccatatccggcagcataatcagcaacttgcgactgtgacggtcggcccaggagccgccgcaaatcgagacgatggcctgcggcaccacgccaaacaacgtggccagcagcatggccgaaccggttttagtctgcaatacgatccaccaccagatggcatattgcacaatattggagcccagcagcgagaacgcctggccggtgagtagaagcactacacggcggatccacgcacgctcggattccccgttggccactgctgcggcataggcggcaccgggtttgttcgcgctatggaccgctgcgcgcgcattcgcattgtcatcgccggaaacctcgggtgtttcgcgcacagttggttcagttgttgtactactagaagacatacgagtgttctcaattcttcaattccactacaaaggtcacatcacggcatacgcacgccgacgcgcgtatgcgtgcacgactccagcaacgagccgtacccgccgttagatggcaggcttcagtatcgtgacgccatgcgttagcgtcaccatgcaacgataggaacacactattcgatagtataatcatgaaggcgtgacgttgccccccgatgtctatttagaagtgcaacacccttgttggtcctgtaattctaacagttaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgccgtttgcaggaggaagatgcggtccaaccgccaggggttggaatgtcagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccactgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgagaagggcgcggtggagtccaaggtcggcatggtgcggcgcaagctgttcgtgccccggccgagcgtatggagcctggagaactttaacgccgggctgccggaccggtgcctggagctggccacgaaaccgcattaccgcaaggacacggaggaacgtggcctgttctccgaggaccgtgcggcgctgctgccgttgcccgggaagcgtttcgacgtggtcacgtggcggcatatgaaggccgaccggtacggcgtggtcacgctcgagggacggcatcgttattccgcggaccgggcgaacgcgggcagagaggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacagacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatctgagtgaatacgacatcgcgttcaccgcggacgtcggcgtgcaggaaggagggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgtacccttcgacatcgacggggcgcgcctgctctaccagatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacatttccctaaccccactgcccacgtccgtccaatcaggcgtgttcattgggagttccaacgagaacggcatttgcgtcatctcctaccaatctcccaacggcaaggcgcctggcgtaattgtcgccacccccgggccgtggccctcggacggcatgcgaggcttggccataaccatttgggagaatggtgtggactcggcacaaatgcgattgatgaacacccgtactggagagttcggcacaagatggcctacaagattctcatgggttgcgatatggaactagctttccctaacccctgtcacgggccgggtcaagatgccgtattccgataggtatatcactctggttcgcgtcggccgtatcgtcaccgcctgcgcgtatatcacgctgacaagcaatttcaatcagaccagcaacgtgtccgtcaacgagacaatcccgaagggtttcagaccgtccggcgattcccgcgcggtcatgcgcggcaccgacaacagcggcgcgaccagtttctacctttacggcaccgcagacgggaaaatggtgttgaacggcaccggatataccagccgattcgtcggtatatccggctgttggattaccgagtagcattccctaacccctgtcacgggccaagtcaggatgccgtattccgacaggtatatcactctggttcgtgtcggccgtattgtcaccgcctgcgcgtatatcacgctgacaagcaatttcaatcaggtcggcaacgtgtccgtcaacgagacaatcccgaagggtttcagaccgtccggcgattcccgcgcggtcatgcgcggcaccgacaacagcggtgcaatcagtttctacctttacggcaccgcagacgggaaaatggtgttgaacggcaccggatataccagccgattcgccggtatatccggctgttggattaccgagtagcattccctaacccagcgttccacgacatggagggtcccttacagcaacgacagtatttcgctgacgcgcgtgggtgatatctgcttcgcgggcggcaacgtgaaattcaaccagagaggcgagaacaactacacacaggcgcgggagaccatacccgtggggtatcgtccagcggaaacgtcgaacgttcccatcgccgtgttcggcggcaacaccacgttcatcctctacggcgagcatacgggccgtgtggtcatgcttggcaatccgaacagcgcgtacgcgggatgcaccggcgtatggaggaccgccgacccgatgcccgccgcatagcttcgggacactggctcaggcggttgcactgtcttgcagtgaccccacgggtcatagcgcgtatgagacggtcatgccgaacgcgttcgtgccctgcgtgccgccctgattggcgtaggtcatggttccgttcgcgtttacgttgatgatcttctggttcgcgccgtcgcgtccgccaaatgagaaattcaaatccattggaggacgccagctttcaggcagggttccgaaattgccggtgttccacgagccggacgccgacgacttccagtcgatgcgcaacgtcaccatcggcccggacctatagcccttaacggtgccgtaattgccactgatgagggtcgtgacatcggtgtgggttagggaaacagactggggacaggagagtcaggcctcgtcttgggttgaggcatggaactccgcttgcctctcgagatgtccccggggagagaggccgcttgtcgagctgtatttggaacctggggttttttccgaacgatgcacggaaaaactgccccttcgtgttgacttcattcacagggtggagttcggagaggtgtccgggcatcgggttcttatcaagaggggaccgggaaatcggggtcctacggaatgtggaaccacccacgaggccacgtctggaatgtcttcgtgagaccggcctcatcctgaggtgcgaccggaaggtcgggaaccccttccagacaaagcaggggagtcgaccctcctgtccagatcaggaggggagaaagggctcagaggagggggtgccggaaaacctcagggttcctctcgagggagaccgggatttcggggaactttgtgggtcgcatccagggtgccaagtgccctttcgacctccaattcctaacgtgggacttctcctgaggcgctgtagcgggaaagggcttcatcttgcgatgacgggggagccacgtggtttttctcgagttacggcgggattctcgagttacgacggggaattcaggctgcctcttgtgttggcccaggcaagtccaatcttccattcgagttgcgaaggaaagctggggattgctctcgagtgactgcagggccaatagacctcatctaggcttgtgtccagaagccaatgttcctctccaggggcgacagggatctcggggttgcattccagacgcacccggggagacaggcattcatctcgagtggaagcaaagaaccccgctctgctctcgagtcgcgacgggtatctcttggagctcactgggtggactcaagggagtcaagcctcctgaggcgtttggagagaggtcgcgagattggtcgctaggccatgcaggagacgaaggccctcatctctcgatgacgggggaatctcggggttgttctcgagcggcggccccagtgtgcggtttctcacgaggtacgacggcgaggtcagtgagcctctcgtggggcgccagggaagtcgggtctccatgcgagtggcgagggggagcgcgtcattgctcccgagccatggtaggggaatctggcctcgagacgtgttgaagaaggtctctcgaggtctttcccgggttgaggcaggaaaccctgggttccctcgacttgtgcaggtgacctcagggggcttctcatggtggctctgagaagccagggaaactggaggtgggaggggcctctcgggactccactgggtttggtgcattggaagagggcctcatctccagttgaggcaggaaccgcagggtacctctgatttcagactccgatcgcagggtccctgcagactggggacaggagagtcaggcctcgtcttgggttgaggcatggaactccgccccgatgtctatttagaagtgcaacacccttgttggtcctgtaattctaacagttcgtcggcgaacgcctcggcgggcgtccggtagtccagcacgcgcatgggacggttgttgatctcgtcgacgatctccctgacctcctttgccatgtccatccggatctcgcagcgtttgggcagataccggcggatcatgccgttgcggttctcgttgcttccccgctgccagctggagtacgggtcggcgaagtacgtggccatgcccagcccgtcgcgcagcctttcgtggtgggcgaactcggtgccgttgtcgtgcgtgacgctgacgcgcgcgccggccggcagcggcgagaacatgtccagctgcgccccgacgctctcgccggcggtcttgtccggaacgatgcgggccatgaggaacctggtcctcctctccacctcggtgtgcaggttgcatcccactccgatgacgctgtcggcctcccaatggccgaacgcgctcctgccgtcggcctccggcgggcgttcggagatgggcactcggccggggatcgggaagcgcgacgtcctcctgccgccgtgcctgcggcgccgcctgtgccctcgcggcaggcaccgcgcccagcgttcccgaagcggcctgctggagtagacccatcggtagatggtctccgggcacacgcgcatgagcgcatcgtccggccacaggacgcgcagcctgccgctgataagcagcggcgaccagccgcggcccagccattcggccacctgcgcccacaggcggtcgtgcgacagccggtagggctttcgtggcttggatctcctgcggtcggccttgcgctgcgcgggcccggcgatgtagtagcggccggtccatggccccgccttcagtcttttcggccggtacgggcggtacgactcgttctcgttggacgggaaccatgtgttgcgcttgatctcccggctgatgctggacgggctgcggcccagcatcgcgccgatcccgcgtatgctggcgccgttgcctacctcgatctggatgacctggcgttcctcttccgacaggtgcgaatatacttctcccataggtgcgacatcccttcggactggttttctaggcaatttccaatctaacgggtgttgcactttcatttagacaacggg
